United States Patent 7,960,114 (GENE SIGNATURE OF EARLY HYPOXIA TO PREDICT PATIENT SURVIVAL (75) Inventors: Renaud G. Seigneuric, Crimolois (FR); Maud H. W. Starmans, Heerlen (NL); Glenn Fung, Madison, WI (US); Balaji Krishnapuram, King of Prussia, PA (US); Dimitry S. A. Nuyten, Branford, CT (US); Arie van Erk, Eindhoven (NL); Mic) - sequence listing, part 2

SEQ ID NO: 58 - DNA, 55009 bp, Homo sapiens
catctgaattccttctctgtggcatatgctttaggagaggagcagacagctcttagctagggtcagatttcaaattctcatctcttggtgccaataccaccaccagattcttctttgaagtcaacttttgagatcttcactaagtacacgttggtgtctgaagattcacacgagtgcctctggtaatcattttcttcagggaatcacagtctctcctctcagcaaagcatccactgtactgaactttgcttttggaaacatcttcttcctgagacctcgttgaaagaaactctctggtgtcatactttccaatatggaggtgaagaactttgcagtttgggattatgttgtatttgcagccctctttttcatttcctctggaattggggtgttctttgccattaaggagagaaaaaaggcaacttcccgagagttcctggttgggggaaggcaaatgagctttggccctgtcggcttgtctctgacagccagcttcatgtcagctgtcacggtcctggggaccccttctgaagtctaccgctttggggcatccttcctagtcttcttcattgcttacctatttgtcatcctcttaacatcagagctctttctccctgtgttctacagatctggtatcaccagcacttatgaggtaagatgatttctccattcttctctaatttttttttctcatcctcttgatgatagcacctggtagttgaagaacactcactgattttcaggataattacacattatgagaaagacattaaaatgtttttgtaaaaagcctaagctttggagacagacatatctattttcccatctgtagaaggaaaataatgatgacaatcccacagggctattttaatgatcaaatgagaacctctatgtgagcacttaatgtatggcctcatttgtaggaggtttgcaataaagagggctgatgttattttttattattgtgaacgtcatcattctgaaaagcaaacagaacatttctcatgagtacggcaattttccagctaagaaaactgagatacagataaatgacttagttaagatttttgaatagtaaagtgacctgagaacctaattttttctgtatctctacttagtggcctttccgtcagagagtagagggcattttaatacaaattataataagactaatttttaatgaggaaatggaaacatttttgaaaagtacaaaacattttaacgaaaggaattgctaaataatacaaatatgggaattatttaatgtgagggaaatgaggcagtggtgttttggctttacaatgattctcaatgaagacatcatgttcaaaattgaatttgcatgctctatatagaaatgtgatcaaacataagtttctattaataaggtatttattttcattatccaatatcattcctaaagtcactgcaggagactgaaaagagacctatttttttttaaatatgtaagctatatgagtataaaacattattctagccttcaaaagtcactcaggcaaatgaacactttttaggaagtcttaaaaagtgttattgattccatagttttatgtaatgtaatttttatgactattcactcagtaaatactcattaagcatctactcttaagatacttaaaaaggcactcttctttttttccatgtatttatttacttatttatttatttatttatttatttatgagatggggcttttgctatgtttcccaggccgttctcaaactcctgggctcaagtgattctcctgaatcaacctcccaagtagctgggactacagaagtttgccaccacacccagcttgttctaggcattctcgtagccctaggcataaagcattgcaccaagttcctgctgtcatggagcttacttcatagcagagaagggcagtcaataaacatatactgtgtaagaaaatcataatacaaatatatatggtatttaactatgtgctaagtacttctctaagttccttatgtgtgttaagtcttttggccttaaaacaatcttttttagacaggtactgtcacctccttttaacagactagaaaactgaggcatatagaattaagtaacttgctaagtgacataaagctagcaagtaacagtttttcaaaccaggcagtctaactttagatatcatatgctaaataactatgctgtcctgtcctacaaaaacaaatggagaaaaagtaaagtaaataggatgagatagagaggaggaatgctggtatgagtagagaatgtccatattcatagagggtgatcatatgaaacttcaagtaaaataagacgtctaaatggagactggaagaaagcaaataattgcaccagacaagggaagtgcatctcaggctgaagtagtcacagatgcaaaggccctagaaaaggagtgtgactggcatgttgaaggacagcaaagaaatcagtgtgcttggagaggagagagcaaaggggacaatggtaaaagataagatcaaagagatgggagtgcccagttatatacagcaggggtctcagtggagctagtgccacacagagggagcacttgggatatttgtaggatatttggttgtcacaatgattaggagtcactactgatgtttagggagttgagggcagagacatcagatgtctttcagtgtgtaaaggcacatatacaatgagtaatttcactctgcactgcatgatattttaatgccgtaatgctcaaaaactactgcacatattagtattaccttagtgcacagtaactttacaataaaaagttatacacacactataaattagcacattttccagaaattaaatgaaataaaaacactgtcttaaaattattgaacaatttacttactttgaacaatctgtctattccatatgtgctgctcattacatgcttagccataactggttttagtaaaatggcctagttactgcaaaaacaactaaaccaattgcaattatgtaactgaggagatttgattctctttttaaattaataaattagtacaagtattgaaaatataaggacttcattgaatttaatttactaaattgtttttaaaatatttactatttttgcctctacatattttcaactttttagtgacctaatagtaagtaatccagagtgtgtaaagtagatataaggttattttgggattacctcttgctttataaaaattggcattatggcatgcaagttaaaagtatggactctaggccaggcgtggtggctcacgtctgtaatcccagcattttgggaggctgagttgggtggatcacctgaggtcaggagttcgagaccagcctggccaacatggagaaactccatctctactaaacaacacacacacacacacacacacacacacacacacacacacacaaaattagccaggcatggtggcgcacatgtaatcccagctactcgagaggctgaggcacgagaatcacttgaacctgggaggttgcagtgaactgccgagatccactgcactccaacctgggcaacagagtgagactctgtctttaaaaaaataaaataaaaaagactatggactctaaagtctgttgacttggctttcagtgtcagctctgccacttgctagctgcatgaccttggcgtaaattacttaacttttatatacctggttttcacatgtgtaaaatagtggtaataaaaacatctatctcaaaggatgtctgtgaggagtaaatgatttattgtatacaaatacttttaacagagcctggcaaatagtaaatactatgtaagagtgttgcattattatgatcattgttgttgctatcttcaaatttataccacttaatctgtctatagtatctggagtttctgtttctttcttcagcctccattctctagtagttattgaaaggtatgctttctagggtctttttaaatactaaagactgaaagaggtggagtctctttatccaccctgtgaactttggccagttttgtgacttgctttgaccagcagaatgtagccaaagtgatgttctgtgagcttggagcctaggccttctgagccttgtagcttctgcctttgtcctcttggaatgctgccctgatactgctatgtaaggaaggtggcatagctgatctagcttcaggagcagcagtggacacatagagaacagagacacctagccaacagccaatacaagttaccagacctgtgagtgaggccatgtcagacctctctccattgatcttccaagttactgaagctacatgaaagtcctgatgaaaccagagagatcacccagcctgacctcagagttatgagaaataataaatttttggtttttgagccaatgagtttggaggcgagtgttatatagcaatagccaactgatttaaatgccttgatatgcagtgggatttcaagactaagatatgccatctgtgctactttatcactaccctgtcacaagtcaatgtatagggaattcttctcaccctcaagtgataatttaggcttagctagtttgcaatatcatatattttcattatctcaattgtacagtttgttattagtctcataatattatcttcactttaaagttatttccttccttctcttatcatacactcataaatctagtttgctattatttacctaatttaatattggcttataggccaatgtctacctgttctctcatatttcttggacttcttggcttctgaactacttacttctcttcaatttcaaattttctttatgataatgcccgggctactatttcactgtgttttcttgtacagtggtttctgagcatttatacattacatactttttttaggtaaatgctttccttttagttctccttcaaataacagtggtggtattgttagtaattatatttatattttgagaaattcaatgtttatctataagatattattgaatactatttcagcagagtgaacggtgctatataatatttgttgtaaaagagatatttagggtctgaaccaacgttatggggccttttaggtcatcatagggattagcttttactctagaaatgatgggtcattacagtgtttgggaagggaagtgacatgatgggatttgtatgttaagaggattactctagctagatattaagaataattttagggcttttactgctgaagcggggaggtaattgggagtttccttacataatctgagcaagagatgatagtaatagggttgtaagagaggatgaatgcaagtaaatatgttttgaaagtggggggcaagcacccagatttcttttatgaattggatgtggggagggagagagaggagtaaaggctggctctatgttatttgggctcgaaccaacctgaaaagtagagttggtatttcctgagatggaaaagagtatggctggatcaagtttggggttctgaaaataatccatcataatgttggtaaatgtcacctcaggtatttttacaagcaggcatgaagcatgcaacttctctgttgtatttttacttttgacaataggaatagcttatatatacaccaaaggtgaccactgaatgaatgagtgaatacattgaaaggaaaagtggataaattctttcagatatagaattatgcagttgcagtagtctttcttctttcacagatgagaatcctgaagcacagatcacagagtgagatgccagcaaatctcaaactggaattcaaggaggctgatttctgatcaggtctttattcatatagcttttccctagtactgtctttgtaattttactgggttgagtggaacttaactgaaatgcgaaaaccattgatttttttcaagatccctatagcaatagcctcgtggctttactggttttcaggattcgttgccccttatgttttccagacttccttgtgccacccagtaccaaagctaatgctacatatttttggtttttgttacacctccccacttctagtgccaatctttgtattcatgattatctattgctatgtagcatactactccaaaataaatgtctcaaaataacaattttagtttttcacaattctgcagattaacaattttgcctggctcagatgggccccataaaattgtgctggtctcacttgggaccatctatgtgacttccataaggtagctagttggctagcagcttgctggcctaggggaatgcaaatgagacagcttgtccttgttacctttagtctcatcctcctgtaggctaacctgagttcttcatgtgatagaaaagagttcctctcagaaagagaacacacctcattacagaagcattttcaaaatttgtacttgcaatatatttactagaaatgtctctgtcttaagttgcattctactagaagcagatcctgaaacaaggatttgaatgcaagttgatttgggggaagtgattctagtaagcagtgatagacaagtggcaacgtgaaacagaagaaaaagatgccaattaaaaatgtaattttgagcaggttaccactgtgaacaactggggttcaatccaactggggatctctaagagacaatataaagtgcgtctcagggttgtcctcactgaaaggcaaaaagccagggtattttgttccaaccccatttagtaattggctgagtgccaatgataacaccctcaagccttctgatctgccctatggccctgtgcaaaggctcagaacactctcaagcagataatctcaggcacatttagatgccatcaacatgtactggaacagggaatgccaataaactatgggtgttgcaccctcagagaccacagcagtcattaaatcctactatagccctagctctgtacctggcattatcatacttcccaccatctgatccatacaacatccactttcagaagagaaaatcatggcttagtggcagaaaatagtcttcccaagggcacaagatgtgaacccaaggtgtcttcaccacagacatttcagtgttttctaccttatgatatttgtgactgctgactcctcactgacttcccttcctctgtaatattttccttatgtctgatgccctcattcacatattcaccggactatacattctggctcacagaatatatcatctgaagagaggacctgaaaataaggtggttttctacctcaggtttgggagaatctggcaggataaattgagaatgtgagttagtataaaatggagtcacagttctgccaagagatgtcctttgcttcaaagaagggccaattgtaagccatgaaacatttatctaatgtttctagggaaaggataaattgattgtcaatccttgatttaatcaaaatgatttttttaattcagaaaagaaagaactactatcaagtagaaactactagcaagaaatttaatcctcaagccaattgatactttaaaattttatggtgtttattcaatacatgtttattatatactgaaagacatatattaatgtcttctagaatacttactgagaaaaacttttcctaatctccaaaacagtaaatgagattctactatttaggaagttcacagctacttttagctcttgtagtacatatcacaattgcaactttacttccattagtataaatatttgttaatggtcacttcgtctaatctgtaagatcctctatggtatggactatatcatatttgcttatcattttgtgtcagaatgcaatatgtaaagcaggtaacaaacatttgttgaatgaatgaatgtgtaaatgataaagataaaaatgaataaaatagaacagtacttgtatattaggaatagtaaatatggtaggctgaaaacagcataccttccccagtatatatccaggtgtaatccctgagagctgtaaatgttactttacatgtttttttttgttcgttttgaaagggattactgcaaatgtgattaaaggattttgaggtgagaaaattgtcttggattatccagagaggctctatataaatgcaatcaatcacatatatccttatatgagggaggtagtgggaaatttgacaggcaaaagaaaaggcaatgtaactgtaaaggcagaaattggagtgatggaaccagaagctaaggactgccagcagccactaacagcaggaaggcaggaagctgacttttccttaaagcctcgtgtaggagcctcctgctcacactttgattttgacccagtgaaattgatttttaacttttggttttcagtactgagaggtaataaatttctgttgtttaaagacaacaaattggtggcaattaatttatacagtattaataacaaactaatacagagagataatcaaattcaacaccaaaatataagatagcaactgataaccatgaaaaagtcttaatattagtgccatatgagctcagaggatgaaatatgagcagagccaggaatagcaattgggctgatgctttcatcaatgatctaagtcttgaatttctcatctgtgaaagaagaaagactatttcaactgcataattctatatctgaaagaatgtatttacttttccttccatctattgacagatgactaagactttgtgaaatttggggagaggggctcttatattgagagttctgcctaaatgaaggaaaggtctgaaaaagcacaaaatgtgttagctgaatgataaacaataattgtatgtggagaataaattatgtgaaggttagtgacataagaaagggagggcgtggatccgacaatggaaggtttggaatatcaagcttgggatctgcactttgtttgtcaatgatagagaattgttgaagaatttgagaaaaagagcagcatgatcagagctctgctttcaaagaattgatatgggagatatgtggttgataggatgagtgggcacagatggtattagggagatcaattggggtgccacaacagcaatccagaaaagagaaaataaaggatcgaactaaatttggagcagcaaagatataaaaggaaacaatggcttcagtgagtccactaggaagacttttgggcagaaagtcaatagagttgaatttttattgaaacaacccacttctcttctctgatcatcatgagaaacacgaacagaaattgatttttaatagatctttgacttttaacaatccatgcttttttattcctgttgcttctaaggatacatatcataaaatcagattacaagtccagagcacaacagaggatataccaagataaaaaggactttcttagcagttcttatctaaacctcactgactctgcatgtctttctgtttcctttagtacttacaactacgattcaacaaaccagttcgctatgctgccacggtcatctacattgtacagacggtaagtggtcatggctgctgcagatgtggaaactgtgaggttactagatataggtttgtttattttgggggcaataaactcagctaaaggacacttaatactaagaagacgctactttcttccaaagatagcacttttaatatgtactaaaaataacaaacaaatgtatattgcaagccacaaagggaaaaaaagccgtttgtgtgtgtgtataagccacccacattttcttaacacgtatttcactgctgtttaacctgcataagttgctctagattagatatgaaatggtctgataactaggttttgctttttttgtttttgtttttgtttttgtttttttacttgtttgctttaaccattaactgagttgaagcagaaatacctattttgcagaaagtcattttaagacaatattcccagctaatactcctacttccctctctttcttatgaactcctttcccacccccccagctttgggatgtcttcatgctgctccaaatttgcccatggcacggcattgatagacttcctactactcaccaagtactttctcctagaagataagcttcttccctcttcttaatcaaaactcccacacactgactgaagaatttaggcaagcaaatggaggaaaacaatgctcctttacctgcccatagatatttgccttttaaaaccctaacatgaatctctacatggtgaaattccgaatagagactggagaaactggacctatttccagcagggtagtggttgcacttctgggaattagaagacatattcattatggagatcaaccatgttgttagtcttcccagcacagtactttctcctcacagattctttctatctcacctctaaattccatatttcagcaaactgctaaaatatgcttctgttgcttagtaaagctcctcatgaagtcggtagagagttcactgtgacgcgtgcatcaggaaaatggatagaaggaagatgaatcaaaacttaattaagtctatttttgtatcccttagagatatacaaaatataaccataatatctcaaaattagtagcaattttgaaaatccaactctcttcctccatctaatgattacatcccctctacagactactgatagtggtgagcaacttcaaaattagagtcaacaggaatgcaatgtttcatgaacaagttgaagagaatacaagtctaacgtcgataaagaactttctaggcagttttcctttctatgtccctttctcactgccaatctgattcttgtttctctaccagattctctacacaggagtggtggtgtatgctcctgccctggcactcaatcaaggtgagttatcagcattctcttggcatattttaccatttttatgcctgaattctcaccttgcagaattagaaataaaatactttgttggggagatattcttctggttagaggattctgaattactattagaagtcattacataaagctctaaatattgattaaacattgaaaataatgcaaacaattagttacttggttttgactcatatacttctagataccaattttgattgcttttgtttgtttgggatttggtttttatttttaaatcattggaattatggcagtttcggtattgtatatgttgctaagtatggtcatctataatacagggacttcagtaatctcatgaagtagataatctcagtataaaagttgcttgtaatagttacactaaaatttatagtctattatttcaaaataatagaatcctaaaaacaaaaaggaaagaaaaaaagtcaaagtaaacttcacaatgacacctgccgtattgaaagtcctcaatattgcatttaattcagctatgtgcttatactgagaaatattaacctcagagtcagtgaggtttagataagagctgccaagaaagtcctttttatcttgatattcctctgagttttgtgctttggacttgtaatctgattttatgatatataatcttagaagcaacaggaataaaaaagcatggattgttagaagtcaaagatcactggtaattagagaaatgcaaatcaaaaccacaatgagataccatctcatgccaattagaatggcggtcattaaaaaggtaggaaacaacagatgctggagaggatgtggagaaataggaatgcttttacactgttggtgagagtgtaaattagttcaaccattatggaagacagtgtggcgattcctcaaggatctagaacccagcatcccattactgggtatgcacccaaaggattataatcattctgttataaagacacatgcacacatatgtttattgcagcagtattcacaatagcaaagacttggaaccaacccaaatgcccatcaatgatagactggataaagaaaatgtggcacatatacaccatggatactatgcagccataaaaatgatgagttcatgtcctttgtagggacatggatgaagctggaaaccatcattctcagcaaactatcacaaggaaagaaaaccaaacaccacatgttctcactcataagtgacagttgaacaaagagaacacatggacacagggaggggaacagcacacactggaggcctgtgggtgggtagggggctaggggagggatagccttaggagaaatacctaatgtggatgatgggttgatgggtgtagcaaaccaccatggcaggtgtatacctgtatatgctaggtacattcaataaaaggattgttttcctagaaaaaaagtcaaagatctattaaaactcaatttttgttcatgtttctcatgatggtcagagaagagaagtgggttgtttgaataaaaattcaagtctactgactttctgcccaagagtcttcctagtggaacctctaaggccattatttccttttatatccctgctcatggctcatgtttaggtgatttcagagtactcagactaactttgttgagaaaaacagaaactcaaaaacaaaacatttggatcaaagattggaagctacaaaatcttaggaggaacaatttgacttaacattacatgaaatgtatggactagatagaagtataaaaatataataaaaataatctttctcgaaggtgagaaaatttaatgagggaaaactctaatttgattttatttttgcctacaaagaacactgataaaaatattgtgtctttttcctcataaaacttgctcttttaattttttgaaggaaacttcttttaatatttttttcttctttcctagtgactgggtttgatctctggggctctgtgtttgcaacaggaattgtttgcacattctactgtaccctggtatgtatctagctgtgaagaagtatttaacactacctcctaatatgggataagggcaaatctccagcaataggcatctaattatagcagaattcgttattccaaaattaagcagaagtatgtcggcttatctgtcacagtttcctgaggaaggtgctgttgtttaacattcttttcattaccaacctttaggagaatttaatctctgcactcattcaagaaaatcatgcctaataagaaaaaaatctaatgaaaaagtcttcttgattagagaataggtggccctatgctacttctgagaaaaatagtttattcattcatggccctcataaaccacagatggcacttatactttacactttatgcttcactgtctactggttgagaaataacaaaatgtacatacaagtgagcagtgatggctgctattttataaacttgaggatttcacagcttgtttttgtcttgtatttctgggtaagcctggattacatttaccacttggctttacacatgctctgtttttaattaaggagcctgagttgtattgacagcatgtttatgtaattaatacaattatatatagtttagttaaacattcattgagcacctattgtttgcccattccctgcaactataatctttattcttctgagtcattgtaccatgtacaacctataattaaccagttaagcatatggtagtggttcccagacagttgaattatctttccttcactatagataaaaataaaaaattaatatattttcatatagcagatgattcatgtattttggtgttatgtgcatatcacctagtctttgtaacatctattccaattatatacaattttaaaatagcctgatctttttcatacttgcaaatcccattatttctttgcacttagttttgtcttcattttaaaaaattacattctcattaccatgattctattccagacactcaactcttcccacctatgctaaaagaatagactcttgctcctcttacctctgacctcatataatagattagttgctctgaggtacctgtccagagaagatcagctagatgctggatataacaatttctaatgcattgcttgccttgaaaaaggtatcatagctccctaagtaagtgttctcccccaaaaacaaagtaacaaaataatataaaacaatttaaaatatattaattatcagggctgatatttggaaggagtgttgtgagtaggaaggatgcatgaggctgacttgaaggcaggtggtgataacagtactactactattaaggtattgaaatttgggtcagtgaaaatgtagggaaactgagcttgggactataacattaagctagaatccttggggggagctggcatggttttactccagtgatgcacttcagattttgcaaggaaaaagtgcaaatcctctctggaggaataatccaactgaagactataagatatttacacacagataaagatctaacaataactttaacaaaatatcataaaaaatacaaaatagcaatttactgtgagtgaggatcagcaaagcaacaaacaagatttagcctctcaagaacaaaatattttggtattaaaagatactgaataagagaatagatatgcataaacaactgaaataaataaagaatgtaatttcaaagatgagtaagcatcaggaatgactgaccacacaatataatgattatgataaagagcaaatgtatttgaagagacaatgagtatgatggaaactctatccaaagaaataacctaaagaataacagagagacaagaagatgaaaaaagtgaaatagaaatggagacatatggtggacaaaataagaaggtctaattcatgtccagttgaagtctcagaggagagtataaatagaatggaggtgaggtagtgtttcaaaaaattatggattctaatttttcagatatgataaaatataagtatatatagatttagaaagtgtaaccttaaagcagaaagaaaaagaatacgtttatacctggatacattagtgaaactgtagaacagcaaatacaaatggaggacctgaaaaagagccagaggaaggagaaagagatacttaaagagggacacttagcaacaacaatggaaaccagaaacagtgggataacacattcaaagcattgaggaaaaagtattccagacccagtcataattgtgtttttgataaaactatctttcaggagttgaatgtcaagaaccaaagagaatttagcacttacagatcttccctaaagaaaaatctagaggagatactgtgggaaaaagggaaaacattaaaatatgacagttttaaacagaaaaattgataagaaaataaaatagtaaacatttaatgagtctagttaaactatttttggtatgaaatgataaccattattttataatttatatattattaaatgttttatattattgtacaatttaaaatacaaaatatatcaataattataattataattatatgccattttgaaatttagaaaaaagaattacccccaaactgtataaaaatagaatgtaaatcaggaagagagtactcagacttaaatgttttatcatccttgaatttctgaggattatggcattgcttaaatatttactctacatttaaaatgcatggcaaaatttcaaggggacccatttaaataaaatagtcaaagttaagaaaaatggagtttgaaaaagcaaccctcaattcatcaaagcaaaagaagaaaagagaaaaacaagcatagcaaaagtaggacaaatagaaaccaaaaaacatgacatcagaaacatccagatatttttataatcacaataaactaaaataaactaccttctaactggttttgtgcttccagcctcttcttgctcccacaccctgcatacctctgtcagattaatcttcttaaaatattcatttcttcatgcaactttactgatctaattctcttgttacttcctattgttcacaagataaattataagctccttagcctggtgtaaaaatctttcattctatgaatccaatctacccatataatctctgtaccacacctctgttcttctctctcgtcaaattagaggcttcacctttgctcatattgccgtctctttactctgctaagcctgtggatgtataaaatatttaaaataaccagtgaaagagaaaagagaaagtgtttgttgccatccagggttccgtagtttagtagggcaaacattagaccccaaacaaggcagtttgattaaatatgtgggtgacacacaaggtaccctcagtattaaagaaggtaagtgtgtgtgtgtgtgtgtgtgtgtgtgtgtgtgtgtgtgtgtgtgtgtgtgtgtatgacagagaaaagaggtgaggactcgctgtatgaaggagtcagacaggtcttcatggtggctataatctgccttttgattaatatctgataaagtggtttgttctcttgccttatgccaagtttatgcagatttctgcacaaccaatgccaagtatcctctgaaaacagaggcctttgacattttgtcttcatagcactaaaatcttacattgagatttgggttttgaaggcttaatggatttaagaaaattaagctagtgctacctaggaggtaacaggtaagaaatttattatacctcaaaccatgtgtgaacaaaatatataaatacagtgcctttggcaggtattttaatgtctatttttaaaattgaatttcaattttaattaaaaaagaagtgatggggcaaccccaatgtcttctttcatctcaagatgaagatgaagcctgtcatcttttcactaaagttcttgacactctggaggagtaaccagagatgataattctgtttttcaatgttaaaaataccacgtcatttcattttcatagggctcattcatttcccaagcacttattgatatatcacttcatttcatctttccccacttgctcatcccacatagatcatcatcctaagggcttctatacctgtaatactacaacagcctctctttttccttccttcttcttgcccaaatgttcccaactgtaattctacactagagtcaactggggagctttcaaaagatgctgaggaccaggccccaatccagaccttaattaattcacaacccttggggatagggcttaaatgttatttaattatttatttttccttttacattcctcaagtgactctaaaggggagctgggtttcataaccactgctctaacctcttgcctaatcattgtatcctaaattttactattagattcatcctcctggaactctgttccacttacctcaccatttgaccattctgtagctcttcaaactcattcctctatgaatgtctggaatatactattccttcctagttctttgtttgatattctaccatctcagtttcccaaaatatattccctgtcactaattttgcaaagagtgtttctagttgtgcaagccagatcctatttgttagttttcattcccttacttctttaccacctgtattcaatgaatcctaagttatgttgattttacctccaaaacagtccatccacttcttttcatctctaccttacctctatctgtcaatcatattgggcatggactgctgaaataaaatgagatggtctctcaactccttttcttttcctgcagttgattctccacacaatcaccaatgaaactgctgtgaaacaaaatctctcatcatataactcttgctaatgcttccttattgctcttgagaaaacatttaagtgtccttatcaaagtctgtgtggtcaggcctctagcaagttcacccacagagcaaattcctctttgggtgtttcacacctttgaccaacatcttccagctttcttgtattccctcagggagttgtgcttcttcacacatgctggttcccgcttctgtttgtcctctgtagttggtaaattcctactcattcttcagaaattagcttgaacatcatttcctcaagaccaggtcagggctccctgttttatgctcctatagtaacctgtctttcttaattgcactttccacatttttaagtaaatcactatcttgttgtctaacatctgcttctcccattagattataaactttataaagttaaggaaggggtatgtctctttcactttccattttgttctcatgcttaacatggtacttggcacataaaagatcctcagtggctgatgctgaataaacaaaagaatgcatgcatgcattagcagagaggctttgcagagccagtacagttacagggtttgttttcaaggactcaaacattctctctatttcagggaggattaaaagcagtggtgtggacagatgcatttcagatggttgtcatgattgtgggcttcttaacggttctcattcaaggatcaactcatgctgggggattccacaatgtattagagcaatcaacaaatggatctcgactacatatatttgagtatgtccaatgcaactttttcatactttacaaagacttagctacatgaccttatcacctaaaataatatcttaggcatcaaaggaatatctttgttcactcatttctctctgtctcatagctttgatgtagatcctctcaggcgacacactttttggactatcacagtgggaggaacttttacttggctcggaatctatggggtcaatcaatcaactattcagcgatgcatctcttgcaaaacagaaaagcatgctaagctgtaagttctcagtcaagaaaaattttaatgttttatcttaccttatttggtacttattatatattaatacttcctcttggggggtgtgtgtgtgtgtgtgtgtgtatgtatgtgtgtgtaagagagaggcagagagactcacttaactctttcaactttttgagcccagcattactactgtcatctcagcaggaagtggcagaggtggggtgtgaactgaagtcggtttgtcttttctctcaattatttgctgcctccatttattgagaaattactagattaaattaggtactgtgggtggcaatgcaaaggtaaatagctcacatttcttcctcacttgatttagcatgtggtcttttcaactattatttttcttttcatgggttaaaaggtaaactgaggcacaattaaatttttaaagagtttatttgaatgaacagtgatttatgaattaggcagttaccaaatagaagtagctgaaggcctccactgagggaacacaaggggaaaaattatagattagacatggaagcaaagcaaagcaagtatttgattggttacagctgtacagttgtcttacttggtctatccgattggaaatttcttagttagatatctctaagttagttggtggtttctgagtagttagcattaagtttcatttttttctttgatataggcatttaccagaaatagcccaagttaagcttcatttatatttgcaaaggttaagctcacttaacagatgtttgtactcttaaagtttccaaggagaggttaaaaaaataagaaaacagagggtaatgtagcaagccacagtggaactcagctgctctgactctttcctggtctgcttgttctgaaggatacaagcagaggcacaagcctcatgcattttccaagccctgcaagccaccccatgctccaaagtagagaccaaagttatatacactttcacaaaactggcagaaataagccagaactgcatccaaaatgattcttcatcttcagtgctgtttcccaaggtttcaacctccccagcctaaccaggatacttgaaacttttcttggagaaacagtcactatgaatgtttccccaggtgattttaaaatgctttcaatgcacagtttcttatttcactaaataaaatataaaattgcctggaaacgattcaaccattttgtaagttgaattccaaaaggagaactgtaatgttctccttatatatttcatagctctcagaataaggaaataaaagcattatctggcgttccatcaattcactggtaatatactcaaatcttatttcaataaataatattgtaacaaaccctccacacatgtggtcatctctttatccaatagctgtgtcattgaaaatgcatgtgactttgatccgaaaatttcatttaaaattctgctctaaaatagattatagttggctgtacctgtaaagagaagaatcctttggtaaaataaataatgattctttgttatatctagtttttaaaaatattatgagtttatattattttctgttgtgaatatgcctaatttctctatgttaatacctgaaagttaggaaatgtgtctttttaatcatttttccccacaagaccaagaacaatgctttgtgcttactaaacgtttatcgcttattaaacaaagtaatgcctcgagaaggccatgcttgtgtgtatgtatatacacagggacacacacaagtatggatgggcatatatatatgtgagtgtgtatgtgtatacacttatatacgtatatataatatatatgtaaatgaaacttaaggctaactaatcagaagccaccaatgaacttattgttatctagttaggaaatttccaacaagaaaggccaagtaataaaattatatagctgtaatcaatcaatatgtgtacacacatacacacacatttctgtatataaatcttaaaacctgatttagtaaagtagtttaattcaagaaaaatgaacacaatcccattcctatagttgcctggaacttggaatttgttgtactagtatttagtgagtatgaaagctgtcagaaaaggaggcatactcatgaagacagaaatgtacataatttcctaacaaatgtacataattttctaatattcaggactgccattcctggttccactcatgccaactcccatgaagggattaggactgtgatagtaattttgtgagaataatgaaagatgaaaaaataaaaattctctttagaaaagggttccctgagagaatctaaggtgatagggttaataaaattcaggagagagaaatcagttcagatgtttggtatagttgcagtgcacagagctggaggggagattgctgtagtgagaaaatggtgaggggggtcccatctgtcacacagctggagccttgagggcactcaggggcatctggaagccactcagagccagctgctgactgactgtcacttaggaggctctgaagatgttgatgagatgttctgcttttgttccattatctgagagcctaatgtaattaagacattccatgcggcttagaaaaatctctggtacttgaggaaaataaatcctgcaaaataggtaagtaaaaatagatccataaagttcacactaaaagtgggcatgggttagaatcaggagtggctcatatacatgcatttggtttcatgaccagaaatgtgattagtcaccaaagacaacttaatctaaagccaaatcttccttgcacctagaaatagtatcacttactgagacacttacatgtgcttcctggaagctaactgtgtttctaatcccttgtttatctttcaggtctgctggtagcaaatggtgctatgagggtagaaggagttgatgcagggtatcacgtcccatctcccagttacgatgagcacatctacacacagttgcatttccatttccacttccttagtttattttccccatatctctatcagatctaaaattatctgatttatttatttatttatttatttattttcagtgttcattacctgcttctaatcccaaaatgtaatctccatgaggttgtcttctgcattgcttcctgctatagctacaatacctagaagagggcctggtacagagagttgcccaataaatactttctgaatggatcaatgaaaaagcctattttacaaacagaagaattagccctgtatagaacccaagtccattttaaatgagaaacgaattcaaaatacaatgactttaatattctatttccactggtttctcatttcacatagttgactgatgaacttataagattgttctggataatgtatgactgtcctctgtatggctatataacctccacatatttttacagagtataactcattaaatcctcataatcctataataaaaagtaaggcagttatgttacattctttttacagatgatataactgactcagagtgttatgtgatttgtctaaagtcacacagttgttaaggataaagacttttaactccaggtccaatggtatattttaaaaagaaacagtgtaaaaaatgcagttatgtagtaaagaatttctaccattaatttcttcaatcatttcattatttcttaccaaaaaaataattttatatttgctatatgctggaactgttcagtgctctgggaacacaaaacaataatacatgaataaatatagaatttcagatcataaatactatagtgacataaataattataaggagtagaaactgacaagagagcaggaagtgactgttacaaataaggatgagcaggaaagtctctctagccagccagagcaaaggcttgaatagagttggcctgaaggttggagacagcaagagtacaactaatgcaattatcggtattgctcattttatgtagcaattgtattcccaaagcccaccaagaaaaacaaacaaacacataaaaatcattgcattggcaaaatactttcaaggaagtagactttgagataaaaacttcttctaaactgtgaggtgaaaactcctctaaatgggataattatctggcgtatttgccttataaatgtggactttgatttaagggtcttctgaaaatcaagtacacctgtacggtataggttttagaggattttgaaataaacgtgtgtctttacatttaaatatgattcccttcaaacaatgactagatcttagacaatgttcagcgttgctctcttggcctcctgcggccatctccacagtgaggttgtttattctctcaggccaaggtaaggccagcctactttcatgtcctctctggaattgaggaaattagtaaaatttttactttcaaaggacagtaatgaatacaacataaccgtaggatactacaaaaacacccagactggaattaggcatatctgtgggttttaaaataaaatgaattgcaccacatagtatgggtaagatgatcctaagttttttgtactttctgttgtctttttaaaaaaccaactctaacttttatctgcattaatctccaaagtgaatatttccaacacttatctatttctgtgttagctcattatctctctggaaaaagatgttaaaaatgtaagttgcctttttgacagttttatgaattgagtagggggaaaatcacttgaagttatataatatgagtgattggtatgtgaaatttcatccaagagaatagatctcataccacacatatcaaggttttgcaaaaactcttgatttcaaaggaaaattcacttaaaatcttactttatttaaatttggtagtgagtctaaaaatgtaatgttctcaagcaaaaaaaaaatagcaaaagtataaagtgtagtgattcttaaaggctatagaattttattttactagcaaaaagacccaaaaccctttaccttgagtacctggtaatgacctcaccacagtatgatatggtatacaggctaccaataggcccatgtgctcttttctagtgccttgtattttaacttgctgggtctctggatcattctggtgtgtgctgtcttctctggcttaatcatgtactctcactttaaagactgtgacccttggacttctggcatcatctcagcaccagaccaggtatgggttttcttgaggacagtggcgagtgtctggaatgagcgtgcttctagctattggtggataatcttggcctttctctttttcttcctggactgctcactatttctcaaaccccaagaagttggtttctttcttctcttgggtgatatcagcacctaccaggttctaatacaggggaatgagcatgtaaaaaagagggcaccttggccaggcacggtggatcacacctgtaatcccagcactttgggaggccgaggcgggcagatcacctgagctcaggagttcgagaccagtctggccaacacggcaaaatatcgtctctactaaaagtacaaaaattagccaggcaaggtggcgggcacctgtaatcccagctactcaagaggctgaggcaggagaattgcttgaacctaggaggcagaggttgcagtgagccaagatcgtgccactgcactccagcctgggcgacaagagtgagactccgtctcaaaaaaaaaaaaaaaaaaaaaagacggcatctcaccttgttcttaaagacaaggtctggcagcatagcaaggctggagagagtggaatgcaggcttgaaccatggctttggatgtcgctgctgcctttggactcttcctacaggtttcacagttgattaaggaacctcagattgaagaaaacgacccttatttccacaatgcctgcctcttatcatgtcttctcagcataacttaaacatcgtgctgatatactacagtaaacatggttttgaaaactccatttatggagaatatgctcaagggaagtaatcatttgccttccctctctatatatatttaactgtcctgctctgtcaaagaggggctcctctgccacaaacctggatgtagagtagtgcatcatatctagattccctgaagtcttcttttaggggcttgattttagggcttagttgctaacattcaggataaacacgaaagaaaatggcgtatattgaaaacaaggaaaataaacttcctacctccttttgctaaacagctatgttcccacatttcaaacactgatgagaagaccactaatcctatttttttctctctcttctcttttcttttctttctttcttctttttatttatttttttatgttttgcctcctcttcagctgatgccgtactttgtcatggagatatttgccacaatgccaggactgccaggactttttgtggcttgtgccttcagtggaactctgaggttagtatagcaacaacaatctgatgatgatgatggaaaggataacaaggatgatggtgtagtgatcaacaatatttagcaagcactcactgtgtgtaaactgaccttctgaatgtgttatttgtatttgctcattaattggtacacaacatatgagcctagaattttactcatcatcagtatacagataaggaaactgagatttagcaagatagaaaaattacctatggtgagttagtaaactgcaggggctggatgtaagccttggtctgtcccgactcaagaattttatgctcattatcctaccttgtctgatgctaattgcccccacacttttgtatcacctttacataaagcagctcactctgctggctcttctcattcatttggctacaatatatacagtctgccacatgacatttcagtcaatgatggactgcatatatgatgatagccctatattttaataccatatttttattataccttttctatggttaagtatacaaacgctttgtgattgtattacaattgcctacagtattcaggacagtaacattctgtacaggtttgtaaccgtggagcaataggctataccgtataccctaggtgtatagcagacaatgccatctaggtttgtgtaagcacattatgatgtttgcacaatgatgaaatcacctaacaatgcattttctcagagcacagccttgctattaaccaatgcatggctatatattctgcacatctattctttgcattccattgatctcatctttaataacacactcagacagctaataacttccattccccaaataagggcattattctaaatacaaaatcattcatgcatttattgtgacaaatattttagaaggcttatattataccagacacagttggtgacatcagggatactgcagagaacaagactgatataagcattgtcctcacttatatagagtttgctttctaatagacatggaagatggccaatatgtgagtaaaaaagattaacaagattgtgtctgaaaatagcaaatagtatataaaggaaataacagtgtgtatcctagagagaggtgaagtctgaggattctaatttcgatagggtctttaaggaactcctttctgaatatgtgatatttgtattgaaatctaaaggatgcaaaaaagccagctatgtgaagagcacaagcaggaacatttacaggcagggggaaaagcaaatactaaagccctgcggagacaaactgtatggagtgtttgaggaacacaggaaacactggcacctaaggccctggaaggagagcaggtggggatgagttagaagaggtgagcaaggatcagatcacaacaagcctttatgaagtggtagagtttgcatttcaagtgaaataggaagtcattagaaggttcgaaaccaagggagtgagtgacacacaaattgaagacttggtcttctgtgtcaggaagatttgagctttcctctttatatataagaaaaatagccaattgacctaggttaaggactttttttctcatttgttcattgtctatttgctttattaatgacatttttgaccacgtaaagattttaatttatattaatgttttacattatgatttcaggattaacatcattctcaaaaaggtttctccattctgtgattataaataatcaaccagacaccattctagtatacttatggttttagtaaatattaatgttattaaattatctagactatacatataagaaattaagtgaagttcctgctttattttctttgtaaactagtaaccaagttgtcccatttgtctttaataaataggccatcttttcactgctgacttgaaatattacttttattacattctatattcttctatgtatttgatacctcttcttaattatcttttacattcttttgatctactggtctttagctatgccaacaccaataattttgatgactgtactttaaaatataatttatctattaggttaataccttaattaattttattttacagaattttcctgatatctaggggttttaaaaaaatatttttagttgattctttggagtttgattgtaatcaaatatctacagatattcttgactttttttctttgtttttaatagatgcatttctatgtttattctcttatgtaattgtgctttgagaacatgataaataattaaggtaatgttttattatgtactctaaaaggaatatttgtttggtttcacaatttaataagatattgacttttggtttgaaaggtattatttatatttgagaatattcacataaattattttaaaagtagaagaataaaatgcatgtatttatgctaattttagaaaagatgtttatctgagtggtatattttggtaaaattttagcatctttgaaatggtcacatatttttctcttttaaaacttttagtatgttaatatgttgacagatttccaaaatagcaatatccttgaatttatataatgactttaccttaggattttaatttagtgtactgctaacttgtttttactaatattgtttttagaattttgcatcaatagcacacagtgacactgtcctatggtgttggcactaggatctcaaggacactaaggacagagataatgagcaccagagactcaaacaccagtaagggtcacactctgtcctttctttcgtccctctctacatgctttattttttgccctcttactctgaggctcactctctccagactggagaaatatggctgttaacagattatatcccccatgaaagaatggttgattcctttatcctaagtcccaaagtttcaaggaagaaacacactggacaacatatggtatagggagattactactgccacaagcacaaggagactgtggggatagagaaaggaaaagacaggagtagggatagaatgggaagatagtggttgagaggtaggggaaaaatatttccactatcttgtagcagccttagaatctgaaaattgacatatggatacacctgactgccaaagcaaccctgcagaggttgtacaaaccttacccttctgggccaaattcaactttctgctccctcccgcccaaaggattcaaagattaaccttgatgttggaaactttcacaagaagtatattgagacaaagattttgggagcataaaaagtccttttatttaatccccttctctccttatttaacttttatggagctccagatagaagaggagtctggcagggatcacatatcatgttttgattcttagaaaaataagaatagtaccccccaagcaattagttttcagatatgggtcttggacagtttttacttcctatatatatatatcacttagagaagtcatagctatatcttgttctcaagtgagcactggaggatagcagaataatttttaatcaatatcaatggaaaacttacaaattgctagacatcttttgttcattggcctgtttcttttccagaatttttttctcatagttgtgattttgcatcacttgaattgaatatattatctgttccactagctaaaatattccgggtctgtatgaggaattgaagaaggtctcattttattctgcaaagaaaaccccaacgttcaggtcctctgtcacctaagcaagttttaggtccaataagattgagctctgattggaaagtgacagagggaatattagaggttttatgcagtttcgatttgtggctacttcccagtcttacctcttgctactttctcttttactgttataatatcattctagcaactctggtagctttaggttgttgaatgtaacagctcctttttatgttgagacatctatacgtaatttttccttcatcctacaacatctttttcccactttgcatggattttcccagtgcctatctgtcacttccaaaggaaaaagtttccaaactacatgtcaatttaggtctctgtatgttcttacagcgtcttgctattttccttcacaactataagcaggtaaataattggttgttaaatgtttgtgtcccagttagagtgcaagatctacgtctttctggttcaccattgtatgcttgatacccagaatgaataaaaggatgtagaaataaatgaatgaataattaatgagtggcaggctctactgattcctgggttagagtagtcactactttctgcctccactccaacctgaacacacacatagacacacacacagatttcctctggtgctgcctgctagttcatttaacctcttgttaaggggaattagtgggtgttagattatgaaagcctagcttcttcactgtagttcatggaaaaattttaagagcaatagcatggaaaaagatttgaaagatgagtaaagaggccatatagttcccatggagtctcagaagatagagatatatctgcatctgttttttctagaggcctgccttatctatctgccctggacaagagggcaggctggtagctccgccttatatagcttagaccatgttctcacttttctttccttatagcaccgtggcttccagcatcaatgccttggcaacagtgacctttgaggattttgtcaagagctgttttcctcatctctccgacaagctgagcacctggatcagtaaaggcttatgtaggtacagctggtggactttctattccatatcatgaaatgtacatgtggtagatgtcaaaatcctgcatgtgctattcaggacacacttataaacacaaatgcactgtgagatatgtgaagaatcccacacatagattcttacacttccaaagatccagcagggtatcaggaaagaatgactagctagtttaccttaactgcctttattttcagatactcttctatacttaccctacactctagacgaggcttatccaacccacggcctgtgggccgcatacggcccaggatggctttgaatgcagcccaacacaaattcgtaaactttcttaaaacattctggaatttttttgtaattttttaaatcttagcagctatcattagtgtttgtgtattttatgtgtactccaaggcaactccttctttcaacgtggcccagggaggccaaaagattggacacccctgcaaactaatcacatcaatctctcttgattacactgtgtgatggtcatattagtctctctacatgggaagatgttgtgcttactatggccagtcactttgacaaagaaaagccaaattcttttctaaagaattgttccttattaccaaactcccagtaaccccctcaaagaataattgccccttgcttaatcatgcaattgcatattatgtttatactcacttcagcacttatcagagataattgcagtttcacaaggtttactttttaaagtataaacaaattatgtatttacttactaatagaaaatataggtaatttggggaaatttatgtacattgttaaataaaattatatctatctaactttgttcctggttgtttttaccaacatacttgtgacatatacaataacatatcatgttattatgtatttttttaaaaacatggtatttgaatgattatacagtattctatcaaatggcttctttgcttaattttatgttattgttactttttaaatttttttcattttcttttaatactgtgacaaaaaaaaacatgtacataaaccttcgactgcatctgtaatgtttttccttaacacgaacttctaaaagaaaattaccaggttaaataatacaaattcattgatatttcttggtacatattatgaaatatggttctagtagtgaatcaataagtatgtgtggcagcagtgagtgttgatatatattttgtgtgcttaatattagtatttttttaaattgcccaagttagtggacaaaatggcatcagatttttgctttaatttatgtcttttgatatatacagcatttttttcagatagtaatgatttgtatatttttgtaaaaaattatttttgctttctgtatatttgttgatgggacattggaaattttattgtttgtaaaatctctttatataaagaggaaataagtcctctgtctattgtagaatgtctcccagcttcccagctttattgtttttaaacatattttcatgtacagaaaattttaattttatgtttgatcaaatatatcatttattattttaccatttctttatgcttatacatttcttacattaaaaacatgtttacttatatttcctttagattgtaagtacttttatattttatattcagtatatctaaattatttatttgatttataatttaagataataaactaaatttttttttttttgagacagagtttcactcttgttggccatggcatgatcttggctcactgcaacctccacctcctgggttcctgcctcagcctcctaagtagctgggattacaagcatgtgccaccatgcctggctaattttttttttttttttttttttagtagaggtggtttctccatgttggtcaggctggtctcgaagtcccaacctcaggtgatcccccggccttggcctcccaaagtgctagaattacaggtgtgagccactgcgccaggccactaaattgtttttcttatatagttcactttcccagcattattctttaaatattcctcagttttaaaaatatttccattaataaaaatatataatataaaggtttctcatgtataagaatgtttcatgttgtatacttattttctttaattacaagagtgtaccatcttgttttatattatagccttgtagcattttatttaaatgtctgatagaacaattctcatttttctttcagtttaaaaattaaaaatgtttccattataatttttacaaaaaaattttggctattcattactatttattctcttaaattaactttaaagtttactgcatggaacctatctgaacccaccaccaccactccccatcccatgggattgcattaaacatgaaaatgtatttgggaataactgatatctttgtaagccttccacctagcaatagcatctacttttttctatttaattgtgttgtattttgtattttatgtgttaagtatactcacatcttcctctttcaactcctcttccttcctcccctttgctctcttaacaataatgattttaattatgctattgtgttatgttccttacattataataattaaattatatggccaagttttaaaactttattgtgatctctcatatacacattgcctagattctccattattattttcctatacttgctttttcatgtattcatccagttgtctattcatccattaatccatcatatttttgatacatttaaaagcaaattgtggacctctgcacacttcccccaaattattgtaacatgcacattgttaacgataattcactatttgtttcaagtttttttaaatgtaaaaaaaaattcacctataatgaaatgaacaaatattaaatacaactttcttgagtattgacgaatgcatacacctgtgtaacccaaccacttatcaggatatgtgaccttcaccgtggaaagttctcctatgccttctctagtcattcttttctctcactcaccctccagaggcaaatactgttccaattttttccaccatagattagttttacctcttctagaattttatataaatgggatcacaccattgcacttttttttttctttttgtgagacagagtttcactcttgttacccaggctggaatgcagtggtgcgatatctcgactcactgccacctccgcctcccgggttcaagggattctcctgcctcagcctgcggagtagctgagactacaggcgcatgccacgacacccggctaaattttgtatttttttagtagaaacggggtttcaccatgttggccaggctggtctcaaactcctgacctcagctgatccgcctgcctaggcctccctaagtgctgggattacaggcatgagccaccgcacccagcctgcacttttttttttttttttttgtaacgtccttcttacggcataaagtttttgagattacatgatgttttgtgtgtgttcatagtttattcttttttattgctcttagtatgccacatatggatataccacagatctttttttaacatctgagtctattgatgggcctgggctgttcttgtttgaggtcattatgactaaaactgctatgaatactcttgcacaagtcttcttgtgtacgtgtttccatttctctttgataaatagctaggcatggaattgcttagtcaactattgtcattttaatttccttgcagtttttccttatcatacccggatccatcttcatctaaacttattggtgttacaccctgtcttcctgttcttttcatcttgttttctcttgacttgtatgtccttgcttcattgagtctgtgtatccttgcagcatattaagattgccaaagttttaaactatttttttctggttcctaaagtgaattatttgcagaaagaatactatttatttcagtttttaggttaatatattcattcccatttttggcaacattttgtcatgtattctatatttcctttcttcgtttatttgtgtttgaacaagaagagaggaatgttgaccacatgtttgctaactgggtagctgaattgccttgattctgctcactctctgagttagagctgatagcaagtagatgggcactgctgccagtataattcccgatttctggcagatattcatggatactctggattgaggtagaagtttcacctatgcctgtgttttgttgtctgatcctccgagctgatgctgcattgggaaaatccatagcattttctgcaactgtggagctttcactccctctactgctttgtttttgggagatattccagatgtctatgaaatttccacaaatttctcctaaacttcctgcctagcatgctgctgttggttgcaatctggtggaaggataaagattttgtggggaggactgaatcaattctctagtcggcacaaaaaagaagaacttatgaattgagggatggctgcctagaatctcatttgaacaggtaaccattggtccagtgagagggcagtcagaaggagagaaaaaacatgtctttcttctgttcttcaggcttatagggctctcctttttcatgaagcaatacaaagtcagggcagacattgttttctgtagtcttatctatctatctaatagtctaatagtagtcaatctatctaatagtagcctatctataatagatagttggaatacttttggaattttggcaagtgcttagtgatcaatcttgaagtttccttatttttgtgtgtcttattgagaagttggaaaagatagcctcaaagatgactagcctgatttcattttaagagtgggttcctcataaggaatatcatgtaatgactctgaaataaaataataaaaatgataaatacatagtacttgctgcgtgccaggcactgttcttgggtatgtgcatatacttgttggattaatttgcaagcagtttcttcctagaatgaaagctgttagagacaggaatcacattctaactttatggcactggcatctggtgcagtgtctcatctatggttggtattcaataagattgaattaatagtcatgttgggaactgggttggatatgtagctgacagagaatgctcaaaaagaatcaacacaatagttttctttccatttctgacactgtgtctccatctctgtcaatctgctactttttgcctatctttctctctattgttttgtttatgtgttattattggaattcagtgtacttttgagattatttttaaacaaagatgtataaaaacaatgactttttaaaagatggtttagaagaagatattatttttaaaagatgacaaaatacatatgctgattcatttagcgagctttcatgataccagaagagcaccatactctgaaggtccttttggtgatatggaaacaaacaaatcattatgtaatgtaactaaggaccataaggataatataaaaaaaagcgccaaagggaaaaatctgaaaaactttccagatttgcgaaacctgttaggtagaatgtgtagacattatttaaccattgttaagatgaaaaactactggagtcctggaattagtagcttctttttcagctccttgctggagggtggttgcccaggaattaatttccactaattttgtctagattagtctggacctctcccacattttcatgttgtttccacataacagatttcttccagaagcttagaaggataacccttgaggctggatagcagttcattccgcctgatgaggaagcaggtcattgaaacttttccttggtaaagagacttcctaagtgcctctcttggggctgatgatggctgaatggggaggatggtcctcgctgagatccctttgcaaagggcttggatcagagacagttctgagtgggggctcaaggcatcccttgaagtcaggaatccctcaggaaattatgattgtaatttttctttctttcaggtctcttatttggcgtgatgtgtacctctatggctgtggctgcatctgtcatgggaggtgttgtgcaggtaacgaaagaaggaaaagacacatttggtttcactggaacttccccccactctcttttaatgtcttgcttcttcctccaagatccaaaggctgacatttaatgataccagctccaaattaaaaataaatgtaaaatgcatgtaaaatcaattctctagtcagcacaaaaaaagaacttatcttttcagaaagagaaatcactttccgaaggggaaactattaaatcactttcagaaggagaaacgattaaaactagtaatgggatagtgagataaaattagaaactcttaaaaattctgatctgagaatttattatcctgatatgaaagtagtgataaaaatagtaaaaccaataataattaacatttatgtaacacttactatgttctgggcagagtcctagatgtattatttcatttaatcttcatcacttctcttaaaggtagtataattaatgcactaattttccagatgaaggaactaggaagtaactgtctcaaagttacataattaaagagtggtagaactgggatatctgctcacctccacctatcatccaagccgaactcacaactcccaattccataaaatatcagtgctaaaaggaaccttatggataatctgtttcaacatcttcattttgcaggtgattacgggaaaaaaagtgaaaataccctgttcaagttctcacagttagtggaaaaactaggtttatgactcaagtctcctgagccacccatccccattcttcatgttgcccaactcacaaagcagcatcagataagcacatattcagattctactccgattctctcagtcccgttgtgtctttgtgggtttttttgtttttttgtttgtttgtttttttgagacagagtctcactctgtcacccaggctggattacagtagtgtgattttggttcactgcaacctctgcctcccaggttcaagcaattctcctgcctcagcctcccaagtagctgggattacaggtgcccagttaatttttgtagttttagtagagatggagtttcgccatatttgccagactggtcttgaacttctgacctcaagagatccaccagcctcggcctccgagtgctgggattacagatgtgagccactacgcctggccttttgtaatctgaacattatttagagtttcttatcatggcataagttttcaataaatgtttttcaaatgaagatatgagtcacagtaagtgaatagtaatcattaatgtttatagaaggccttccagttcccagaacagtgtaacttacttgatccttccaatgactacttagatatgttccattacttccattttaagattcagggaactaatctaggagagctaagtgatggaataattcacctgtctacataaaagaacttgtgggacatgatgtcctttctaataggccattaactactgtttcatcacagatgctttgtaatcccttcataatgtttgaagcactctgatatatacccatctacacagcagaagtggcaaggtggtgaggtttgtctttagtgatctcaggcacttattttaggtttattttcctattcatggaacctatatttccaagttgcttctgatgtcttgtgcgccacaataatatttactcttaagaaagtatcatcatgtccaactggtgatttgagtcactaaattgttttcttccagagatatttccattgtgagctcctctgcaattgaagtatgaggggctccagataggcaaggactcctccaaagactggtggaaaacaattcttgtagtgaggaggaagtcgtgagtgatgccctcatctgcctgccttagttcagatgagtatcctgggcccaccttcttgattgattaagatgtgtgccacgcagtttaagagatgttgataggcaagaaatgaaaaccctgacctctcctttcctaggagaggcatgatggctagtgacttttgtaagagattgtcaaatatttttcccacagggaagataaaattacctttactaacttattgactctcctatgtaatcactagtaaattagctttcaaattcagcaaccctagaaactgtgaattaatgctatcgtcagcagaggaaatgccaagaatattaacttaagtattgatgctgggtaagaaggaaggctttaccctcatctgcctccattttgtcaagaatatatctgaggcattgacttctttgaaattaatctggaaaaaacaatcatgcattgtaacccatctttctggaaaaaagaacttgcattacagctagaggtgatttgaagtccccttggttctatgaccttatattttttatagagaaagaagactctgaagttcaatgagtttcaacttgaacttcaaactaaattcaggttacctgcctttctactatacaaacacacacacacacacacacacacatacataaatacagtgcttatcattcatcccagaattgagaaatgacttatagaaagcacataattaacaaatggcacagtcaggactaggacccaatattatcccaggtccaagagaggtatgatgccaggaagtcacagatgcccttgagtaggggattcatctggtctgcctttgttccacaggcttccctcagcattcacggcatgtgtggaggaccaatgctgggcttattctccctgggaatcgtgttcccttttgtgaattggaaggtaaggatcccacagccctcttcacaattcccagtcaaaactgggcccagccgttttctctctcctctcagccctgtttagaaaagctatctgtcttagccaggaaaagaatccacagcagaattaaacagagcttgagtctacctgtctctgacttcagtgacatctttctgggtacagaaatgaaagaagagcagaggtagttatgaactgccacatatcctgacatcaaagctgactctttaaggttaaattaagtcttctctaaattaaaggcccacaacattaactgtaaaatagatattgaattcaagaatagttttgttgaaacacaattttgaaaattcgtatttacaaatgtaaatctcattgttttctgtgtatagttacctagatttataactaactttattaaattaattaactaatttatgtaggggagaagggacaaacttgggttctgacagctggatcttcattttgctgctctgacaagctaatagtatgtcttcaagtaaatgttggttggataactatgtattgagtttaaatcaagatgaataattatttggaaaaataacataacaatatttttaaaacatttataatagcaggattttctcagtctaacaaaattgccatctttcaattattgccatgtgcacacttacatgcatgtattttgagaaagtcttttgattccagaaagcttgactttacacttattaatgtatatactataggatattccataaagtctgtgtcagatagtatacttgattaggtctctgtggctacctgacccttattgacctttctcttagataaatcctgtggggctaagtaaaggagattgatgggtagcgagcattcgggtctttgcagcacttcccaagcagtcttaatcacttgtctgatattggggttgacaagaatattatgtctttggggagataatgtgagggaagacaatatcctagccacaaaaaatatgagctaactacataagattttagtgcactgttaacattgatttattatctatgttagtacattgtagttttttctatttggtcaggaaaaccaccttgatttctcttaatgaaatcaccttgtcattttgggcagccattggggccctcatttaccctgcaccagcctctaagacatggcctttgcctagatatttaataaagtatagtaaatattataaatttgtgtcacctctcccctcatcaatggccatagctgatcctactaaccaatcatggctctccttcccatagaatgtggctacaccttcagaatctgtctcaacatggctctccagctagccattatagatcaaccagggttaaccctccagttgaaatccattttccacttactggtaggccaggggtcagcaaacgatatgcctcaagccaaatctagctggccccctgtgtttggtatggcttcaagctagaaatggttttgacattttttaaatggttgggaaaaaagtcaaaagaagaataatattttctggcacaaaaatattacataaaattccaatttcagtgcccataaataaaattttactaaaaacacagccaggctcttctgcttgggtattgtctatagttgcttacatgccataagagaactgagttgttgtgacagatactgcatggcttacaaagcctaaaatatttattgtctgactgttatattagaaattttcagatcacttgtttagaccaaggcacaagtattcaaatcacacacactgattaaatttcttcaaacaataatggagaaagtattctggaactcttaccaaggcctcttctatttttttctgattaactagagaagccaacaggtttcttttctctgactcagaaggctcagtttcctagcagtgaccagaaacatcagattatattctctagtggtcctaatctctgctagattgttctgcctcctctacaagaaaagtgattctttgacttttcactatttatcaagaaatataaaccttaaatgacaagaccattaaatgcacttgctagtattcatactcaaacaaaaaaactcagaactagggagtcaggggactctgctggttacttaggaagagagataggagtaataatttctgtataaaagctgtcaataactaaaaatgacctagtatttgaagttttccttaacttctgaaagtcttctaatgagaattgaggtttcagcagctttttaagtagtaagagaaagaaaccctaaggagaaaaataattattgctagaaatctaaatataatgatcaccatgaaattatctgatgtcttcatttaaagaacaagtcactccttaataaacctgcattatgggagttgaggtgaaggcagtttgagcagagtgtttctgaaatatgtggccaagatttgggatggaaagccagaatctctaaggcatagaactcctcatctcattattctttccatagacagctttgccaaatttcccattaacctttttcttcttcatccagggtgcactaggaggtcttcttactggaatcaccttgtcattttgggtggccattggggccttcatttaccctgcaccagcctctaagacatggcctttgcctctgtcaacagaccaatgtatcaaatcaaatgtgacagcaacagggcctccagtactatccagcaggtatgctgactttatagatggtgctaagtcccagagagtgggtcacctggtaagagggaggtgcactcttcagagataagtgtgatgagacatatcttgttctcttatgagactcactcagggaagtacccagcactgaagagtgccacgcagggctgcagctttctgcagatgtccattcctctgtattcagacatacaaaaaccaatttggtgaaagagttaatgcgagatatgagtacaaaagagaaaaaatagtggagggttcaaagacaggtgactgggtatgaggaacatggtttcctcaaagaataaaactcagtagaagaagtttgtgagcaatgaggataatgcttatgggcaagctgagttaggagcaccgctgtgaacctatggcttctaaaccaaacaatatgaacacagggtttaacaaaggatttccctttgtacttctggctggggtaagtgatcaaatatatcaaaatacatcagatactatggtgtagagagacgattgtggactttgaaatctgaaatatttgggtttggattttggttttataatttattccctctgtatctttggacaagttagtaagttgtaacttcttgaattctcagagcccttgatggaaaaatgaggaaatatatatatatatatgaatatatatacatatatatatgaatatatatacatatatatatgaatatatatacatatatatatgaatatatatacatatatatatatgaatatatatacatatatataaagtagcactacacgtgactttaataaatgttcactctcacattctaattgtatgtaagagcaagtctagaaaatataggatttgtgttatttgtgtatcctcaaaagtacttcatttttagtagcccttttctgattatcatcaatatctccccatactggctcattccctctgagtccaggcttctcaaactggccagataatgtggcaaattgcattcatgaaagtctctctcggtccggcatatcttctcctctccattgtccttgtcaatcttgaggctagtcttgtctttacaaagtccagaaaagtgaaattatcttatttgtattttttatttcctccatttttctatctcttttcctttctaatacaacccattctatccaagcatcactagatttattttttctgaagcacctttctgaactcattactaccacatggagatgacttaaatgattcatgtgcttatggaataaaacacaacctttttatcctggagctaaatacctgccaaacttaaaactttcctgtggttttaatgttattaactattgttttccttctactctgaattctgtttcttctcgtctacctatgcttatcccactctttcctacatttgggtccttaagctattccctttacatgaatatattttagtgttcatttccactctcctaaaatctgtttatctttcaagagccatactagtgtctcctattcctccataaagttcattttgactcaggttccaaatgggcactccattattttgcttccatttgtctttgagtttcattttctttccataaattttatatcgaagaatttcaacctattcatggttccccataaaccatgttgattcttccctcctgcctatacttactgtattctcttcttagaatgctaattcctggccctgactaccctctttgcttgattaactactaattattctttcaaaatgagctgaggtatcatctcacgcattggtctgaatttgatactactctgaaggctgccatagtattttataccttttctactgaggcaaaaccaacccattttatgattgtctattagctcctgtatgtagactttgtgactttctcatctttatatcactaatgcttgtcacaattactagcactaaatctgggcttaataaaagtctgaagaataaataatacaaatgaaattgtattatttgtattaagacacaatcctcattgtaatacttatgattcagtatcaacatcgttatatttgtaattcaggaatgaattgaattgagtggaatacaaagcacatcttctctaaatataattttttaaatgacaaaaagttatgatttaggcttttgagatgccaggccctaaaatgaatcctgagcagtcctctacatcactgtgggtctttaggatgcatggaattggtgacatgtgctgttctccacagacctggaatagctgatacctggtactcgatctcctacctttactacagtgcagtgggctgcttaggatgcattgttgctggagtaatcatcagcctcataacaggttggttataattcctccctttgggactaaagaagatatgggctcatgcatgcattggtggactggctgtctgtcttattgctttgaattcacgtttcccacaaaaacccttcttcccacagagatgtctactctctcaacgctgacatacaaaggcacccttcattattatatacctgactattaatatataaaacatatattcacgggaggctgaggcaggagaatcgcttgaacccagaaggtggaggttgcagtgagctgagatggtgccattgcactccagcttgggcaacagagcaaggctccgtctcaaaaaaccaaaaaaaaccccaaccaaacaaaaaaacatatattcaaacatttcccatatattatttaaaaaaagatgctttgacacatgccccccagaggcctgagtatgaaaaaccctctgtaatataacaatcagtaaataaggttaaatattcagagtggttcttttcccttcatcccagtaagagacaagatttttgtcatcaccatcttactatctcatgaagtcagcctttgctaacttactagaaaagcaaaacactgttgtttttgcctatgttgtcctttggaggctgcttctctagggtcgtggagttctctgcagtgagcagcttcactgtaagccatttttagcaaagtgtctaccatccatacttgcccttttgatgtattaatgtcctttttgtttcaaagcccatgaggggttggtagtggtgagagtgtgggagataatggggtggaataagttcactgtactcttgtccctccacctccttggagtatgtattttagctaaaaaattttaaggtattctatttttccatgactattatataccaatgaacaatggccaacattctgactcaacacaaaacctgaatggcaacatttctggtgactgtgtactagagatgttatattgaagctccaatgccctattgttctgtgcatgatgtcactagccattcactgaaatttaagaagatcttggctatgataaagaatagactataaatcttgtaaccccagtctttcacataataacaactctctcaatgtctttatgtaaatggtttcaggcaaaagattgtttattcattttgtttagattttgccttagtaccctgacatctgtaactccttccttgatgctagtgggatatacctagacatttcagtttagtgatcggtcaccactaagaagacaaccaagatttcagctgcctgaacatttccttctaaatcaggaaatgtgtacacatgaaatccagtagtttgccagtccatattttccatgtgtgcaccagaattagcatgctcttatgttgatacagcagcacttatattaaatttgattgaaaattcttacacattttcagcatgaataactcttccagtattaatccctttgttttctttttctccaaataagccaggtcttagtcaaatgcccttcaggccaaaagcgaacactctaacaaagtctaattatgccttcaaacatttggaaaaatttttgaacatgaccaccagatgttcttgcctcctggtccctgtcttccaaatgaggccttagggctagcctgataacctcaggtctgctcactaagaggctttaacaaatcttctgtaatacccactgaatcttttaaaaagtcttacaatgtttaaatgtagaatagggtcagtaaggaaggacagaggccttttgtgggcctgttctccttgtgtcatattttatcttggtcttgtttggtcttaataggtgatgtcttcaattatacttcttccagataaaatacggcacctcgaagatatgctgtttatgttactcatacatgttgacacatagaatcatgtctgtgttgattagcaactccaggaagtttatatcattaatcattttgtgcatcagctgctgaaagatcttggcctaagatacactttaaattcttaattattactgataaaattctgctggatggctgaaagttattttttaatttttccattttagatatgtgaaatgaaaatatcatttcctaaatcaagaacaaataccattgttggtgtatcaagtggccaaaacatcccattatcaggacagtatatagagattgatgctactctgtttttcagtgtacagtagtttatatttatctgaatcttactatatttttctcatttaccataaagctgcatgtctcagatataaaatctttagttatcaatctattattttatattttagattatgtttccgtactaaggttaaatctggcctactacctgttttctttttttttttttttttttgttttctagaaacagagcttgcccatttatttgcttttaactatggttgatttcactctacaaaggcagagttgagtagtggcaacaaagatcctctggttagcaatgcctaaaatatttacaatctatctcttaacataaaaaagtaatctttgtattagataattaatctcatcagagaaatttactggactagtttataaattgtcaggaattgtgcagctctgtataacgatgagagacagatcaaaaatattctagctttcagtttgctgtggtgaaatctgataccattctaatttctgattcttgtgtgtaatctaccttatttcagtctctctctcctctttgtcacacacacacagacagaggtacatacacacacacacagatacatgcacacacacacacagatagatacacacacactcatgccattctttctgttgcaagtttatagaccatctctttattcctaggtttctgaaattttatgccctttccactcctaatctgactttcctaacttccaacttaagcctatgtcttatactcaggacttctgctgagagttttggggcttgtgcccagtagagggaccatgtggggaatggattctaggttgcattctgctcatggagtcagtaccttggcatagagttggttctgctcagaggaaggggaactttcctcaaaaccaccccaggttactatacatctagagacatttcctctataagcatgaactttcttttccttaggataaacctacttgtctacaggatatgatctcatcccctttgaccttctcttttctcacctagtatgtctacagtcctgtagtctcttgacgaacttggtttcaaccaattttctcagcagtccactgatgctcaatccccaaggtcttgctcatgaaagagatgataaatccacgattgaaggcaaacacagagcttctggtttgagaatttgagtttcattttcatttttaactttcctacctgtgagaattatagccctatactttgctttaccatctgctatctcccaaagggaatactgtctttttctagaagaaaacagaatctaaatccatatgaagcagagtcctgtccttcttagcaaatctcaggacctgctcttaagagacaatagatctacatcatttgttggagtgtttgatgattttgtggttcattcagagacaaaactcttctctgtttgaaaccctggaaatggctttgtcccaaattaaattattctgattcagagatgcccttggatagaagtttgaggttttgcaactcctcctcagccactcacacatacgcacacattaaggcaaatggagcgttacagagtgtgagatcacatatgtttaactaaatgtatacttcatcatttattagcttctagaaaagttcaccatttcctcatccatgaaatgagaataacaatacttacctatttatagggattagtgataatctatgtaaaatgtgttcagtatgtagaatacactgactaattgataaatattattatcaacagtagtagaattctatgtggccaaatgtcttttgacatagtgatgtaaatgccagggaatagattgcttaagcctcaatttagatttttaaaaatccacattttgggccaggcatagtggctaacatctataatcacagcactttgggaggctgaggtgggcagatcacctgaggtcaggagtttgagaccagcttggccaacatggtgaaatcccatctctacaaaaagaatgcaaaaaattagccgggcatggtagttcgtgcctgtagtcccagctactccagaggctgaggcaggagaatcacttgaacccgggagacggaggttgcattgagccgagatcatgccactgcattccagcctgggcaatagcatgagactctgtctcatacaaaaaacaaacaaatctacatttttttattttttttgtctctagaaagcagtttgagaaaaagtttgtggatggtcacagtatctggcacttaaaagaaatttgatcaacagtgtaaccactactccactcctccctctagggatctttacactacactgactatgggactaataactatccttgaatgatattgggtattagtgaatagtctttatgacttaaaatttgcataagttctgggaggagcaaaatcattggcctttacatcttggtttgaatatcaatttgactcttgttccacagcaggatttgaagaaataggacattgaacaggtatgtttcaaggaagggaaaaggagggtgtgaggcatgaggaggtgtgaggaatgcttaaagtacctgggaggaacatgagggtattgcttgttcaggatgttagggtgaaagaaaagaaggaacaataaaaatactctttctaattttacaaatactgacttagatgatctcaaatattaatatatctggtttggataaaaagtcaagagcttttttaaaggaagaaattgcataattactgctatcccctctgttggccaaagaaggttactagtagcattttctataatagatatttaaaaataaataggttgtctctgtttaactctacagtcatgagtctacctgacctgacaatttgttgatgtttaaaaacgaactcccacccctttcagcagttaaccaatttctgtttattaaccactcaatcttgttttcactcttattctaaaaagcaacctacttttcaagttgacaatgtttaaatctgtaaaggaagacatggaggcctgcaaccatctaatctatttgttcttttgttaataggtcgccaaagaggtgaggatattcaaccactgttaattagaccagtttgtaatttattttgcttttggtctaagaagtacaaaacactatgctggtgtggagttcagcatgacagtgggacagagcaggtgagctgatgtttgagcttctaaaaatgtgtatggactcaaagggattcctggttttgcccatttaaaccggctgcaaagatgcactggaaagggaaagcagtgagtgtgagaacttgaaggaatttgagtttcagcttcagagttatctcagctaatcagcttttaagcacataaatatgttgataggtaaaagtgccttgtagctgaattactggcattgcaggtggtcagttttcaaactgttttaacccctgtgaaggtgaattctaggaagacataaaagtgaataatagaaaaggaacaaattgaagacacattctcctataatagttcaaagcatggactttagcgtcagacagtcctgggattaatcctggttccatgtcctacattctttgggtaaattatttaactcctcaactccagcttttctgatctaaaaactggatgagtaaggggggtattatacagagcaacatggacacaagcatttccagttctatgggatataaacgtaaagcaaggtcatggtgggaatgtacaggcaaagacgcagcaagatgcacctaactctctaactccctagctctctttattctgggaaaaagaagtgtgtttagatcaggcagtactagagacactgtccaagttctattaaggtttcatcagccaaagaccaccagaaagagcctgtagttagacaaaattggacttactgacttgatgcagcaaggtggggtacttcagaggaatcggggaatgccaccctcaacaagagggaggaagaacatgtcttttgtaaggtttgggttcccactgaaggattcttaaaggggtctatgggaagcagaaaatgaccacaaagctatctggggcagcattggtaagagtgcaatggtcactcaaagggttgttacagcatttgatgactgccagaccttggcagcagctgaccttatcagtgtctgtcttcccagcttgattaagggcaggagtattttttgttgttgttgtgtttttctttttagtttaaacttatattcacttttagtcccagacattttattcttttacgattttaggagagggaagcctaacccatatcatggcaaatatttctgagttgtccattgctcttatctccagaaaacagcagaatagcatgtatatcacctaaagctgagtttattacttttggcaggaggcaagagcaccacgtttacagagaggctcagaatacagaagttaggtgcagacatgtatagaattctgagcttaagtgacttaaggtagatctttcaattcagggttcttattggaactgggcaaaactgtgttgtgagaatttaaaattggaaaacatagccaggtgagggtcctaaagtcagttttgataattgaacagtggcttgataagcaaggagtttgcttcattgaacaatctatacttttgagaaaagggctgtttacccagatgagcaatttattttgctgagaaggcagctggttaagcagcctattgtttgtataaatgaattttgaggaagttctagaagcaacggatcaagttatttgttggtttgcagactcaggaagatagaatttcctggaataaataataaacttaattaatgcaggcagccagcttctgttctcaaggataagttgaaagggaggggacactccttgtgtcactactgggctcctttgccaaaaaataatgttgagcagcatccaggggagtttgtgcataggtgtccctgtttttatcagcagactctcctattcccaggtaggaagggggccatccccatatgagatacaggtatgtttctccttataaggtaatactactacctcacaggattgctgggttaaatgagaggtatataaatttcttcatgcaacacgagacatactgtaaatgctcaataaattgttctttttgctgttattatcattagaaatagtaccttacgtggattatcaaagttatcaattagaaaatgtcttaggtcagagttgtttatgcttcttttgtacatatatataattttttgaagccaaggcctaaacaagattctctcaggttaatttggagtacatcaaggatatcttgctaatatgtgtctttgtatttccctcaggaaaaccttgagaatggcagtgcccggaaacagggggctgaatctgtcttacagaacggactcagaagagaaagcctggtacatgttccaggctatgatcctaaggacaaaagctacaacaatatggcatttgagactacccatttctaaggcaatacctgtatgaatgcacacacacacgtgcaatacacacacacacacacaaactccacatacttcttgcctacttgttagtagatatgtatagttgccattgctagaagacagggatgtctggtgcctatttctacttatttataactacatgcaaaatgactgtctctcgggatattctttgaaagactccaactttcacagagaaaaaccaacctgctccaaatgcccttgactacttccttcttgaataaattagggctggatttcattaccattcaagaaagcgaagtctttttgcttggtgtcatattaaacttcaggtttttcgttttagtagttttttaaccatcaaaatatcttggagtttagaggcagaacgggaaacagaaatatgcatatttaacactttcctgccacgagggataaaatagaggaatgacatccacccctgacctcatacctgacatacatgtagatatattttatgccacccatctcccatcctgtagctacaattggcatacaactactattaacctcccttcaccaccactgtcaggtcctcttccagtcattccagtcattagctgtcctgaccaaacattaaaaaaaaaattcagctaaatacagaagaagatggtatgtctggctagtgggagtgattataactaaaaactttgctccttttgtgctgtccatgcagtatgtcttcttcctttctatcactttacaatgaaaaattgcctcagagctcaataagaagtctagagcctttttccagggctaaggaaagagaaaaggaatgtcctatagaaggttgttaggatagaatttggtaaaagaacgttgcaaatattgtaacagaccataggagatttcatcagcaataggattcttctttggagaaaatacattgtccataagacttgtactctgctcattcaactcatgtgagcaagctcaactcactccacctgggttaggtaacagaagtggagaacttcatagttcgtgtctagaaaataatgtttaaagttctggagaatgagggtattgcagattaaaaggcgagttgacaaatgaaggagcagtgaaagatttttggaagaagtgaagaagtgaaattctgaaaaggtaaaagaaagaaccagtatgtcacaggggccaagtcagaggacagataataagaaacaaagttgtatctgagagtcatatattaggacaggtgtcagatatttattttggtggccagataaaagcaaaaggcctagaaacagtgtgttagcaaagtaagaagaaatggtccaaataggcaaggataaggaaatccaaaggttgtctttaaatatttctcaaaagagaaagccttgaaagaagcatacaatagagaaaaaataaattaccagtatttattattagaaaagatagaaagacagacaaatcagtggaggaattaaaacagagaaactggagtttataaaacagagcccaatccttgccttctctccctccactcaaatagaaaaggagaatggagaaagagaaagaaggtattaggctacagtttataagagagatgagaaaaaaatacatttgggaatagagggaaagggtcaaaaggggtcacatttggagaaatatctgaaaatgagaaggagcagaatttttggaaacattttttaaagtctggcaacgctaattaagctgttgatctaaggatttgcaaattgagaggtgcaattattttccaaatgatttgtgacactcttattaattagaatatatattttgtgaatattgaaatctgagccaaaactagttagctttattaatatcttagggaaagaagagagaaagaaagagggagggagagagagaaagaaagaaagaaagaaagaaagaaagaaaagaagaaagaaagaaagaaaaagacaggaagaggaagagagagacagaaagaataaaaaaacagcaattctgaggatgagaataaattaatggtaggtattacatatgcatatacatatatatatctgtacacatatatatgtaaatatgatttggaatacatcaggattgtgaacttccacttgggatagcataaaagcaaaatataccatacaatttttcattttactcacaaattttactcacaaattctcctaaagacatttcactaggtcagtacatttccgagaaagttttaaaaacgtttcttcttttatagtccctaattatcttacctggagtgttatcaaaatgtcatacaactggaaaatgcaattattattataaaaatatctctgccttctcttgtgtaatgaaatttatggcattaggagatgacatttcaagagattttagaggtcaatgtagagactccccccattcttcttaattgaacaaacatgcataaatctagggtttcaggtagagagcagatgggaatctacaggaaactgtcttccatagtgtatgaaaaccgtgtttgttgtgtggtgaagcaaaaggaaactatgaagcgcacagtcaatagattcagctagtgagtcccagcactcctttcaggccctcactaggattagcagcccagagtcatgccaaggccactggtgcagtacaaagacagttcagtgacaagttccatccataccatggaagagggttaaacttgtggctgtttttgccacagcatgaccagagacattctcaataaatggcactaggaatgatgagttttagaggggcctaaaatgttccaaacttgatactcaccactgtacctttaaagcacaaccacagatattggtaaaaatggaacagaattacctcaatacctctttaactcattctgtatgaattcattttgatgacagacattttttgtcaccatttggaataagaactacaacagcttatgattgaggtgaggaactgcagtcaaatggcttaggttcaaacacgagttctgacacaaatctaggtaattttgggcaatattttaaaatcttagtttattcaccaattaataggagtaaaaattacccctacttaatagaattattatgaagatttatataagtaaatcatataaagtgcttagcacagtgtgactggcccacatggaacatttaatacttggtctgcagtatatgaagaaaatggtgtacatgttaacttaaatggtttcattatttctcttcaggatttttaagatgtgggatcagaatatatgttactattttgagaattagaaataataagaaaaacagaatgtatacattaaaagtcatgcctaaatttccaaagagtagtttttttaatgccagagtttaaataaaatattattttccagagagtaacttttctaaaggtcctaaattctgaaaagagagaaaactactgttataaacaagtttattactaaaagatgcaattcattactatgatttattattattttgtacatgtaaaccttgataaataaacagcatctcaacccaagtttattactcattgcacagttcaaagcaactatgactctcaaaatagcaacagaaggtggggagggtcttttccctttgtttatatagtatttgctaaaaatgaactttactattttgtggctttatagggttacaccatttcattctaaagagaaacaaaaagtaaaccattggccatgtggctttcaaacagtatttcaaagagaatattactgaaatatttttgtgctgttacagtcttaatcaaacattattacaaagatcagatacggaaaaaatagaggagtctccccttaattgttccctttgaaataaattgttttaaattattacagaagttatagctgtatgtacatgcacatttgtatatttacaagtctcatgtacttaatctcaatattgcaaattagctaggtttactatagagttaactgcttttatctagcatttataatcttgtagtataacctattttcaaataactaaaatttaattgatgtcatcaatggtacacatgaaaatgatacaaatttataaactaataaaatgtaactcgtcattgatagtaaat

SEQ ID NO: 59 - DNA, 324976 bp, Homo sapiens
ggcccccgccgggtgctgagcgcccgccaccgccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctaggtatgtcccaagatctcttattactgctgttaatgatgattctaatagctaccatttgtcgagtacttattgcatgccagacattgcacaaagcaggttacacatacggtctcatttaaaacttgtgaggtaggcacctgttgttatccctattttccaggtgaagaaatctaggcactgacataaataacttgggatcacactgctaggaagtactggggaagggaattcaaaccatggtttatctgaactatataactgttacatctatttagaagtctgcctttgataaatttgcccaacctttttttagaattcacttacactttatacctgtgtgaaccctttcattcttttttggtatatgcataatacaagttcattccaaaaaaaaaaaaaaaaaaaagccctgccgggcgcggtggctcacgcctgtaattccagcactttggcaggccgaggcgggcggatcacagggtctggagttctagaccagcctgaccaacatggtgaaatcccgtctctactaaaaatacaaaaaattacgcgggtgtggtggcaggcacctgtaatcccagctactccggaggctgaggcagtagaatcgcttgaaccctgggggcagaggttacaatgagccaagatcttgccattccactccagcctgggcaacgagagcgaaactctgtctcaaaaagaaaagaaaaggaaagaaaaaccacctcccaccaggttaaataaataattaacattttggtatgtacccttccagacattttcctatgcatcacatcaataaatatatgataggatattttacatttgatgtatcctgaagattaattcaacaaatgtttagtgagtaggcttgttgtaggtgctgggaattcagcagtgaacaaaacaaagtctctgcctcatggagctcatattatagtagggaagactgtcaataagcaatatacacattactaaatgatagataatgcccagtaatgtggcaagttttatggaaaaataaatcaggataaaaggataagagtgatatggggattctcttagttagggtagataaggaaggcctcttagctaaggaggcacataaatatctgatcatttaatgagagaaggagcaacatggatttctagagggaaactatcctagaagagaagcagcaagtgcagtgaccctgaaatggggatttgtttggcatggagaaagggcaagaccagtgtggctggagcacagcaaatgagagaaattagatggaaatcaaggcagatcatgtatcatctggtaaggtttggattttattgggaagtgacagaatatgacgaagggttgagagcaaaggagtagctttgctgtaaaaggatcactgtgggctgggagcggtggctcacacctgtaatcccatcactttgggaggccgaggcaggcggatcacttgaggttagaagttcgagaccagcctggtcaacatggtgaaacctcatctctactaaaaatacaaaaaaaattagctgggcattgtgacgggcgcctgtaatcccagctactcgggaggctgaggtaggagaatcacttgaacctgggaggtggaggttgcagtgagccaagattgtgccactacactcaagcctgggcaacagagtgaaactgcatctcaaaaaaaaaaaaaaaaaaaaaaaatcactgtggcagctgtgtggagaatggatggtagaaatattaaaattgccctttgcctggtgaagtggtgtgtacctgtaatcccagctactcgagagactgaggcaggaggatggattgagcccaagtttgagaccagtctaggcaacgtatcgagacccccatctctaaaaaaattttaaattgctctctaaggcataaattgtccttttacatggtagttgttcaacagatagttgattaacattagtgtttcacctatagctgtacagctttacaaccactctcaacttcacatagtggaagtggggtcagtcatttaggacatatctgtgtctttgtcattgaaactcaaattttgagactggctaaggcaaatatccagatctggatgtcatgattgtcaacaatgaatatcagtaatcagtgttgtaatactgtagaaaaattagtcccacataatactgagatctagtcgttaaaaacatagcattcaggggccaggcacagtggctcattcctgtaatcccagcagtttgggaggccaaggcagatggatcatttgaggccagtagttcaagatcagcctgggcaacatggcgaaaacccatctctgctaaaaatgcaacaattagctgggtgtggtggcgcatgcctgtaatcccagcttcttgggaggcgcaagaattgcttgaaccctggaggtggaggttgcagtgagctgaaatcgcaccactgccctccagcctgttcaacagagcaagagtctgtctcaaaaacaaaaaaacaaaaatcatagcattcaactacctggaaattaccctctcccttcagttgatgttaggctctacttagaccaatttagtcagtgtgcttaagaaagatgtggagagggcaggacacggtgcctcacacctgggatccctgcattttgggaagccaaggtaggcagatcacttgagttcaggagttcaaggaggcatgagaactgggcaacatggtgaaacttcgtctctacaaaaattgcaaaaattagccaggtgtagtggcgcatgcctgtagtcccagctacttaggaggctgaggtgagaggatcacttcagcccagagggttgaggctgcattgacccagtatcacaccactgcactccagcctaggtgacagagtgagacactgtaccaaaaaaaaaaaaaaaaaaaagatgtggcaaaattaacatgcacagtgagaagaagggtaacactgattactgattaaggcagtactcctctgggtttttgtcttaagtggatgtgatagtggcatcacttacacgaccagctgaaggaagaatagatttggaggagaaattgaaagttctgttttggatctgtgttttgcattctgactggaaatgacaaatacaagtctacagctcattggaggtgtcagaactaaaactgtataactgtattagaattgtttatttggctgtgtgtcttacctagacagaccttgaggacagacactgttgtctttgtaacctcagtgctctgaagtgtatcctcaaatacttgtgaaatgagtaagtaaaggcaaaagtaaaaatgaagtcactggctgggtgcagtggctcacgcctgtaatcccagcactttgggaggctgaggcgggcggatcacgaggtcaggagatcgagaccatcctggctaacatggtgaaaccccatctcaactaaaaatacaaaaaattagccgggcgtggtggtgggcgcctgtagtcccagctactcaggaggctgaggaagaagaatggcgtgaacctgggaggtggagcttgcagtgagctgagatcgtgccgctgtactccagcctgggcaacagagcgagactctgtctcaaaaaaaaaaagaatgaagtcacttaggcaaaatgtagaagatacatactctatgctttcactgaaagtctaagcacctgaatgtgacttacaagtagggtgaccataatttctgatttgctgagaatagcctggtttatatctgttgtccctacctaagtattaatattgcctggtttcactctcagtaaagtctccatttgtacaataaatttatattgtcattctttttagaaggcccttccagatctagcatcttcctgtatctttatcatcactgccctatcttagactccatttgccagccaggtggacataccttcatttctcatatgcactcttaacttcaaggttttttttgccaaggtactgcctacctcacttagacatcacttccttaggaacacttctcctgaccccccaatggctgagttaagtcaccctcttacatgttcccagtacaccttgtatttaacctgtcatagcaaagatgactaagtgccttgttccctcactaaatatctctgtaaaggaacccaaaaaaacaccttttgtcctctttaagccataaatttatattaataatatccaaatccatgttgaaccagtatttttgaagattgaccttcaggataaactaatagcacaatcttcatgccctttcattcataactaactgaaaaggttgacttttgtaccaggaacccaacgaagaaaacttgtatcttgtcagggttggtaacctggctgccattgactgagaccaaaatatcccaacagtttgtcctcagctgctaagctgctgtggttagaatcaaacgtagagtttctggcctggtgcggtggctcatgcctgtaatcccaacactttgacagtcctaggtgggaagattgcttgggctcaggagttcgagactaaactgggtgacttagtgagagttcaactctacaaaaaaatcaaaaaattagctgggcatgatagcacacgcctgtggtcccagctacttgggaggctgaggtaggagaatcacttgagctcagacagttgaggctgtagtgaccgtgattgtgccactttactccagcctgggcaacagagtgagacctcgtctggaaaaaaaaaaaaaaggtaaagagacaacctacggaatgggagaaaatattcacgacccctacatcagataagtggacaagggcctgaaaagacattgctcaaaagaagacatgcaagtagcatgggaggccgaggcgggtggatcacctgaggtcaggagttcaagaccagccgggccaacctggtgaaaccctgtctctactaaaaaaacaaaaattagctgggcgtggtggcgggcgcttgtattcccagctactcaggaggctgaggcaggagaatcacttgaacccaggaggcggaggttgcagtgagccaagatcacaccattgccctccagcctgggcaacagcaagactctgtctcaaaaaaaaaaaaaaaagaaaaacaaaagaaaaagacatgcaaatagctaactggtatgtgaaaaaaatgttcaacatcactaatcatcagggaaatgtgaattaaaactaccatgagatatcacctcacacctgtcagaatgattattatcaaaaagcgagataagcattggcaaggatgtggagaaaaaccctgtacactgtcagtgggaatgtaaattagtacagccattttggaaaatagtatggaggttccttaaaaatttttgaatggaactaccatatgatccaataatccacttctgggtatatatccaaaggaaatgatatctgcatgtcaaggtatctgtactcccatatccattgcagcattattcaccatagccaagacatggaaacagcctacatgtatgccaatggatgaatgaataaagaaaatgtgagatatagatacacacacacacacacacacagacacacacacaatggaatactgttcagccttaaaaaataaggaaatcctgtcatttgcagcaacatagatggacctggaggacattatgcaaagtgaaataagccaggcacagaaaaacaaatactgcttaatctcacttatgtgtggcatctaaaaaagtcaagcttgtagaagtagcagaatggtggttaccaggggatgagagagaaagaattggaagattttggccaaaggatacaaaatttcagttagacagcaggaataagtgcaggagatctattatactatatggtgactatagttaaaaatatatacttgaggccaggcactgtggctcacacctgtaatcccagcactttgggaggctgaggcaggtgggtcatctgaggtcaggggtttgagaccagcctggcccacatggtgaaaccccatctctactaaaaatacaaaaattagccaggcgtggtggtgcatgcctgtaatcccaactactcaggaggctgaggcatgagaatcacttgaacccgggaggcagaggttgcagtgagccaagattgcatcactgcactccagcctgggcaacagagcaagaccctgtctcaaaaacaaaaacaaacaaacaaacaaaaatatatatatgcttgaaaattgctaagagagtagattttagttgttcttaccacacaaaaaaataagtatttgcggtaatgggtatatatttgaggtaatggatttgttaattagcttgatttagccattccacaatgagtacgtctatcaacacatgttgtacatcatgaatatacacaatttttatttgccaaaaaatgtttaaatatgccataagtaaattaaataaaatatatttcttagaacattatttataaaaataaagcaaaaaaccagatctgtccaaatataactaataaactgactctcattatttaacactcaagagttggctggtatcaggattttcataataccatggccattaaacagttttcgtgaatccaggccttcgttacccatctcttctgcttcttcctcaccttactgacttctttctcatgtacacagagtgcggaatatctgtctcatgagtcaccagcctttgggcagaacccaaaaaattaggtgaactagaaatatattgttgctaagtggctcggtttatcagacaattctaaaatgcctactaggctgcctagctgcatacttttctgcctaatgtacaggacctccatcttgtgactgtcaaaacaggctcctaaattattttgcatcatttggtgacaggcagtctatactcttgtgcaaccaacaggtgcccaataaatgcttggaatatgcaaggaacttggcattgtttaatataattgaaaaagcaagcatggactttgaaactttcctgaatttgaattctgtctccactccttatcacctttaagaatttagggcctggtgcggtggctcatgcctataatcccagcactttgggaggctgaggcgggtggatcacttgagatcaggagttcgagaccagcctagccaacatggtgaaaccccatctctactaaaaatataaaaaattagccgggcatggtggtgcatgcttataatcccaactacttgggaggctgaggcaggagaatcgcttgaacccaggaggcagaggttgccgtgagccgagatcccaccattgcactccagcctgggcaacaagagtgaaactccatctaaaaaaaaaaaagaatttagggaagttattatcttcctgcatctcctttctcctcctatgtaaaatgaaaataataatgtctaattcataagcgtttcataaggatatgatgaaagcccgatgcagtagctcacgcctgtaatcccagcactttgagaggctgatgtgggtgggtcacttgaagtcagtagttcgagactagcctagccaacatggtgaaaccctgtctctactaaaaatacaaaaactagctgggcatggtggcatgcacctgtaatcccagctacccgggaggctgaggcatgagaatcacttgaatccgggaggcagaggttgcagtaaggcatgatcagtctgttccccactctagcctgggggacagagggagactcagtctaaaaaaaaaaggtggtggggtgggatgatatatgtatgtatactactaccttgttcatggtgggagtcaaatataattttatttatagaagtgctccacaggatgatcctggggcttatttagaagttgttctacataggttaactagtgctcagcatagaatttttcattgtttaaatcaaaaactcttatctactggaaacctgtaggttcaggaacaacagccaattaaacagaatttttttttactggcagtttcttcagcattttcctcactatagaatactaaggaaagtgtatgttatctcacaggtcgcaggacaaatgtgtagttgcaatataggatggaggatccagccttgcctcaaatggagagcaaactcaggagctatgtctcatttaattaatgcaaatagtgaacaaacttatgcattattagcaattaactataagactgttccttagagtacaaagtacttttattgtaatcaaaacttaacaacaaggttaatctgatgcatatttaataatatatgtaattgttatggtgttgcatgataattaggccctacacgttaaattgtttacataaatgactgtaattggttatttttacacagccaaacacataaaacttttgcctgcttattttattaattttctagattctataatcatgccaaagacaacagtttatctgaaatcctttactacttaatcatgcagtgacaaacacactattcaaaatgacacagcagggtttcccttggtactgaaaatagctactattcaaggctttctgtatatattctgtcatttaatccctaagaaaccctctacgggtttactcgtattttatggtgttactcccattttactgatgcagagactgatacttaagagaatgtaagtaggcagcatagtggagattcagactactaccacaatccctgacactataccgtctcagaaggtaatggatcacagcagagatatgtaaagttagtttaggagacagagtggctctgaaaaatacagaatatatatagcatatccaaagggagaatgaatcaacctgaaaaagagagaggttagtcagtaatggaaccgtaatgggagggctggggctgacttagtgcccattcaaggaagagagccttggccagtgcatttcaggcattattaccccattatactccactatattatagagatacttatcagactaatgccatctaatatttaaattttaaaactaactcctgttattctaatttctttttttgagatggagtctccctcttgttgcccgggctggagtgcagtggtgccgtcccggctcactgcaacctctgcctcccgggttcaagcaattcttctgcctcagtcccctaagtagctgggattacaggcatgcgccagcacacccggctaatttttgtatttttagtagagacagagtttcaccatgttggtcaggctggtctctaactcctgacctcagatgattggcctcccacctttactgctacttctttctcttaaatctacttctccctttctggattaatgggctcttctctgtcttacctgttgtcatccaagtttctgttcttcactcttccttcttttgtgtttttccattcaatgagttcaagcaatcttgtcttctcctgtggcttccaattttccatcaatctcttgctcactccctcatctgtttaactctgacctgaatgtcccccttggcttttttccatttttttagacggagactccctctgtcacccaggctggaatgcagtggcgccatctcgggtcactgcaacctccgcctcccaggttcaagcgattctcctgcctcagcctcctgagtagctgggattacaggtgctcgccacaatgcctggctaatttttgtatttttagtagagacgaggtttcaccatgttggctaagctggtctcgaactcctgacttcaagtgatccacctgcctcggcctcccaaagtgctgggattatgggcgtgagccacagcacccagcctcccttggcttttgaatccaaaacacataattaacacataattaccaacagatgaataccacgaaggaaatttacactataaaacagtatagaagaatctgatggagtttagaaggtcagactgaggaggtgactattgagccaatatctgaaggaagagtggaaagttaaaccggctaatagtagtgaagaaggggaaagaggatgagagagtagaaacaatattccaggcagacagaacagcatgggacttgaggcaggaaaggagctagtccattgccactgaagctagagaaggggaagagtggggcagaggagactggagagaggcagattatctagggccttggcagtcgtcttgagggttttgtactttatcctgatagcagtgggaattcactaaaagttttttagcaaaagagtaacaagatcaaatctgtattttgaaaaactggttacaatgtggagaattgtatgcagattaaactgaggcaagagagtgtatggggagacagattctgaggatatggtagttcaggccaatgatatgctccctaaacccacttgttttcctaacattactttagtagaaggcaaagacgttaattcttacatagtaaatgtgcgtcgaatattagctattattattatctatagctagagataaaaggcttaaaattaatctaccaggaagaatgagttcattggagtgaaaggatttcattgaaagcatggaaatgcgaatcaaattcttttctttctagaacagagggagggagttagaggagttaaaaagtgataccacaggctggccgcgttggttcatgtctgtaatctcagaactttgggaggccgaggcaggcgaatcacaagataaggagttcgagaccagcctggccaacacggtgaaaccccgtctctactaaaaatacaaaaaattagctgggcatggtggcgggcacctgtaatcccagctactcaggaggctgagacaggagaatcacttgaacctgggaggcggaggttgcagtgagccgagattgtgccactgcactccagcctgggcaacagtgccagactctgtctcaaaaaaaaagtccgggcatggtggctcacgcctgtaatcccataatcccagcacttttggaggccaaggtgggcggatcacctgaggtcaggagttcgagacagcctgaccaatatggagaaaccacatctcaactaaaaatacaaaattagcagggcatggtggcgcatgtctgtaatcccagctactcgggaggctgaggcaggagaatcacttgaacccaggaggcggagattgcagtgagctgagattgcaccgttgcgttccagcctgggcaacaagagcgaaacttcgtctcaaaaaaaaaaaaaaaaaaaaaaagtgataccacaacagctagaagaggaggccaaactgttttttttttttttttgagacagagtctcgctctgtcacccaggctggagtgcagtggtgcgatctcggctcactacaacctccgcctacctggttcaagtgattctcctgcctcaggctcctgagtagctaggagtacaggcgcgcgccaccacgcccagctaattttttgtatttttagtaaagacggggtttcacagtgttagccaggatggtctcaatctcttgaccttgtgatccacctgcctcggcctcccaaagtgctgggattacaggagtgagtcaccgcgcccagcccccattttacatttttttatttgtgcccactgccttttttcagaggatgcagttagcaatttcagccactggatggtgcaaattcacaagagtccagtgaaagttcctcaattacggtccaaggtgcacctgttgctacactgcaccaagtgaaggagggtggggtaaaggaaagactttttggatctgaaatttcagtataaacatggatcgaagttcactagaagttcagattgagggaaatttttagaatttgatcactgacaaatcaggtcattgaataaggaaagacaaaagaaaagtgttgtaataatgaagaggaagagaaaaaggaacagatgatgaaatatgagggaaaataagtctaaagagatgaattcaagtgttagcaacaattatagtatgaccctttactggtttgcatctccctggtaactgatagcaactttgatataaaaataaagcttacttcattctcttctagaaagtcagctatgctacccttagcttatccatttggtggtgtgacattatcaacaaatatttttagtatctgctatgaacatggtgctttgttgatacaaagtaatatagagatatacaaattaacacagatactgggcttcaagcagaagaaccagtaagtacatataagaagataagtaattgactggattaagaaaatgtggcacatatacactatggaatactatgcagccataagaaaggatgagttcatgtcctttgtagggacatggatgaagctggaaaccatcattctgagcaaatatcgcaaggacagaaaaccaaacatcgcatgttctcactcataggtggaaattgaacaatgagaacacttggacacagggctgggaacatcacacatcagcgcctgtcgtggggtggggggatgggggagggatagcattaggagaaatacctaatgtaaatgacgagttaatgggtgcagcaaaccaacatggcacatgtatacatatgtaataaacctggacattgtgcacatgtaccctagaatttaaagtataatactactactactattactaataatagggaagataagtaattcaaggcaacctgagggccattgtgtcaactcagaaaatggaatactttttgaaagtgggagtggagtatcagtgggatggggaggaagggatcataggactctcaacctgtccagggcaaacaaaaaataaaaagatttcttctggcctttagtcataagtacatgcagcaactcttccttggaaaatggctagttatggacatagacataggaaaagtgctctaggtcagaatctgctgggcagtgattagaaagcatccaaaatattaataggagggggtaggagatatgaggaaataatggttaaggccagtaccactcctgaaaccaccgttgcactagcctgggagtacagaaaaggaaggatgttaatggcttgttcaggcctttcagagatccacagtcccaggtcactttgatttttgagattatgggtttatctaaaaaatgaagaaatggcaaaacagagatacaaaatatgttttatattttatttatatttatctttttttttttttttgagatggagtctcactctgtcacccagactggagtgcagtgtcaccatctcagctcactgcaacctctgcctcctgggttcaagcgattctcctgcctcagcctcccgagtagctgggattacaggcatgtgccaccacacccagctaatttttgtacttttagtagagacagggtttcaccatcttggccaggctggcctcgaactcctgaccccagatgatccacccgactcggccctccaaagtgctgggattacaggcgtgagctaccatgcctggctgttgtatattttaagtgtttctgtttaacaaagtaatgcttttaatacacacgcaaatatggctgtttacttaatgtcattcagcaataacttaaaaagtttaaattggaggtttttgtgaatgtaccttctttgccctaagcaactacctatcttaatttttgggcctatcaaaaagtattggggtgacatcaaccctttaaaaaggtggaacagcctaggcgcggtggctcgcgcctataatcccagcactttgggaggccaagatgggcagatcacctgaggtcgggagttcgagaccagcctgaccaacatggtgaaacctcgtctctactaaaaatacaaaaattagccgagcatggtggtgcatgcctgtaatcccagctacttgggaggctgaggcaagagaattggtttgaacccgggcggaggttgcggtgagccgagatcacgccattgcactccagcctgggcaacaagagtgaaactccatctcaaaaaattaaaatttaaaaaaaggtggaacagcttctagtcacctctaaaacttgaaaataaacacaacttcttgaaatgtagtagtaatatattagccaagaagaagagacagattttttttttttttttgaaatggagtcttgctttgtcacccaggctagagtgcagtgacacgatctcagctcaccgcaacctcagtctcctgagttcaagcgattctcctgccttagcctcccgagtagctgggattacaggcgcctgccaccatgcccaactaattttttgtatttttagtaaagatggtgtttcaccatgttgaccaggctggtctcaaactcctgactcaaatgatccacctgccttggcctcccaaaatgcaaggattacaggcatgagccactgcacccagccaaagagacagatttaaagtggtgtgaagaatatgaagttttgtatgtgtctttttattatatgtgtatatatatttataatgtccataaagagatatattaaccactgattacatattaaccagtgttaatgattatctctgggaagagagattaggtattacttttattctttatacttttgagtattttctaaaagcttttataatgagaatgtactttatttattttattatatactttatatatacatattttttgagacagagtctcgctgtgtcgcccaggctggagtgcagtggcacaatctcggctcactgcaagctccgcctcccgggttcacgccattctcctgcctcagcctccctagtagctgggactacagatgcctgccaccacacccggctaattttttctttttcttttttttttttttagtagagatagggtttcgccgtgttagccaggatggtctcgatctcctgacctcgtgatccgcctgcctcggcctcccaaagtgctggggttacaggcgtgagccaccgcgcccggctgagaatgcactttaataattataaaaacaaagtgtggtagcttaataagaaagaacttgcaatagaaacagcaaataaggctaggcacagtggctcacgcctggactttttaccccagcactttgtgaggccgacgcgggtggatcacttgaggtcaggagttggagaccagcctgaccaacattgtgaaaccccatctctactaaaaatacaaaaattagctgggtgtggtggcgcatgcctgtaatcccagctactggggaggctgaggcacgagaatagtttgaacccgggaagcagaggttgcagtgagctgagattgtgccattgcactccagccttggcaacagagcgaaactgcatctcaaaaaaaaaaaaagaaaaagaaaagaaacagcaaataattccacaggaataattggcacttccacagaaacagtgttttatcaagttttgtataacttggtctataatggtgacactagaaatggtgcccagctctgaagtgatctgcagatccacatcccaaagcccacacaggagttctcctttctcctctgccatctctcccatctctgtttttacagatcttcactggaagggaatataggacttgaagttattaatggattagggagtcagaaaatcctcagaggggtctatgctttgtcaggggaaacaaattgtccccaaagcaaaataattttgattctgtctgtgaatttctataaagtcagtacaaatgttacccaaattatactcttttttttttttctttgagacagtctcgctctgtcacccaggctggagtgcaatggttcaatctcaggttcaagcaattcttgtgcctcagcctctggagtagctgagattacaggtgcgcaccagcatgcctgcctaatttttgtatttttagtagagacgggtttcaccatgttgtccaggctggtctcaaactcctggcctcaagccatctgcccacctcggcctcccaaggtgctaggattacaggcttgagccaccgtgcccggcctccaattatactcttgtagaagagttgatgagcgcagattttgccataggttttatctcctgggacatctcatgtttcaggattaagggacattcagtggtgggtgaggctgggaagggtgaggatgcatgtaggcctcagttctggaccaagagcttctaagtatataatgcttttaatcatcctcaccagtggtcttgggaaagagcaggcattttttttcttcctattttattgtcaaactaagtcacagatggcaaaataaacttgaggcaacatcgtggatcagtggcaggatgcaaataatatactcattcatccaaatgccaacctcagtgctgtttcctctctactatattttcaaggtatgctctatggacatttagaggttcttttttttttcttttttttttttttgagatggagttttgctcctgtcactcaggctagagtgcaatggtgagatctcggggctcactgcaacctccacctcccgggttcaagcgattctcctgcctcagcctccccagtagctgagattataggtgccctccaccatgcccggctaatttttgtatgtttagtagagacgggtttcaccatgttggccaggctggtctcaaactccttacctcaggtgatccacccaccttggcctcccaaagtgctgggattacaggcgtgagccaccatgcctggccctagaggttctttggagcttctttgaaacatatcctcattatccatgctttatatgtgttctctttcaggctggacttgaatattaaatcgagccttagggtgagattttcccctgttggtattgttttgataatcactttttggacagcacttgaagtgaaagaaagaaggatacagtttatgtatttttttttttaaccagagaactaagaaaacagaatttcttagaaacagacacatttcaccaaaatgaaatggaatggtttcagactcttaggaaaagaagcagggcctcaccctgtcttatccctcctgacatttcctttttcacctcaacattgattcaagatcaggtggtttcactttctcaccaaactcttatttaagcaggttagatttgactcatagctattctcctgtgagaaacagcattatcataattattttgctctggaatctttgtccaaaaggtatgcaactctctattaaagtatgatataatatcagagccaccttaggaattctggatcgtcagaagacttcacttgggtactaatggtctgtagtccctgaaccccttggggataacttatgaggaaggcttttggaatgcgtagggtcaagttcccttcagcagtgtgtggatagatacatgtagtaccagaagctaaattacaaaaccttataaacgtcaaccagggagatcaggagtcccactctaagctattgagggccagtgagtgtgaagtcagctgtgaagataacagaggagctggaagctatgtcacactaacagctgccttgtttcttagaggctgtgtttgagtcttctgtcaaagagagtagtaaggtccattcatagtgcttgcagggaatactttttgttctcgtttgaggggatggaaaggtatccatttagatggatgtatgaagtgaattacagaaggttgtggctcagataggggcatgagggtaactctgctaagcccacactctcccttcattaaccaggaattggtgtttgattgtaatgtccctgctgaagatacaagtgtgaaattggcaagaatgtgcccatattaatagggagaggactgtgtagtatcattcagtctttgagatagagcagaacttttcagaagtatgtctggtggataacagtgatctctgcagctttctttgggtttgatgaattggcagcatcttgtccaacctagagattgaaaggaaatatgaaagttaaaaaaggatgcaagtgtatagttcttcatgtaccaagaaaagggctggctaagtacaaaaccccatgtaattccaagtgcacttcattttgcctctttgttaatcgataattacactgagaaagtatgatcaaggtgcacataggtatgagaaccaataattgcttggaacctataacccactagcaaagtaattaaaagatctggatcatagttctgtttctaacagctgtgtaaccttgggaagtcacataacctcttcaagcctcaacttaagtatgagtaaaatgtagatacttgccctggctactttccaggatttctgtaaggctcaaatgagataatgtatataagattgctatcttagtactatttttttttgagacagagtctcgctctgtcaccgaggctgcagtgcagtggtgtgatctcagctcaccgcagcctgtgcctcccgggttcaagcgattatcctgcctcagcctcctgagtagctgggattactggcgtgtgccaccatgcctggctaattttttgtatttttagttgagacagtttcaccttgttggtcaggctggtctcaaactcctgacctcatgatccatccacctcggcctcccaaagtgctgggattacaggcatgagccaccacgcctggccctatttttattcctttatcatttagtagcttattgtgttcatagaagttcaatcacagttgcagctacctggttatctctaattctattctggactagactttgtagtcccttcaggcctatttcttccaatgttcaggagaaatgataatttttttttttttttggacacagggtctcaccctttttcccaggctggagtgcagtggctcgatcatagctcattgcagacttcaattcctgagcccaagtgatcctcccacctcagcctcccaagaagctagggctacaggcacatgccaccagctggcttttttttttttctctctttttgagacggagtcttgctctgtcacccaggctggagtatagtggcgcaatctcggctcaccacaacctctgtctcctgggttcaagcaattctcctgcctcagcctcccgagtagctgggactacgggtgcacaccaccatgccccaccaatttttgtatttttagtagagacagggtttcaccattttggctaggatggtctcaatctcttgacctcgtgatccacctgccttggcctcccaacgtgctaggattacaggcgtgagccaccgtgcccggcccagctggccttttatagatatatagatatatagatatatatatatatatatatatataattatgtataatatataattatatataatatattatatataattatatatatataatatattatatataattatatataataaatatataattatatatatttatatataatgtgtgtgtgtgtgtatatatatatatatatatatatatatatatatatatatatacttttttttttaatagagacagtgtctcgctatgttgcctaggctggtctcaaactcctggactctagcaagtctcctgcctctgcctctgcctcccaaagcactgggattgcaggcatgatgaatcaggcctggccttaaaaatcttaaaagtaagattcttgactccaatctaaatgatctgattcagtttatatggggcccagaggtatgtgtattcaataagcaccctattgtatcatgtctggactgatgttaggaaaacagtaggataaaatcctacctatttcctgacataagaaggattgcccacatttgcttcataactgaagcagctccctgttcccagcacattaaaaaaaatattttttcacagtcctcttagggacgaatctcctagcacttatatattaaccccattttctgtttttctttttttctttcttttttttttgagacagagtcttactctgttgcccaggctggagtacaatggcacaatctcggctcactgcaacctccacctcccaggttcaagcgattctcctgcctcagccttccgagtagctgggagtacaggcatgtgccacctggctaatttttgtatttttagtagagacagggtttcgtcatgttggtcaggctggtctcgatcacctcaggtgatccacctgcctcagcctctcaaagtgctgggaatagaggtgtgagccaccacgcccggcccctaccccaccttctttaagcaaatgacataaaccacacagagaacactttccttctggggctgagagtcaggcttggattcagctgtcccaggtggctggcctcccttcttttgccatctccacaaccactggcattggcacagcttcctggctcctaggcattgatactgaagggagaaaatgactggtattaatatgaagtggctggtaagcatttggttttcttccaaacctcttgttgggcaacttaaaggaagccatctcttctaaataaaatattcagtcctattggacctatccttcctagaaaatgtctaagtacagcagaggaaaggaactgcatttagtgagcacctgtgtgccaggtgcctttcacacagaatctcaatctttataactaccatgagaggcaaatatcatgagacttattttacacatgaggccactgaggttagaacagtcaagcaactttcccaacaccactcagctagtgagtgtgagtggcacatctcctcaaattccaaagtctatgcttttctccttatgccaagctgcctctggaacagaagaaagtctttatgggtcaagttcaaggattcaatacaacagcaaacttacaggacatgggacttcaaaaattacaaatactataatggcaactccactgagcaacagggtgacagcaatcagaattttgaccacaatactccatttctgtctcttctctaggttctcatctgtgtctaaaggagagaggggagtggaagagggagaaaagaaaatttgagagaggaaagagattgatcctttgacctgaagttcttctggctcacaagactattagaggcccagactaacccagaggcagaggcagaatttccaattcaaactcagggctggagggggtgtgagggtgagctgagcatcatgggctctgctctaacttcttttgcactctcttcccactgagtcaccttccctggaattggggattttccataatcacatagggctgattcttacactgctcgcaggaagaaaaatctcgggtacacatggagctctaaacttcttttactgtcagctttatcagggttcctaccattttgctctgacacattttatgggattagaaagtcgcctttcctatgtttctcctggctttcatagaatataagaggaagaaatgtaaaaattagcactgcttctgggtcagaagctcaatctggcggcaaatggctaatatgcattttttttctcactctggcactcaagactggcatgcagtggcacaatcttggctcacttcagcctcaatctcccaggctcaaaccatcctcccaccttagcctcctgagtagctcagaccacaggcgaacgccaccatgcccggctaatttttaaaatttttttatacagacagagtctcattatatttcccgctgagcttgaactcctggcctcaagtgatcctacagtcttggcctcccaaagtgctggaatattacaggtgtgagccaactcacctggccctaatgtgcatctcattattactaatatcacatttttcccctggtagaaactaggatgtaacccaaattggaatcttacagaattttagtcctggccaatttaaggaggactgttgctaaaaaaacagtgaagaaggctgtgtgcggtggctcatgcctgtaatcccagcactttgggaggctgaggtgggtagatcacttgaggtcaggagtttgagaccagcctggccaacatggtgaaacccgtctctactaaaaatacaaaaattagccaggcatggtggtgcatgcctgttgtcccagctactcaggaggctgaggcaggagaatttcttggatccgggaggcagaggttgcagtaagctgagactacgctactgcactccagcctgggggacagagtgacactccatcttaaagaacaaaaacaaaaaaacagtgaagatgaaagtatgctgttggaggcccagcgcagtggctcacacctgtaatcccatcactttgggaggctgaggcaggcggatcacaaagtcaggagttcgagaccagcctggcaaacatagtgaaaccctgtctctgctaaaaatacaaaaattagccgggcgtggtggtgcatgcctgtaatctcagctactcaggaggctgaggcaggagaattgcttgaacccaggagggggaggttgtggtgagctgagatcacatcgctgcactccggcctgggtgacagagtgagactccatatcaaaacaaatatatgctcttggggacgggcgtggtgggcaatgcctgtaatcccagcagtttgggaggctgaggcggtaggatcgcttgagcccaggagtctgagaccagcttggacaatgtggtgagaccctgtctctacaaaaatttaaaaattagctgaacatggtggcacacacctgtagtcccagctactcaggaggctgaggtggggggatcacttgagccccagaggtcaaggctgcagtgagccatgtttgcactactgcactccagtctgggcaacacaagaccctgtctcaaaaaaaaaaaaagaaaaagaaaagcacttggttggtgtcatcactcttataattgcttagtgtttaaatattgtccatctatacatacagtggttagaattacctactacagaaatacagttttttctgtccctaattctggcgacagggtgagctcatttgcgtggagataaatgatcattgatggtgtcaaattacaaacatttctgggacctttatagagaagctaattttgttgttgttgagacaaagtctcactctgtcgcccctgctggagtgcagtgggacaatctcggctcactgcagcctccacctcttgggttcaagcgattcttctttctcagcctctcaagtagctggggttacaggtacctgccaccacgtccggctaatttttgtatttttagtagaggcgggttttcaccgtgttggtcaggctggtcttgaactcctgaccacaggtgatccgcccacctcggcctcccaaagtgctaggattacagacatgagccacagcacccggcctagagaagctaattttttaaaataaaaaattgaatgatttttcaatgtacattcagtaacttctcaacctcaagaaaaatatcagtagatccagactaacgctggggctaaaaatgtttcttttctgttcccattttactcctacttattctgtactttgtcatttcaaagctagaaaaattaccggtacttgtagttttctctccttctttattcccaggagttatagaaggggcagtggtgggaaaagtctctgatgaagcccccaggactttacattgtgagatccctggtaaaaaagctataaaacaaagtagaaaagatgaaactttaggggaaaactttatcctgcctttggttttatctgatgaaaccctgcccagctgatagtaaacttccaattgtggtcccattaacctgtctgtccataggtttagggtgtgagcacaaaataatgccaagagtaaatgaggatagagacactaataagagatatggattaaatgcccatgggacttttaactaacataggatcaaagtgaaggagtcatgccaatgatatcattgcctatcattatttaggccataataataataaagatgaaggccataaaaactgttgacagtttccttctttaaaaagagatggctccaaagtccaaggaagaacatgaaatatcacagttagccttaatgactgctgcaagtgtgtctagtagaatctagatcaactactctgagaggggactggggaaagcaggaggagctggaagaaggaaaagccacccagcttcatgtactccttgatttcattcattcagcaatttttttttttttaagacagggtccccctctgtcacccaggctggagtgcaatggtgtgatctcagctcactgcaacctctgcctcccaggttaaaatgattctcatgcctcagcctcccaagtagctgagactacaggtgcatgccatcgcacccggctaatttttatattttttggtagagatggggtttcaccatgctggccaggctggtcttaaactcctgacctcaagtgatctgcccacctcggcctcccaaagtgctggggttacagacatgagccactgtgcccagcctggccttgctttcaaaggatctctgggctactgtgtggggaatgggttggggtgggcaagggtagaaggagggtaacctgttaggaggccattgcaaaagtccagatgagagatgatgtgattcacaccagcagtggaagtgatgggagatggatagagtctagctggagtctggaaataacctcactcgtctccagaattgacctaatccaattcagacagtgtggtttctgttctatttttagtggtctcatatcattgcttattaaattaaggtctataaattctacttgacttttctaaattactcttccatgtcttaagtccatgagaaaatgatagttctttacctcagaggccagtggccatagtaccaggcactgtacatgaaatcataggggaagaggtgatccccgattccagtttaatcaggaagacagtgttggcagacattggcagagacagacataaagtcaacaagttcaaaagaaaaaacaagaacattttcatcatagtgctagtcagttcttcgaagtgataacttacatgtttataagtcacattagataaaaataaacaaatctcactttggacaagtcaccacaagttatctgtgtttttttttttaatctgtaagatggtaatagtaaaataatacttgctctacctatttcacaggggtgttgtgaagatcagaaacaaataaaaatgagaaagcatgtgtgtaaacactttgcaaactgaatgatattatgattgaaagagggggaaaaagatgacctaatgagtcatctgtctccaccagaaggaaattttgaaatattgataacagccgtcttttccttttccaaatttcttaaataataacaaatagtctccatttacctttttctacattccatgttgacccacatcttctgatgagcatttgtattgcagaacattctcacccttacagttccaaatttctattttacttgaggacattttcatgaactgtcttctgaccatttccaggacatcctcctatgcagactgtctgggacaacaggcgcacaccactacacccggctaatttttgtatttttagtagagacggggtttcactatgttggccaggctggtctcgaattcctgacctcatgttctgcccgcctcgggctcccaaagtgctgggattacaggcatgagacaccgcgcccggctctaatttttatttctaccctgtttgaggtttatcacttctggtattgagtggagatttaaattcagaataggaagtttcaaacttgtagaagggattatgtttcaaaagttcatacataaattggttgttttggaccaagtgaggtggctcacgcctataatcgcagcactttgggaggctgagttgggctcaagtgatctcacttgaggacaggagcttgagaccagcctggccaaaatggcaaaaccctatctctactaaaaatacaaaaaattagctgggcatggtggtgctgtaatcccagctactcgagaggctgaagcacgagaattgcttgaacctgggaggcggaggttgcagtgagctgaggttgcaccactgtaccccatcctgggggacaaagcgagactctgtctcaaataaataaataggttttttgggattcatcattatggtttcataaaaatgtatcatgagtgatgattaggtccccaaactaatctacaaatatccatttaatctttttgcatagctcaaatagtacagagtattagcttaaattctagatgtgggaaccaactactatgttatgaaggaaagaggaagagtttctttttctctgggaggctaaccaagtgcaaatttttgaattaggtcaggttgatctttggcatctctcctcccctttaacccctcagttttccttgtcccaatttctaagagctaatgtccttaattgccccaagtctcacaatgcctagcactatattcactccacccagagtgctccaaactccaaaatgacttaagtccacttttccccaacacagctgccatggacagcaaggtgtcacatgttaagagggaaacaattggatttaattaatttgcattaatattcaaagttcaaaaccctgccagagtcttttgagtttgtttattttttcagatggagtctcgctctattgcccagactggaatgcagtggtgtgatcttggctcactgcaacctccgcctcccgggttcaagtcattcttctgtctcagcctcccgagtagctgggactacaagcgcgtgcctccatgcctggctaatttttttattttgttttgttttgttttttgagacagagtctcgctctgtcgccaggctggagtgcagtggcgtgatctcagctccctacaacctctgcatcctgggttcaagctattcttctgtctcagcctcctgagtagctaggactacaggcacacgccaccatgcccagctaatttttgtatttttagtagagacgaggttttaccatgttggccaggatggtcctgatctcttgacctcatgatccgcctgcctcggccttccaaagtgctgggattacaggcgtgagccaccgcacctgacgcttttgagtttttaagagtttttctgtaacatcctgagagcctatccacttatttcccagttttagtctagagtttaaagttttttccattattctgcttgtggatccccaatttctctaaaaatgtcaagttttattttatttttccagtaatgtagcaatagcatctaggggactgccagtttataaagaggaaccggctacactaaagaaaaaaaaaaactatatgaaaaaaagaaagggtgagaaaaggaaaggagggcagaaggagagaaacttcaggctgaggttaagaaccactgtccagcagctgtgggggaataggcattctcccccagtgtggatatgcacaatggaaccaacctctagtgagggtaatttagcagtaactatcagcctttgatgcaacaatcctgcttcttggaatcttattgataaattgataaatcttattgataaattgcaggtatacaagaagaatatatatagatactgagtaatagtgaaagaggggaaaagaatttattaaaagaaaaaagagaaaaaagaagaatatatacggtcattgttttcggaattgtttgtatttgcaaaagattggaaacgaccaaaatatatatcaatagggggctagtagaatatagaagagacatggccgggtgcagtggctcacgcctgtaatcccagcactttgggaggccaaggcgggcagatcacaaggtcaggcgatcaagaccatcctggccaacacggtgaaaccccatctctaccaaaaatacaaaaaattaactgggtgtggtggcgagtgcctgtagtcccagctactcgggaggctgaggcaggagaatggcgtgaacccgagaggcggagcttgcagtgagctgagatcgcaccactgcactccagcctgggcaacggagcgagactctgtctcaaaaaaaaaaaaaaaaaaagactatggaagagacatactatggaataatgtaaaactgttaaaaagaatgaggcaaatataaaaaagtatggggtaaatatatacgtattgaaatggaacgacctataagatatattattaaatggaaaagcaagggattggccaggcgcagtggctaacgcttgtaatcctagcactttgggaggctgaggtgggtgaatcacttgaagtcaggagttcaacactagcctggccaacatggtgaaaccttgtctctactaaaaatacagaaattcactgggtgtggtggtgggcacctgtaatcccagctaattggaaagctgagacaggagaatcacgtgaacctgggaggaggaggttgcagtgagacgagatcgcgccactgcgctccagcctgggtgacagagtgagactccatctccaaagaaaacaacaacaacaacaacaaaataacaataacaacaaaaaacaaaaacaagcaaaagcaaggggcagaacagtgtatatggtatgttaccatttatgtttttaaaatatgcacattcatacattcttagagtatctccggaaggaaatataataagttgataatagtggttccatcagggatagagaactggagaattgagagacaggagtaggagagagacttacttttcactataaatctatactgtttgaatattttactgtgtgcatgcaaaatgaaatttaaaaaaaaaaaaacctggccaggcacggtggctcacgcctgtaatcccagcagtttgggaggccaaggcgggcagatacttgaggtcagagatcaggacctgcctggccaacatggtgaaatcctgtctctactaaaaatacaaaaattagccagccatggtggcagacacctgtaatcctagctacttgggaggctgaggcaggagaatcactttaacctgggaggcagaggttgcagtgggccaagatcgcaccactggactccaacctgggtgacagaacgagacaccatctcaaaaacaaaaacaaaaaaaaagaaattttaaaaaactgttgaaagaagatccatcagaaatggagatcacatgaaaatcacagagtatcagggctagaagggatcttagagattataaaactgactctcagagagcacgtagatttgcccaaggggaggataattcattttcttttttttttcttttattattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaacagtccccagagtctgatgttccccttcctgtgtccatgtgatctcattgttcaattcccacctatgagtgagaatatgcggtgtttggttttttgttcttgtgatagtttactgagaatgatgatgtccaatttcatccatgtccctacaaaggacatgaactcattgttttttatggctgcatagtattccatggtgtatatgtgccacattttcttaatccagtctatcattattggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatcatgagcattttttcatgtgttttttggctgcataaatgtcttcttttgagaagtgtctgttcatgtcctttgcccactttttgatgggagaaaattttcgcaacctactcatctgacaaagggctaatatccagaatctacaatgaactcaaacaaatttacaagaaaaaaaacaaacaaccccatcaaaaagtggataattcattttcttgtagcttttcctgctacggagttctggctgccttcaaggatgtcaactaaaagttagtgcctgcccccttcctcttttccaatctcacctttgccttttagaagagatccagtctgaaacttggatgtggggattaggtgacagcttgaggaggcagagctgtttctgcggggagcagcaatgattctcaggttcttcaaaatatgcttgacctttggccttctctccaaatatacaaggttgacttttactttgctgtcagagccaaggcactgcagggtagctatagtccggttttgaatgaatgttgtccttttggtttctgtgtgagtttctggaaggagaagaaccagatagaaaaatggagctggttttgttttttgtttggttggtttttttgagacggtgccttgctctgtcacccaagctggagtgcagtgtcgcaatcatggctcactccagcctcaaactccctcgatctccaagcaatcctcccacctcagcctcctgagtagctgtgactatgggactacaggtgtatgccactttgctcggctaattttttaattttttaaaagacagggtcttgctgtgttgcccaagctggtctcgaactcctgggctcaagcaatcctcccaccttggcctcccaaagtgctgggattacagacatgagccaccgcacccgaccttgaagcgtttgctcttgtggtccaggctagagtgcaatggcacgatctctgagttttgctcttgttgcccagagttttgctcttgttgctcaggctggagtgcaatggcgcaatctcagctcactgcaacctccgcctctctggttcaagtgattctcctgcctcagcctcccaggtagctggggttacaggcgtgcaccaccacatccagctgatttttgtatctttagtagagatggggtttcactatgttggtcaggctagtctcaaactcgtaagctcaagtgatccacctgccttggcctcccaaagtgctgggattacaggtgtgagccaccatgcctggccaaagctggtttttaatctgaacagtgccaagctaacccatttccattcatgacccctgctaaactccactgctgtactttctctccttttagttaacttcttcagtttgtgttcatagtactaatagacaagtcctgcctttcttctgccatggttcccatgaaggttggtgacagcagtaaatttagcacagagaaatgctcatagatttttctttaatgcagagaggggtaggttctgcctccttctcttttttcatctccatccatttgagtaatataagcatgccttaggtaatgacagttaatttaaagattggtttccagaaagccccctgggaggatacatatccttaaaataggatatttgagatatgggctaggaagtgggaagatgagatatcttttaaaggtaaaaattttttggaatggcaatatcattttccagaaaggacccattccctaccttgcatttgcaattctctgatgcttctcacgtcttttgggaagatcccaggcagctgttccagtcggcaactgctatctctgaggtctgggggtgagcagagggggaggaggggaaccggggaaggtttggggaaaatcagaatttactggtacttactttttagaattctgggcaatggagaagatatgaaagattgcagttcctgctcataaaacttgcaacttgggagatcaaacactctctaaaaagactttacttttatttatttatttatttatttatttatttatttatttattgagacggagtctcactctgtcgcccaggatggagtgcagtgacgtgatctccgctcattgcaacattcacctcctgggttcaagggattcttctgcctcagcctcccgagtagctgggattacgggcatgcaccaccatgcccagctaatttttgtatttttagtagagatggggtttcgccattttggctatgctggtctcaaactccttacttcaggtgatccacctgccttggcctcccaaaagtgctaggatgacaggtgtgagccaccacgcccggccctcaaaaaagaacacccagccaaatacatacaaagtagtagttgacctagtataaagaatactgtgtaccaatctattacccttaggacaaagaaaggtcaaatagagttaagaaaatttactaagttaatgaaagtctaaccaacccatttccttaaatactgcttattttctcttctccctcctattctgtcttctttcttgtattaaataaagcttttggagatttatattgtctgaccttggtatctctataggtttccacagaaccataggtcttagttatttatgctttttggcacataattcaaagggttgtgacatttttataatttgtcaaattcgttactgctgcactttgtgccatttggtcttaattctgattagctaattttatttttttattttaattttttattttttgagacagagtctcattctgttacctaggctggatttcagtggtacgatctcagctcattgcaacctcacctcccaggtttaagtgattcttatgcctcagccacccgagtagctgagattacaggtgcatgccaccatgcctggctaatttttgcacttttagtagagatggggtttcgccatgttggccaggctggtctcgaactcctgacctcaggtgatccaccaatcttggcctcccaaagtgctgggattacagtcatgagccaccatgcccagccttgattagctaattttagagatgaaatgtttatgaaactttgaaaactcatattttaaataagcagttaccaaagagcagcaaatgatgccattccacccaatatcaccctttccctcagctctccccacccaagaatatcaccgtctagctatttacatgtaccaacttaaaaaaggcaacatcttatgaacagtatgaatttgggaaccttaggtgatgacaatactgaaactctaaagaaagccatccaacagtgaaaggacttttaatgttaattacatgaacaagacataagaatgcatcacattctctgaagacctctcatcatgaaacagacagctatctctctggaatgaataagttgcagtccttcttagaggcgagtggatacatgggattaactctggaaagtattgcttgctggatatcagctacatctctatctggtggaagagaccccgaaactctttctaggcctctctctgtattttccaggagattaggctagagaattacatacctttcttgttggcatcataggatgcaatgattaggctgaagaccaagatggtatccatgttagcttgagcacatgctcattgcagacagaccactgctcatctgtcacagcccttgatagctctgcctctagttgctttcaccacacgcagctggaaccaagtttgaccctgagagactctgattccaccctgattattttgccccatttcctgaagacccaggaatagatctaattggagaaagggctaattctgcttattaataattcactcagacttcttctgacttcgctgccggtgccgacatagagaactagattacctagaggtttctcgagcaggaaggccataaacgcccattgatatgctttacaaatacttgcagatagacacgtagacatttacatgcatgctcactgacacaggcacagagatttatatactttcatgaaaagatgtggagatttctagtaaggaatataatttctagagcaggaattatagaaatagagcaggaaactaggactaggagtcagtacaattgagttctagtacaggcccttttatgagctatcaccttgagaaaattacttgacttcttgggatctaaatgttctcttctataaattgagagtcctgaaccatatgatctcttttttttttgaggcagagtctcgctcggtcgcccaggctggagtgtagtgacacgatctcggctcactgcaagctctgtctcccaggttcacgccattctcctgcctcagcctcctgagtaggtgggactacaggcgcccactaccatgcctggctaatgtttttgtatttttagtagagacagcgtttcaccgtgttagacaggatggtcttaatctcctgatctcgtgatccacctgcctcggcctcccgaagtgctgggattacaggcatgagccaccgtgcctggcctttttttttgtgaaatggagtctcgttctgttgcccaggctggagtgcagtggcataatcttggctcactgcaaccttcatctcctgggttcaagtgattctcctgcctcagtctcctgaatagctgggattaaatgtgtgtgccaccctgccggctaatttttatatttttagtagagacaggtttcaccatgttggccaggctggtctcgaactcctgacctcaagtgatctgcccccatcggcctcccaaagtgctgggattacagccgtgagccaccccagccggccctgaaccatatgatctctagaattaatccagttatatatataaactcacattagcacagacatacctattgagttttgcacatcttcacactcctgaatagtgaagtgagtattggtggacaacattctgatgaccattgggctgagaggttgtgaggaagagctaaatacggcaggtgagtggtactgtctgtggcttgggaaggttttcctagacagataactgttgttgaagatttttccaaatttgtatttttttagtgtctagtgtaataatctgtagactttgtcatggcatagatagatggagcataaaagagaatgaagggccgggcgcggtggctcacgcctgtaatcccagcactttgggtggctgaggcgggtggatgacctgaggtcgggagttcgagaccagcctgaccaacatggagaaactccatctctactgaaagtacaaaaattagctgggcatggtggcgcatgtttgtaatcccagctacttgggaggctgaggtaggagaatcgcttgaacctgggaggtggaggttgcagtgagccgagattgcaccattgcactccagcctgggcaacaagagcgaaactccgtctcaaaaaaaaaaaaaagaaaagaaaaaaaagagaataaagatctaccccatctttatcaaactctacagcttctttggtcttgttttattttggagatgggctatgttttgtagagacacagtctcactgtgttgcccaggttggtctcaaactcctgagctccagtaatctgcccaccttggcctcccaaattgctggggttacaggtgtgagccactgcacccagactagaaaactttttaaaaaagttttgctatgagaaagaaagcagagaaatgaggccactgactagagggaacataaatgcctcacatctttattggtccaaggaaatctttattcatcctccccaccctcttgcctctggctgcctgcttctcttagcagaggaggtggttagggcagaggggctccattgccttccttgggttttgtgatttttgcttactatttccttaacatgatgacatgattctctgctcccctgaggtattatcaccttccctcctgttgctctatttgaaactctctgtacattagttcctagatgccacggtacaatgctgccaccttggagcaggagtaggaattgatctgagggcttgctgttctcatccagtgtcacaaggtggcaaaagagctcacttttcccaaaagagaccttgtgcttggcgaaagatgaagtctaagagttttctttgatcacctcgcagaccctacccttttcttttgtaacttaaagactctaaagtcagcctgggccaggcacggtagttcacacctgtaatcccagcacgttgggaggccaaggcgggtggacacttgaggtcaggagttcaagaccagcttgactaacaaggttaaaccctgtctctactaaaaatacaaaattagccaggagtggtagcgcatgtctctaatcccagctacttgggaggctgagacaggagaatcatttgaactcaggaagcagaggttgtggtgagccaacagcacaccactgctctccatcctaagcgacagagcaagactccatttaaaaaaaaagtcagcctgcatattggagtaggccatactgtcgggggcagagcggtggaagagctgcagtcaaaatatccaggagtaggccgggcaccgtggctcacgcccataatcccagcactttgggaggctgagtcaggtggatcacgaggtcaggagttcaagaccagcctggccaacatggtgaaaccccatctccaccaaaaatacaaaaattatctgggcgtcgtggcacatgcctatagtcccagctacttgggaggctgaggcaagagaatcacttgaacccgggaggcggaggttgcagtgagccgagattgcaccactgcactccagcctgggtgacagtgcgagactccatcctcccccaccaaaaaaaaaaaaaatccaagtgtagacaaatagatccatgtttctattatttctaatagactatttctctactcctagatattttgactgactttctaagcatttggaatatcagtggagcagagtatatctcttctgatctccttttcccacaacaaaaacatcaaatttagcaggaaaaaagttatgagttttatgacatatgcagttcagagatatggcgttggaagagagtaggaactaggaccaaatggatgaatcaggatgggtctgcagaaggagcacttgacaggaagccaggaggcctaccctaggctctttaattgactaaatcaatttgaacaggtcacttgtcttctcttggcctctatttcggtttctgtaatgaggtggttagacaaaatggcttacaaggcctcttctagctttaaaattattgtacctgcacactatgctactctttttttttttttttttcgagacagagtctcgctctgtcgcccaggctggagtgcagtggcgcgatctcggctcactgcaagctccgcctcctgggttcacaccattctcctgcctcagcctcccaagtagctgggactacaggtgcccgccaccacgcttggctaattttttgtatttttagtagagatggggtttcaccgtgttagccaggatggtcttgatctcctgacctcgtgatccacctgccttggcctcccaaagtgctgggattacaggcgtgaactactgcgtctggcttatgctactgctttttaaaggctgcatgccattttgttcatttgttttggtttgtttttaaatttaaaaaatttaataatggaggcagggtctcagtatgttgccgaagctggtcttgaactcctggctcaagcagccctcccaccccagcctctcaaagtgctgggatcatagggatcagccaccagcatggccattttatttctttatttcttttcctttatttttttttgagacgtagtctcgctgtgtcccccaggctggagtacggtggcgtgatctcagctcactgcaacctccgcctcccaggttcaagccattctcctgcctcagcctcccgaataggtgggattacaagcgcccatcaccacgcctggctaatttttgtatttttagtagagacggggtttcaccatgttggtcaggctggtctcaaactcctgacctcaagtggtccacccgcctcagcctcccaaagtgctgggattacaggcgtgagctactcggcctggccgcggccgttttttaattgtggaatataccatatatacaggagagtatatagaacataagtatattttcaataataataataatactgaaaaggtgaacatatgttaccatcacccaaattaagaaattgaacattgccagcatcatggatgctctttacatgtctgtgcctctggtcctccggtctctttcctcctcccaatctttatttttccatgttttgtaaaatcattgaactatcagccgggcgtcgtggctcatgcgtgtatcccagcactttgggaggctgagttaggtggatcacctgaggtcaggagttcaagacacgcctgaccaacatggagaaaccctgtctctactaaaaatacaaaattagccaggcatggtggcagatgcctgtaatcccagctactcggggggctgaggcaggagaatcacttgaacgcgggaggtggaggttgcagtgagccgagatcgtgacattgcactccagcctgggcaacaagagtgaaattccatctcaaaaacaaacaaacaaaaaaattgaactctctatatatgtatcactaaaaatattttgtttacttttgaatgttatataaatggaatcaaactctatgtattttttttttttttgagatggagtcttgctctgttgcccaagctggagtgcagtggcataatctcagttcactacaacctctgcctcccaggttcaggcgattctcctgcctcagccttccaagcagctgggattacaggcatgtgccaccaagtccggctaatttttgtatttttagtagagacggggtttcgccatgttggccggcctggtctcgaactcctgacctcagggtgatccgcccacctcagcctcccaaagtgcagggattacagggatgagtcaccgtacctggcctaatttttatttatttatttatttatttatttacattatttttggagacagagtctagctctgtcacccaggctggagtgcagtggcacaatctcggctcactgcaacgtccacctcccgggttcaagcaattcttctgcctcagcctcccaagtagttgagactacaggcacacaccaccatgcccggctaatttttttttttttttttttttttagtaaagactagttttcaccgtgttgcccaggctggtcttgaactactgagctcaggcaatccgcctgccttggcctcccaaagtgctaggattacaggcgtgagccaccgcgtctgggctggaaatttcttttatgtgttctcccagtcactcctcaccatcaaaagtaaatattatcagctggacactgtggctcacacctgtattcccagtactttgggaagctgaggcaggtggatcacctgagctcaggagttcaagatcagcctggccaacatggtgaaacaccgtctctactaaatatacaaaaattagatgggcatggtggctcatgcctgtagtgcagctactcaggagtctgaggcaggagaatcgcttgaacccaggaggcagaggttgcagagccgagattgggccactgcactccagccttggtgacagagtgagactctgtctcaaaaaaaaaaaaaaaggaggggccaggcgcagtggctcacgcctgtaatcccagcactttgggaggccaaggagggcagatcacctgaggtcaggagttggagaccagcctggccaacgtggtgaaacctcgtctctactaaaaatacaaaaattagatgggtgtggtggtacgcacctgtaatctcagctactcgggaagctgaggcaggagaattgcttgaacctgggaggtggaggttgcagtgagccaagattgcaccactgccctccagcctgcagttacagagcaagactccatctcaaaaacaaaacaaaaaaaagaatgtattatccagattcttgccatcacaaatgagttttgcctatttttttttttctagaaatggggtctctctctctctgtgtgttgcccaggccagatttgaactcctaggctcaagtgatcctaccatctcagcttcctgactagctgagactacaggggcatgcacctggcttgttttgcccatttttttgttgttgttttattttgacagggtcttgctatgtcacccagcctggagtggaattgtgtgatcaagactcactgaagcctccaactcctgggctcaagcaatcctcccacctcagccacccaagtagctgggactacaggcgtgtatcacttgcccagctaaattgtttataatttttgtgagatagggtctccctatgctgcccaggctggtcgcgaactcctggcctcaagtgatcctcctgctttagcctctcaaagtgctagaattataggcatgagccactggtacctggcctgttttgcctgtttttgtagcaggaaacatacattttttgctcaacattatgttggtaaaatccatccgtatttcttcatgtagcaatcatctgttcattctcattgctttataatatttcattgtatgaatgtatcacaatttatatattcattctgctgttgagagacatttgtgttgtttccagtttgtagccataatgagcaatgtttctggggcagttttgaaagtttctccagggtataaatccagaagtagacgctggttatagggtatgtagggtatgtacaactttaccaattaatgccaaactgttttctaagggattgtcctcattacactcctacttgtaatatatgcaggttcctactattacacatgcttgccaaaggggccaaagaatctttcctgtgtgatgcaataataagcctgagtggggccaggcatactcacacgtgccagccctttggttggtactcagaagctcaggccacagtcatttgctccttccaagtaagggtaaaggattcataatatcccaaggtccctgatcacatgctccattaacctggaaatattggggcggatgggttggtgaactgaattttcattttattattattatttttttagatggagtcttgctcttgtcacccaggctggagtgcaatggcgcaattttggctcactgcaaccaccaccacctgggatcaagtgattctcctccttcagcttcccgagtagctgggattacaggttcccgccaccacgcccagctaatttttgtatttttagtagagacagggtttcaccatgttggccaggctggtcttgaactcctgacctcaggtgattcacccaccttggcctcccaaagttctgggattataggtgtgaaccacagtgcccagccactgaattttttatttatttattttttgagacggagtctcgctctgtcacccaggctggagtgcagtggtgcaaacacggctcactgcaacctccgcccctcgggttcaagtgattctccttcctcagcctccctcatagctaagacagggcctccactctgttgctcatggtgggtgcaggaggcagtgaatttagtaatgacacaattttttgtttgtttgtttgtttgagacggagtctcactctgtcttgcccaggctggagtgcagtggtgtgatctcggctcactgcaacctccgcctcccgggttcaagcaattctcctttctcagcctcccaagtagctaggactataggtgtgtgccaccacacccggctaattttgtatttttggtagagacggggtttcatcatgttggccaggttcatcttgaactcctgacctcaggtgatccacccaccttggcctctcacagtgttgggattgcaagcataaaccactgtgcccagcaatcacaatttctgaattaattgaggatccataaagcattctgttctgtatcgattactaataggaaatgaaaggaaaggaacatggagagaaaggggaaagtaatattttctgtgtgcctactatctaacaagctctgtgccagaagcttaacatgttggttacatcatttaatccaaaacaccaccttagaaggtaggctttatatcctgaatataagatagatatatataatatagataaggaaactgaggctcagaaaggtgtcagttcctcaaggccacagagctaattagcgacagagtcaggatttaaagcatagcctgattaaagagctcaagctgtttataatacagagcacagagaaggtagagttgctgccgctcttgagactgacactgccaataccaagaatcggttcttctcagttttgcttgcctgtattcacccgcaaaactatgttattcaactgattatgaccatcttgttcattgattgaagctacatttccttttcatggattttttgttgtctttattctttcttctttttttttttttctttttccaataagaaaattgggcacatcagcacaataggtccactgataaacaagacttgtgttggaaaataactttctacctgcaggtctaggagttaaccagaggtgagatgatatatatatatatatttttttctgagacgcagtcttgctctgtcactcaggctggagtgcaatggcatgatcttggctcactgcaacctccgcctcccggattcaacggattctcctgcctcagcctcctgagtagctgggattataggtgcctgccacaacacccaggtaatttttgtacttttagtagagacagggtttctctatgttggtcatgctggtcacaaactcctgacctcaggtaaccctattgccttggcctcccaaagtgctgggattacaggcatgagccaccacacctggcccagaggtgagattttttttttaaaaagacgtgacattgtggccaggtgcagtggctcacgtgtgtaatcccagcactttgggaggctaaggcgggtgggatcacaaggttaggaattccagatcagcctggccaaaatggtgaaaccctgtctctactaaatatacaaaaattagccaggcgtggtggcaggtgcctgtaatcccagctacttgggaggctgaggcaggagaattgcttgaacccgggaggcagaggttgcagtgagctgatatcgtgccactgcactccagcctgggtgacagagtgagactccgtctcaaaaaaaaaaaaaaaagacatgacattgtgaaatcttctgctctaagatatcacatacaggaaaattttaagacaaggtattaaaaggataaaaagaaattgaatgatggctcaatttttcttgacgataaaggctctacaaaattattaatgttatattttattatgtattgtgtttcatatataataacaacaatagagagtgaaggtagaagacaggtagaggcctaaatatgtagcaggaaaaacctgaacctgatataggaatgatggagacactagggaagtctaaagagaaggtagggatggggcaggaaatcaacttaccaggagcaccgtcatggctttagaggaaagtgaagtcagggatggctaggctataaagctgatcaacataaaatgtcagaatcctacgactgggcaaaatccaaacaagtcatcttgtccattttcctgtttttaaagagccctttaaaatttctccaggtattttagttgtgaggtgtgtaggacttagaaagggatcttaaaaacatatatattggaggtgtcatggaggaagaagttaagatttggtaactggctgaagtatagagactggaagtgtttgccattggataaggaaggagtgagagcagaaatgccatgtgaaaaccctgtgtccatgtgaaaacatcgtggggagtctctactactcatgctgtccttcattgtgcaattctacctttcatcattaggaccagacttatgaagtggccttcctgaggagattttctgaccttatggtatgaagttccttcaggctcttaattctggataaactggagtgattaacaagagcaaagagacatagtattcagataaggactttgtgtcttatttttcttttatatcacaactggagccacagttgtgggcaaggcactgactttcttgatgaattctgtccatctgtaaagcagctatatatcccactggaggctttgcctctcagagacaacgtgaagacggataagcaggcatcaggagcagagtggcctctcaggtacagagctaatctttatttcagtcaatgaagcgcttactaatagaaatacctagtcctacttgaagagctataaaagggggtagcaaactataagagatggtctctgccttcaggatttaactggagagctaaaaccagtatgcagacaaaaaaatatatcctaattaaattctgaactgtgggccaggcatggtggctcacacctgtaatcccagcattttgggaggcagaggtgggaggatcatttgaggtcaggtgtttgagaccagcctggccaatatagtgagactctgtctctgccggaaatacaaaaattggctgggcatgtgattccagctactcgggaggctgaggcaggagaatcacttgaacccgggaggcggaggttgcagtgatctgacagcacgctactgaactacagcctgggagacagagcgagactctgtctcaaaaaaaaaattctgaactgtgtggtatgaccatattgctacaagaattcaaaggagagagagatcagtgaaagctggagaagtaagagaaatcttggagaaaatgggacttccaaggactagaaagattcagaaaaataggagaaaagttggacaagtctgccaccataaacaaaggtataaggataagaataagcatggcaagtgccagaagccagattaaagtatgactattggtggtcagcaggaaataatatcccaataattcctctattctctgtcctaaaaattgatcactgaccttgttatctacgaatttggattcatggtcagacagccccaggacagggggctcttcatggttctattttcttttctttttcttttttttttttttttgagacggagtctctctctgtctcccaggctggagtgcagtggcctgttggctcactacaacctctgcctctcgggttcaagcgattctcctgcctcagcctcgtaagtagctgggattttaggtgcccgccaccatgccaggctgatttttgtacttttactagacatgggattttgccacgttggccagcctggtctcgaactcctgacctcaggtgatccgcccgtcttggcctcccaaagttttgggattacaggcatgagccaccatggctggactcttttcttttttttgagatggagtcttgctttgttgctcaggctggagtacagtggtgcaatctcggctcactgcaacctctgtctcctgggttcaagtgattctgctgcctcagtctcccaagtagctgagactacaggcacgtgccaccatacccagcaatttttttattttttatttttatttttttgacagagtctcactctgtcacccaggctagagtgcagtggcacgatctcggctcactgcaacctctgcctcctgggttcaaacaattctcctgcctcacctcctgagtagctgggattacaggcgcctgccaccatgcccagctaattttttgtatttttagtacagacagggtttcaccatattggccaggctagtcttgaactcctgatctcaggtgatccacccgcctcgtcctcccgaagtgctgggtttacaggcatgagccaccgtgccctgccgcaaattttgtatttttattagagacagggtttcactatgttggccaggctggtctagaactcctgacctcgggtgatccacccgccttgtgttcccaaagtgctgggattacaggcgtgagccaccatacccagcccatggttctattttctattaaggcactttgtttcctcccttgattcaactcaaacctgacttgagagactttcttgtcctaagagtgacaggtattgaaggccttgttgttcaacagagactctggcacacaaagaggggaacaataatgataaatcttaaacgactgttctcaaactttagggtgattaattattagggatgctttaaaaaaagaaaaagtcggccaggtccagtggctcacgcctgtaatcccagcactttgggaggccaaggcgggtggatcacaaggtcaggagtttaagaccagcctgaccaacatggtgaagccgcgtctctcctaaaaatacaaaaattagctgggcatggtggcacgcgccagtaatcccagctacttgagaggctgaggcagaagaatcgcttgaacccgggaggtggaggttgcagtgagccgagatcgtgccactgcactccagcctgggtgacagagcgagaccgtctcaaaaaaaaaaaaaaaaaaaaaagaaaaagagaaagagaaaagaaaaagtcaaccaggtgtggtggcatgtccctgtagtcccagctacttgagaggctgaggtggcaggatcgcttgagcccaggagttgaggctgcagtgagtagttgtgattaaaaaaaaaaaaaagggctgggaatctgcatttttaacaagcaccctggtggttttttttttttttttttttttgagacggagtctcgctctgtcgccaggctggagtgcagtggcgcgatctcagcttactgcaagctccgcctcccgggttcgcgccattttcctgcctcagcctccggagtagcggggactacaggcgcccgccaccacatctggctaattttttgcgtttttagtagagacggggtttcaccacattagccaggatggtctcgatatcctgacctcgtgatccacccgcctcgcctcggcctcccaaagtgctgggattacaggcgtgagccaccgcgcctggcgcaccctagtgtttgtttcatcaggtggtcagtgggacatgctttgagaaacgatgccctaatctaaatatttgaccgaaaaatgccaaatgaagctgtctggacagtggcgcatataatgtttatatatatctgggtttatcaatttttgagaatttatcttttctcatctatggctattacaaattcatatggctatcatctaaagagtgtgacacagacactctgttttaatgtgctagttttgtcttcttaaatagactataatcaccttgaagacagggacctctcatacttttctgactttacccacaggaagataagaaagcaactttaaggttggaaggtagctgggatgctcaggatgagtccctaatacctttacatcaccttgaaaaccctggaagtcatatatttgggattttgtattcgttttctagggctgttatagcaaagtaccacaaactggtggcttaaacaacagaaatgcatttcctcagttctgaaggctagaagtccaagattaaggtgtcagcagttagtttttttctgatattttctccttggtttgtacatggccatgcatgccctatgtcttcatatgtgtgtctgtgtcctcgtcgcctcgtcttataaggacgacagtcatactggattagggcccacccttatgacctcattttaatttaattacctctataaagactttgtctccaaatatactcacattctgaggtattaggggttaggacttcaacaaatgaattttgggatacaattcagcccataacagacctctagtatcagcttctagaaatgtaccactcatccttctcttccatttgttagtctcatatagtaagttctctccaccctttggttctcctcctccgcctcttacagacgtaatagcttgtgtagcaataactcatggagcagctctaaagaacctacagtagggatgggcaggttgtggcatgcaccaaacaccgtaacactcaggggttgctgaaattccagttgtactgtcttaaagacacagctctttgctcattctctgcccagctgtcttagcatttggtgataacaattagattattagatcctctgtaagtgaccttggtatcgtaactcatccttccttaattactttttttttcactgtagcttctattaggactttctttggccagttctttagaaagctcaattatttaaaataatcagtgaagtcaaaagcaggacatgcaggggctggctgaaatttcacataaggacagtttttgagggtaaatccctggttttgcagagcttgtaaagctggtaaacagcaacaccattaagaatcctggggagacttggcgtggtggctcacatttgcggccagcactttgggaggctaaggtgggcggatcacgaggtcaagagatcgagaccatcctggccaacatggtgaaaccccgtctctactaaaaatacaaaaattagctggacttggtggtttgtgcctggagtcccagctattcgggaggctgaggcaggagaatggcttgaacctgggaggtggaggttgcagtgagctgagattgcaccacggcactccagcctgggcgacagagcgagactccatctcaaaaaaaaaaaaaaaagaatcctggggaaagaattcctattacttaagaggatctaggaaaggtaaaagaaaagtaagaggcaaccgcatggtttttagttcttttgaagtcactcccttcatgtcagcttcagagactgctgttatggaaaggcaaggcttccctcttcccaggccatttttttcggtgagtcaaatcaaacatcttactaaaccaggaagtcttgcccaattatctttttcctcccactacatttgtccaactgattgatatattagtgatataattattgtgaaatatgaatccctgttctgtaaagtccacatctttcctaagttctctgcttccaatccctgttatttaattaacttatttatttagagatggggtctttttacgttgccagtgctggggtgcagtggctattcacaggcgcaggcacagtacactacatatagacttgaactcctcgcctcaagccatccacccacctcagccttctgagtaggtgggactacagtccaggtacgtgccactgtgcttgaccctattattttaaaaatgggttgataaattcttagggaagccccacttagtgggattatgagggctcctagataaatattgttccttgttgaccaatctttccctctttctgcctcagcttccgccaagaacttcttacctgggcatgtatttctatcctattcactttttactctctggcgtggaacttcttcctaccaaactgtcatcctctgcacctctcctggccttcctcacaagtttgtaagcattaagaaggtgcgctgcatgcttcattaaattcctccttggaagggctgagttcaccctgttcttctcaagtgcaattttctccaagtttcttccctacgcaatgtttgtattgtgttgggaccccttccagttattattaattttcaacacacagctaccatgaaagtcttgctatgaagtaactggcaaaactagagacaccgactggcttcctctcaaaggctcggcgtgcccacagtggaggacgggaagcattctccaatccgaaaagtctggaacgctgtggcaactattttgctcagggcaggcagaagacggtggttctttggtacattccccttcttactgagcttcgtttactgaggcttctcctcaacacgccaggatccagcatgtataacacctttggagtgggctgtctcggggctgaggagcgaaacggggggctggttatggagttccagcatggggttacttagctcgcccagacttggaaaccagccagcgtgatgaggacaggtagtggacgcgattgcccaccccttgttaatgtgttaggattaaacagacaaacgggcccgcacaccgcctgccccattctagcccgccttaattctgggttccctttccccgcctctacaggccggctagtcctggcccctcacttgggacgcctctgtccctgatgcgaggcgcatgcgggaccgcttcccccactcccctctccgccaggaggaggagccgaggggttggccccgtacccggctgtggcagaaggggccgcgaaggccgggccaggggcgccacgactgcccagggcccgcccgcggcccgcccgcggcccgcccgccctctagccgctgggccccgaatggcagatccgcgctcggaccatcggcatcgcctcacatcgctccgccccgcgccgccctcccattggctgccgctgagccctcgggcccgcgcctcgccccccggcggccctggcagcgccgcagcccggagcggggtcggaggtgaacggcctggagtaaccccggacgtagtcacctcatggagctcgccggctgaggtgggagacaggggcggggcgggggcgggtcaggcccctgaagccccgccccttctccgtgtgccgggccggcctggtgctgcacgcctgtcagccatcgcccgagccgccggcgtctcctcccgcccagcagttcctccacgcaggggctccggaatcgcccgaccgcacacgttgccaccctgaggtgaggtgagggccggcccagaacctgtgaccggggacctggagaaactggggccaagggaggggcggcggcaggcagggggccgcctcccagcctccgctcacccgcacgcggcctgggctccacactatccagatcgggtgcggggcagcccagcccttcccgcagctctgaggccttgaggtcccctccctagagacatggagaggtctggggtctcgggaggtggggattcagatcccggaactgggaggcgtacagttcagggctcctctaggaaggggggctggagtttctgcctggagctcgcccgccacccctcttgcccagctccagcgtggtctgattccttccagacccctctccaatccgattctgggctcgggagagggagaagaccacgtgggaagggggcgttgcgggttgggtctgattgcattgaaagtcctttctctcttgcagagtgaggtgtggggtgcagacctcacttgctctctccgtgcctttgtatcgtggcgagagccagggccaggcaggttgtatctgccagttcctgttcccaggattttattatgttctctgcgagggacatagtaaatgtacatgccttttgttactctcctcgtttgccatgctgatcaagggaagttactggaaataggacgtaggaagctgatgtgaagctaatgatttcacaggaaaatgtgcgtgaaggtcctgcccggatcggggccaacattattttggatttgagagtgggagagtggacactaatggacacttgaaatcacctctaaaaatcagggacttcgtgtaggccttgtgggttctatagagacatttaagaatataactgctcaggagaaatagtttaatttcagatatttttgtttggaggtttaagactggaataaaaaaaaagaccctaggccttcctgattctgtttctacttaagcgatgtttcagtaatttcctaatgtgtggataaacctaataaccacatcttcagtctcagaagtttatttccttggattttctctctctttccattcattttttccctcccaattcggtagtatagattgagaagcatgctttctttggttacatggtcttttctcactcagcagggaagaatactcatatttgtcccttcttgagggggatgccctggatgtctgtgatgagaaggatttctgtggtgcttatttgacaggcacttttcagaaaagcattgtggcctaatagagcaggaccacagtttacctgtccagatagatgcctgcttgctacaaatagcaagttttttcccacttctcttgcctcagtttcttcatttctcagtaaaactgaatgcataacaggaggactgatgtgaacccaagaatattaaacattttaaagtgggcatatgaaagatgccaaaggtaaagtattaatttatgaagccatctgtgtttactagtgttgtagaattttgttgttgttgttttgtttgtttgtttgagatggagtcttgctctgtcacccagactggagtgcaatggtgcgatcttggctcactgcaaccttcgtctcctggtttcaagagattctcatgcctcagcctcccgagtagctgggattacacgcgtgcgccactacgcctggctaatttttgtattttcggtagagacagggtttcaccatgttggccaggctggtctccaactcctgacctcaggtgatccaccctcctcggcctcccaaagtgctgggattataggcatgagccaccacgccaggcttgttttgttttgatttaccagtgcataatagaaatacatcaagcataagattaaattgctttttaaaaaggaagtcttgggaaatggtggcatttatcttagtgaatttatagttcaaaaactaggtaatgctgaagacctggtattgtgaaagccagcctcagagaacgctctctcatctgatgttgacctctctaaagtgctgtgaacaggttcaggtgtagatcactatgtaacattatttcctttgcagtcaatgactaggaaaatttttatacctgtcacgtggactggtttaacaggtttagggctagtgtttttctttctttaaaatctttttttcctttaattggatggctaatatcctaatagtcttagttgaggaaagaagtaaattaaaatacaaactgtggaataatgcattagaaattagtattttcaattgtgggaggagaagagaatccttttgtaattcagaaaaaaaagttatctcattatctaacatgttcctaaagattaacaattatagaagctgccgggcgcggtggctcactcctgtaatcctagcactttgagaggtcgaggctggcgaatcacaaggtctggagatcgacaccatcctggctaacacagtgaaaccccgtctctactaaaaatacaaaaaattagctgggtgtggtggtaggcacctgcagtcccagctactcggaaggctgaggcaggagaatggcatgaacctgggaggcagagcttgcagtgagctgagattgcgccactgtactccagcctgggtgacagagtgagactccgtctcaaaaaaataataataataataattataggagctatgtgtcaagtatctttccaaacccgtaaaacagtaagattacaaaaaagcgaataaacagtagagactcattggctaaaaaattcctattaactattgagataattaccattaatcttctactttaacagattattaacagattattaactggttttttgcttgtttcaatttaattttattttattattttttggagtcggagtctcgctcttttgcccaggctggagtgcagtggcacgatctcggctcactgcaacctccacctctcaggttctagcaatcctgcctcacccccctgagtagctgagactacaaggtgtgcaccaccatgcccggctaattttttgtatttttagtagagatggggtttcgtcatgtcggccaggctggtcataaactcctgacctcaggtggtccgccctcctcatcttcccaaagtgttgggattacaggcgtgagccaccgcatctggcctccattttatttatttatttatttatttgagacagagtttcactcttgttgcccaggctggagtgcaatgatacaatctcggttcaccgcaacctccgcctcccgggttcaagcgattctcctgcctcagcccctcgagtagctgggattacaggcatgtgccaccacgcctggctaatttttttgtatttttagtagagatggggtttctccatgttggtcaggctggtctcgaactcccgacctcggataatctgcccacctcagcctcccaaattgctgggattatgggcgtgagccaccgtgcttggctattttattttatttttttgagacagagtctcactctgtcacccaggctggagtgcaatggtgtgatcttggctccctgtgacctccacctcccatgtgcaagcgattctcctgcctcagcctcccgtgtagctcggattacaggcgcctgccaccacacctggctgatttttgtatttttagtagagacggggattcactgtgttggccagcctggtcttgaactcctgaccttgtgatccacccacttcggcctcccaaagtgctgggattacaggtgtgagccactgcgcctggccactttattttttatgtatttatttatttttttggagatggagtctcactttgtcacccaggctggagtgcagtggtgtgatctcggctcactgcaaccaccgccacccgggttcaagcaattctcctgcctcagcctcccaagtaggtgggattacaggcgcatgccaccatgcctggctaatttttgtatattaatagagatggggtttcaccatattggccaggttgttctctaactgacgtcaggtaatctgcctgccttggcctcccaaagtgctgggattacaggcatgagccactgtgcctggcctttatttttaagtgtttttgatttattatttttttagagattctctcgctgtgtcacccaggccggatggagtgcagtgacgtgatcattgctcattgcagcctcaacctgggctcaagcagtcctccaccttaccttctggagtagctgggactgcaggtgtacaccactgcgcccagctaattttaaattttttttgtggggtggagtgggggtctcgctttactgcctagactggtctcgaacccctggcttcaagtgatcctccgacttcagcctcccaaagtgttgggattataggtgtgagccattgcactcagcctgtttctttaattttaaaaaactgtaatgagtactgtattcgcttgaatctaatggactatttgaaggtgatattaaacaggtaagaaactatgacaaatagtgtcataaggatgttgcacttacactgtataaatctgattgatatggcattaattcttatgagtttagctggccaatctcatttaagtgttctctaatgatgcagttctcttactaatttgttactttttcaagttaccattgggctgtctagtcttaggatgtttaaggaggcaagtgaaaagtggcttcagcaagggctattcagtgccctgcctaaaggttggtggccccagttggtcttgcctttcgatgatgttgagacttagactcattccatccttttagcatgccatactcatgctgttttatataaggaaccacaataatgtttaccattccatgacatcaggactggaaattgcatggcagtactatttatggagtggttatttcagatagaataaaattgtataaattattttctttattttgagacagggtctctctctgtcatcccggctggagtgcagtggtgcaaacatggctcactacaaccttgacctcctggagtcaagcgatcctcccacttcagcctcctgagtagctgggatcgcaggcacatgtcaccatgcctagctaattttttaattttctgtagagatgaggtctcagtgtaatgctcaggctggtttcgaactcctaggctcaagcaatcctcctgccttggcctcccagagttttgggattacaagtatgagccaccatgcccagcaaagttggaaaattccgaatgaactcatgaagtttaaaaaaacagactcagttttggggagtctttctcaagaaatataaggcctcatttatgaatatttggttatcccctttgatagaaatagagtataatactcttaatgaagttcctgtaaaattatcttttttttttttttttttttttttttagacggagtcttgctctgtcgcctaggctggagtacagtgacgtgatctcagctcactgcaacctccttctcctgggttcaagtgattctcctgcctcagcctcctgattagctgggattataggcgcacaccaccatgctcggctaatttttgtatttttagtagacagggcttcaccgtgttggtcaggctggtcttgaactcctgacctcaagtgatccgccagccttggcctcccaaagtgctaggattacagttgtgagccaccgtgcccagcctatcttctttttttataagcatttttcaaatctgttcttagttgtgtatatattttacacacatgccaagatttggaatagtaggttgataggagcttgattagtttttaagtttattaggagtaatatcagtagattagcagcaagaaaatgaattgctgggtcctgttttatgctttagcatttagtggtattcctggccctggcaaggcaagctgtttaattttactttgattctatctcaaaattcaataacttaatagaacatttagtactggaaagtacctaagggattttcttttccagttttccacttaatatgagagaatattttatctgatgtacgtttgaaagtttccaacgataggcacatctggcttaaggcatcacggggcaactgatttttgggagttcttcataattttcaacttaaaactgcctccctaaaactgcataggatgttgtagctacaaaggaattaggaatttttgctttaacctgtaaatgtctccagcatagatctctgttaggtaatataaagtataatgccttaacacatccgtaggacttgaaggcaaaaaaaataagcagtatttccttaaggaagaaatttcttttcttttttttttttgataaggtctcactctgtcaccctcactggagtgtgctggcacagtcatggctcactgtagcctcactgcagcctcaacctgtcaggctcaagtgatccactcacctcagcctcccaagtagcggggactacagacacacaccaccatacctggctatttttttttttcttaattttggtagagatggggttgcgtcatgttgcccaggctggtctcaaactcctgggctcaagcgatcttcctgcctcgggctcccaaagtgttgagattatacagccatgagccagttcttttccttgagactctggttttctctaaatgcagctctatgaaataagattacgagcgtaaattaattcatcctagaactttctgaattcacaaaatggcattttacctggaggcctttaaatgtttctagaggataatgtttgaaataacgacttagtttatgtctcctagttttgtaactcaaatattcgttgcaattctgataaaacatgaagcctggccaggcacggtggctcacccctgtaatcccagcactttgggaggctgaggtgggcagatcacaaggtcaggagatcgagaccatcctgggtaacatggtgaagccttgtctctactaaaaagacgaatgtggtggcaggcgcctgtagtcccagctactcgggaggctgaggcaggagaatggcatgaacccgggaggcggagcttgcagtgagccgagattgcgccgctgcactccagcctgggtgacagagcaagactctgtctcaaaaaaaaaaaaaaaaaaaatgcagcctgtgaaagcctggtgtttacacagcattgtgaggcattgagggtggtggatctaaaacaattagaagaggctgggcacggtggctcacatctgtaatcctagcactttgggaggccaagatgggaggattgcttgaggccagcagtacaagaccagcctcgttaacatagcaagacctccatttctctcctttttgttgtttttggaagagaggataacttttcccagcctcatctaggagataacccagagtcaattacatagtaacacatattaaagaaataagtgaataacatttcagttgtctggctaaatcctctgacagatatgagataagggatcagagtagcatggaattaattgaggaaagctttttattaaacttacttaaaatcttcagttggcaatacattcatgtggttcaacattttattttatttgtttatttattttttgagacagagtctcactctttgtcaccccaggctagagtgcagtggcaggatcttgactcactgcaacctctgcctcctgggttcaagcaattctcgtgcctcagcctcccatgtagctggaattacaggcgtgtgccaccatgcccagctaattttttgtatttttagtagagatggggttttaccatgttggccaggctggtcttgaacccctgacatcaggtgatcctccggtcttggcctcccaaagtgctgggattacaggcgtgagccaccgcacccagcctgtttcaacattttattttatattttattttattttatttttgagacaatcttgctttgttgcccaggctggagtgcagcggtgcgatctcagcgcactgcaatctccacctcccaggttcaagcaattctcctgcctcaggttcccgagtagctgggattatgggcatgcgccacgctccaccacgcccctctaatttttgtatttttaatagagacagggttttaccatgttggccacgctggtccggaactcccgacctcaggtgatctgcccacctcggcctcccagagtgttgggattacaggcgtgggccactgcacctggcctggttcaacattttaaaagcacaaaagggggccatgtacgttggagtacaatggcctgatcttggctcaccacaacctccgcctcccaggttcaagcgattctcctgcctcagcctcccgagtagctgggattacaggcatgcgccaccatgcccggataattttgtatttttagtagagacagggtttctccatgttggtcaggctgttctcaaactcccaatctcaggtgatctacctgcctcggcctcccaaagtgctaggattacaggtgcgaaccaccacgcccagcccgaaacacatttttttgtttgttcattgttttgttttcgagacagggtctcgctcttttgcccatgctggaatgcagtgatacagtcacggctcactgcagcctcaacctcctgggcttaggtgatcttcccacctaagggtcccaagtagctgggactacaggcatgtgccaccacacccagctaattttttctgggtttttttttttggttttttttttctttttttgagacgggttcactatgttgcccaggctggagtacagtggtgcaattatggctcactgcagcctcgacctcctggaatcaagcagtccgcccatatcagccttctgtgtagctgggaccataggcacgtgccattatgcctagcaaatttttaatttttttattttttatagagacggagtctcactttgttgcccagcctggtcttgaactcctgagcagtcgtaatgcctcagcctccgaaagtgttgggattacaggtgtgagccactgtgcctagcctgttgtatacttctattgcatcacatccagtgatgcacacacagagtaaaccacacacacatcatacaaggatgtcagtttttcctaatattggtgatatttagtttgaatacttagttaagatggtatccatcagatttctccattgtaaagatacttttcccttttgtaattaatatgtaagaatatggccaggtgcagtggctcatgcctgtaatcccagcactttgggaggctgaggcaggcggatcacttgaggtcagaagttcgagaccagcctggccaacgtggtgcaatcctgtctctattgaaaatacaaaaaaactagctgggtgaagtggtgggtacctgtaatcccagctacttgggatgctgaggcagaagaattgtttgaacctgggaggcggaggttgcagtgagctgagatctggccattgcactccagcctgggcaacagagcgagactctgtctcaaaaaaaaaaaaaagctatatatatatacacacacacacgcgcgcacacacacacacatatgtaagatatatatatgtaagatatatcttatatacgtatatatgtaaaatatatatgtaagatatatcttatctatatgtaagatatatgtatatataatatatattatatatatgttttatatatatatatatatgtaagaatatgttgttttcactgagcatggtggctcatgcctgtaatcccagtgctctgggaggctgaggcagatggattgcttgaggacaggagtttgagaccagcctggccaatgtggcaaaacctcatctctactaaaaatataaaaattagccatgtgttggggcacacgcctgtaatcccagttacttgggaggctgaggcacgataattgcttgagtctgggaggtggaggttgcagtgagcggcgatcacgccactgcactcacatctgggcaacagagcgagactccatctcaaaaaataataataataataaataataaagaatatgttgttttctgaaaaccctttatccaatagttttaacatatatttacgatatttgccaacatcagttattgcattggtgttttttttttttttttgagacggagtctcactctgtcgcccaggctggagtgcagtggcgcgatctcggctcactgtaagctctgcctcctgggttcacgccattctcctgcctcagcctcctgagtatctgggcctacaggtgcccaccaccacccccggctaattttttgtatttttagtagagacggggtttcaccgtggtctcaatctcctgatctcgtgatccgcccgtctctgcctcccaaagtgctggaattaccacgcccgtatagcattggtgtttgtaaaatgaattatgttttctaattgcatcattatcggaggtaattattttgagattttgctgtctgaaaatatgtcctgtcctcacaattgatcagcaacctattgtgtctaaaattctagattgaaaataattttccttcagaattttgaaggcattgtttaataaccttcaagcttctgttgttatttctgataagtctgaaaggcattcaaattcttgatcatttgtatgtgaacttttttctctcaggaagcttgtaggatcttttcttgtgttcagtttctgaaatttcagtgatgtgccttggtgtctctttttattcattatggtaggcacttgttgggcctttttaatctggcaatgaccatggcaatctggcatgattatcagattaaaatttttgccctttgttttgttcttgcttttgggagcttctgttacttagatatggaccttctgaacaggttctctcatcttctttttctctcctgttgttcatcactttaaatattttttttttttttgagagacagagtctcactcagtcacccaggttgggtactgcaacctctgcctcccgggttcaagcagttctgctgcctcagcctcccaagtagctgggattacaggcgtgtagcaccacacctggctaatttttgcatttttagtatagttggggtttcaccctgttggccaaggctggtcttgaactcctgacctcaggtgatcctcccaccttgccctcccaaagtgctaggattacaggcatgagccaccgcacctggccctctttgactttttattctgatttgtgaaagcttttctttaaccttatcttctgagttgtttcattgctgtgatcatatttttagcttttaaaaattctttcttgttaaaaaattttttttctttcttttttttttttttttttacgtaagtagggatggcgttatgctttgttgctcaggctggtctggaactcctggactcaagcgaccctcctgcctcagccttccaaagtgttgggattacaggtgcgagccgccgcacctggcctaaaatagttattttaaaaatatttcagaccagctgttgtgactcacacctgcagtcctaacattttgggaagttgaggctggaggatcgcttgagcaggaggttgagatcagcctgggcaacataacaaaaccccgtctccacaaaaatcacaaaaaagctagctgggtgtggtagtgtgtgcgtagtcccagctactcaggaggctgaggtaggaggatcacttgagcccttgtattagtctgttttcacactgctgataaagacatactcgagactggacaatttacaaaagaaagaggtttaatgcacttactgtgctatatggccagggagacctcacaatcatggcggaaggcaaggaggagcacgtcatgttttacatggatggaagcaggcagagagagagcttgtgcagggaaactcctgtttttaaaaccatcagaactcgtgagacttattcactaacacgagaacagcatgggaaagacccacccccaggattcgattacctcccaccaggtccctcccacaacacgtggaaattaaagaggaggtttgggtggggacacagccagaccatatcattcagccgctggcccttcccagatctcatgttctcacatttcaaaaccagtcatgccttcccaacagtccctcaaagtcttaactcatttcagcattaactcagaagtccacagtccagagtctcatctgagacaaggcaagtcccttctgcctatgagcctgtaaaatcaaaagcaagttatttacttcctagatacaatggaaatacaggcattgggtaaatgtagccattccaaatgggagaaattgtccaaaacaaaggggctacaggctccatgcaattccataatctagcagggcaatcaaatctttttttttttttagatggagtcttgctctgtcgcctaggctggagtgcagtggtgtgatctcggctcactgcaagctccacctttcaggttcacgccattctcctgcctcagcctcctgagtagctgagactacaggcgcccgccaccacgcccggctaatttttttgtatttttagtagagactgggtttcaccgtgttagccaggatggtctcgatctcctgacctcgtgatttacctgccttggcctcccaaagtgctgggattacaggagtgagccaccacgcctggtctcaatagatattttttcttatcgtttccctcccatctgctaccctcaagtaggcaattgttaatatcttacatagccataatactttttttttttttttttgagagagagtcttgctctgttggtcaggctggagtgcagtggcatgatctcggctcactgcaacctccgcctcctgggttcaagtgattctcctgcctcagcctcccaagtagctgagattacaggtgcatgcctccatgcccggctaaccataatactttagtcaaaactatgaaattaacattggtacaatagtaactaaactataaaactgtatttcctgggttttttttcctctagagatagggtccctctctgtcgcccaggccagagtgcaggggctccattatagctcattgtaatgtgaaactcctaacctcaagtgatcctcctgcctaagcttcccaaagtgttgagattacaggcatgagccaccatgctggccttctgtagcttttcttttttagtgatgtgtttttctattccagtatttaatgtaggataccacattgtatttagtggtcatgtctcattaatctcccctgatctgtgatagtttcttagtctttccatttttgtaatggcttgatgattttgaatagtactcatcaagtattttatagaatgtccctcaattcaaatttgtctgatattttctcatgattaaactagggttatgggttttttgggaaaataccgcagaggtgaagttgctttcccctcccctcgacccctgtagtttttaatggtttcttgttccctgtaatctcttttcttcaagttgcatttttttaatctacaggtagttatttgtttttagtctttcatgttgaagtttttctcagacatctggtaatctttattgtctgtttatatttaagaggaagtgttgaaagctgattagaggtggttagcttactacagtgtaatctggttgggcaactcaattagggacgttgatgttagtaactttagttatttttctctccttgagctggtcagattctccgaagaaggatcctctaggctgggcacggtggctcacacctataatcccagcactttgggaggccgaggcaggtggatcacgaggtcaggagttcgaggccagcctggccaatatggtgagaccccgtctctgctaaaaatacaaaaatcagccgggaatggtggtgcgggcctgtagtcccagctactcgggaggctgaggcagaagaatctcttgaacctgggaggcagaggttgtggtgagccgagatcatgccactggactccagcctgggcaagaaggatcctctaatctctctccgggaaggtgacgattagggaaagaggaccggaaaatcttactcaatatattgacttaatttatttattttcagtattgtaccctgccccttactgttgctggtatcccccaatctagaaaccctctgtttaaccctctctagagaataaacctaaagtctcaggatggtagagcagcaggcacctgacttcactagttggggagaaaatgtaatgatctgaagcttcggaaacaatttcaaccaatcctccttattttctttagctctctttcacctccactttctgaacattttggggaacgtatgacataaattgtgttgatcgtaagtttaccacagttgggctatgattcagttttcttgggcttgcctagtcatttattgctcttctgtctgctttccaagaaaattgtcttgttgtctacccagactttttaatttcttttttggtctttttgtgggttatgcctttttagtttatttatttatttatttttatttatttttttgagaaggagtctcgctctgtcacccaggctggaatgcaatggcatgatctcagctcattgcagcctctgcctcctgggttcaagtgattctcctgcctcagcctcccaggtagctgggattataggtgcacaccaccacgccccgctaatttttgtgtttttagtagagactgggtttcaccatgttggccaggctggtctcgaactcctgacctcaagcaatcagcctgtctcatcctcccaaagtgctgtgattacaggtgtgagctgccatgcccggcccaacccactgtcttcagacagttttcgccatggtgtccaggctggtctcaaactcctgggctcaagccatcctcttgcctcagcctcccagaatgctgggattacaggtgtgaaccaccacacctggcctagaggtttttttttctttttaaaaaaatttttaaatttcttttttattttttatctttttatttttttgtttatattttttgtgttttcagagattattatactactgtaattgtatatttaggtgtcaatagccacttagctagggacaaatcttatttatctttgaataatcagcatctgtttcactatttggaacacaagttcttgttattttaaaatttaaaacttgtggtaaattaaaatagtttttaaaataaaattttctgtaatccttttatgaatcactgaattaataaccaaaatccattaaaaaataaatgacaaagtgaacaaggcaaattcacttattgtctttgaaaactttttttttttttttttttgagacagagtctcactctgtcacccaggctggagtacaatggtacaatcttggctcactgcaacctctgccttctaggttcaagcagttctctgcctcagcctcccaagtagctgggattacaggcacccgccaccaggcctggctaatttttacatttttagtagagatggggtttcaccatcttgaccaggctggtcttgaactcctgacctcgtgatccacctgccttggcctcccaaagtgctgggattacaggcatgagccactgcacccggcctctttgaaaacatttaagtgaacttactatgacttgagaggcaaggacatgttgtaaaagcttggatacttttatcagtggctatgaaaactaattgctgcctctttattagaattgcatggaaaatacagtgtaatttgagttcaaggagaatatgctaactaaatttggtaaaatctgttgtatttatttagaaaaatatctctgggccggccacagtggctcacgcctgtaatcccagcactttgggaggctgaggcaggtggatcacctgatatcaggagtttgagaccagcctggccaacatggtgaaacgccgtctctactaaaaatacaaaaatcagccaggtgtggtggcatgcatctgtaatcccagctactcggaaggctgaggcaggagaatagcttgaactcgggaggcagaggttgcattgagctgagatcgtgccactgcactccagcctgggtgacagattgagactccgtctcaataaaaagaaaaaaaaaatttctgaatgaaatgcaggctgactttttttgtttttgtttttgtttttgagacaaagtctcattctgttggccaggctggagtacagtggcacttcagcctcaaccttctgggctcaagtgatcctcccacttcagcctcccaagtagctgggaccatgggcatgtgctaccacatccagcttttttttttttggtagagatggggtttcgtcatattgcccaggctggccttgaactcctggactcaagggattctcccacctcagcctcccaaatggctgagattacaggcatgagccaccactcctggcccaggctgactcttaaatacattagctgtaattagctttaccacattttcaggaacataaggcacagtttgggagccttccgcaaaaattttcaagagtctccaaataaaagctgaataatacattatatgtatagtgtatatataggatatatatatgtatttaaaatacatatatatttaaaaatatgtgtgtgtgtgtgtatatatatatatatatatatttttttttttttttttttttttttttttgagagacagtcttactttgtccacagcctggagcgcagtggtgcattcttggctcactgcaacgtccgcttcctgggttcaagctattctccttcctcagcctccccagtagctgggattacaggtgtctgccaccatgcctggctaatttttgtagttttagtagaggcggggtttcaccatgttggccagctgttctcgaactccgaaccttaagtgatctgcccgtcttcatctcccaaagtgctgggattacaggtgtgagccactgcgcctggccacatgatatattttttaaataaaagagaatttggcattgtcaacaattttatataatgaagaaaataatttttatttgagtaggcagactggatctggaaaaaggccttgtttcagaactaagacagcaattatatgagccttccccaaaggtcagcttcttttttagtcctctttctggagaaagaggtcttaacctaattcagggcaggagtttaggaatcccaaacctgtatggaatgaaaattttgtatgagggtacatttttgtcaagaaaaggtccatagctttcatcaaatttccaacagttgagacacttttaagaatcgttggtttatgtacttaactggctgtctttgctgtctagtgaggttataaagtggagggggtgagggagtaaggattagttgtggctttaaggctttttttttttttttgagacagagtcttgctctgctgcccaggctacagtgcagtggggtgatcttggctcactgcaacctccgcctctcgggttcaagcgattctcctgcctcagcctcctgagtagctgggattacaggcacacaccaccacacctggctaatttttgtatgtttagtaaagacgaggtttcaccatgttggcccagctggttttgactcctgatctcaggtgatctgcccatcttggcctcccaaagtgctgggattacaggtgtgagccaccacatctggccgctttaagactttttttgacatacctcataataaaatgtcatttacatcatgacctatatataactgaaacaaaaatttacaaaactatggatactgtcataaactatggtatatcttaacattttctatcttatttcattttcaaaatattggttataacttgctaaattgatttcttaatgttttgctgggtggtaacccataatttgaaaaacactggcctattgcattatagtttacaaaatcctttcatatattcttagttttcacagcagtcccatgaggtacatatgaccttctttaaacttaattaaattcgttaatttatttatttttgagatgggggtcttgctatgttgcccaggctggagtgcattggcttttcacaggtgtggtcatagcacattgcagcctccagctcctggactctagcacacctctgcctcagcctcccaagtagctgggactgtaggtgcacactactgcccagaagactttcttttttatttttacagatgaggaggcttgtctgtatgatatacagagacgttaagtgaccttcaagtctgcagtcacttgcaatatttgacagtcagagtttgagcttgattggtcctaggttttaactccactttcactgcatctttggttacatgatccaaactttttccttcctcttctcagttgtagggaataatactagctcagactgcataactggataaatcctaatattcctaaatgttgtcccttgtcatttaggggtcctctcggaagttttagatttccctaccagtgtaataggttctttccttttgtttcttctctgcccttaacgagtggttctcaagcgtgtatttccatcagtgtcaattaactgtggaacttaaagttgatatccctgggtctccagctgcaattctgattcagcagatctagggtggtgtttagactttgtaaaatttttaaaagctccgcaggtgattcttaaacataatcagagttgagaatttctaccctagatagatttaaattgtcaggcttaagaaggaaaccgaggatttggggagttgctagagactgtttgatcccttacagtttagggacttagtataatgggcactctgtcttccacctggctcccaatctttgtgtgtaggtgtaaccgcttgtaaacataatcagagcttaagtgaattgtagagaatctagtggttctcttctccccactgcctcttttttgatgaaatattagaaatgaaaattttgaaatgtattcatggagtatacaattggaaaagccaccttgtgaaatggtaagcttgttctattgtttaatattttcttaaacaatagtctttatgtaatgtgtttgatttacagaattgaacaaataataaactgctaaactttgtgctttaagttaaataatagatttgaccagtaaaatagatacttcatatattattacctttgtattatgctgagcaaaacaggaattgacaaaagtttgtttcttaaaaaaaaaaaccttaaaatctttctctctttttctctctaggtctttctggaagtggatatctactcagacagtaagaattataagaggtcagttacaaataatactccttgtttacaatgtgataaaaattttgttcatgttgtaaaatatcaaactgtaggcttttgtgttaaaagttgacttccacaaaataatataggcagatttagggtggataacctgaagtgaacaaagagtctaacaatggtactcaactgtattctctctttaattcaggactagaatcagtggaaatgggacaggctgtggagtagcttctagagtgtctggacagctactcagtaattttccatacatgacctctcttttctgttggtttgtaggctcgtgcctgggaaatactattcagtacagttgctggacaggctttttagctgttcacactgagttgcctccaatctatgtaaccgtttagtgaaagctgccttcatggtcttcttagctaggaacttgaagttggccttattgagactctcacttattagcccaggaaccgtgttttattaactctctttttcttctcccatggagtcaaagaattgtgccttgtggattttctcttttgtgtgtggtcatctaacttcagtcagactgcaagctagaatctgcacctgagtgccttgctttcttactttgtgaagaaggcacccattatcttctgttagttgggatgggattttattttttggatctactgttacttttaaacttaactatttactgctgtaaatgtgaaagaaataggctttttgctgctgtaacttttggtgttcttcagtgtggtcagtctgttggaactttcccttccctccccctttctttctttttccctcccttttaccccttttccctcccttttccccttttccctccctctctgccttttttcttcctttttttttttcttttgagacggagggagtctctgtcacccaggctagagtgcagtggcgcaatctcggcacactgcaacctctgcctcctgggttcaagcaattctcatgcctcagcctcccaagtagctgggattacaggtgcccaccgccacgcctggctaattttttgtatttttagtaaagttggggtttcaccatgttggccaggctggtcttgaactcctgatctcaggtgatccgctcaccttggcctcccaaagtgctgggtattacaggcattagcgactgtgcctggccaaaaataatgggagccctttaaaggttttttgtttttttttgttttttgagacagagtctcgctctgtcacctcccaggttcaagcgattctccttacctcagcctcctgagtagctgggattacaggcatgcgccacgctcggctaatttttgtatttttagtagagatggggtttcactgtgttggccaggctggtctcaaactcctgacctcaggtgatctacctgcctcggcctcccaaagtgctgggattacaggcatgagccactgtgcctggcctgtatttttagtagagatggggtttccccatgttgggcaggctgatcttgaactttttttaagacctaatatttcaagggagaaatgtatagtaaatttagacagcaaattttttttgttgcatgatactttttttttttttttttttgagacggagtctcgctctgtcaccaggctggagtgcagtggtgatcttggctcatgttgcatcatacttttatatttgattctagttttgttttattttattttattttattttattttattttatttttgagacggagtctcactctgttgcccaggctggagtgcagtggcgtgatctctgctcactgcaagctccgccccctgggttcacgccatactcctgcctcagcctctcgagtagctgggactacaggtgcccgccactacgcccggctaattttttgtatatttattagagatggggtttcaccatgttagccaggatggtcttgatctcctgaccttgtgatccacctaccttggcctcccaaagtgctgggattacaggcgtgagccactgcgcccagctgattctagttttaaagatagaagttagctaaagtaatctccagttcactttcagaaaatgttaggctgggctcagtggctcacactgataatcccaaccgtttgggaggccaaggtgggaggatcacttgagctcaggagtttgagactaggctgggcaacatgtggagatgctgtctgtacaaaaaaacaaaaagtagccaggcatagtgatgcatgcctgtagtcccagctattttggaggttgaggttggaggatgcttgagcccaggagtttgaggctgcagtgaacgaggatcgtgccactgcactctagcctgagtgacagagcaagaccctgcctctaaaaaaaagggaaatgtctatagttttctttacttttcttttttttttttttttttgagacagggtcctgctctgtcaccaaggctggagtacagtggtgctatcacagcatactgcagtcttgaactcctgggctcaaacgattctcccacctcagcctccccagtagctgggactacaggtgcatgccaccacatgcagctaattaaaaaaaatttttttttagggatgggatctcactatagtgcccaggctggtataggttttctttagttttgttttagcagtcttgccaatttgttaattactgttttattcttgtaccacagtgattctcaacctttagggcttgtgaaagcatagatgaatggatgctggcctgtaggttctgatatggttagttggtctggggaagggcccaagaaatttgcacttctaacaagttcccaggtgatgccaatggtccagggaccacactttgagaaccacactactctagcatttataaatgctgtttgtctctgtaagtgagtaaactgactcacaaattacaccagaacaatcgtgcatatgtaattttcacatgttgagtggtgattcccaaacattttaaagtattgacggtttctcatctgatgtcaaggaacactgttgtccacttactttcatactttacagtgagttatagcatacagagttattaataatacatttattatctattaatgtaccatatcttagagcacttcaaaatcacaattgggaattattatttttctatttttatttttgcagttgcaagatttaatagagtgaagacagagctcccatacaaagggaggggacccaaagagggtagctgtagctggctcgaatgcctgggtttatatcccgatcattgtccctcctgctgtgctgtcaggcaacagatgattggctatttctttatctcctgtttttgcctaattagcattttagtgagctctctttagtatctgattggttgggcgtgagctaagttgcaagcccggtgtttaaaggtggaagcggtcaccttcccagctagtcttagggattcttagttggtctaggaaatctagttattcctgtctctcagtcccccctctcaacaggaaaacccaactgctgttggggaggttggccaacaaccactctaactgcttcctgctgaattggggcgtagtagaggttgtgcagttgagatttcctcgggaggggtgcctttgatgtcattaacatcagagcatgggctagcaggccggtccaggggtccgtggtagattttactcatggactgcatctggggatccatttgaagaacgatttgtagttttactgcttcgattctggaaaagacaaacttaacaaggaggttaaagatacagggtccaaagaggagtaacaatattatagctgctagaggtcctaagaaggggagaatccagggcatccattggctgaggaggccccagggtccagtgttttgcagctcctttgctctacgttatattcgaccttgaatttctttaactttctcggtgatgattccggattgattaacataacaacagcatttttcctctaaaaataaaaaggttcccccgctttccgcggttagcaagtctaaagctcttcgattttgaaggactactgctgctagggagttaagttgatcttgcaaggtgaccagggtatcagcgacccattccatgtcaccatttagttcttgagacagtttgtagtagaactgagtagaggttgtgataccgccaatgccagtagctactccgcctagcactcctgctccaataacaaaaggaagaatgggtactcttttgttgcggggcttaggtatgacatgattgtataaatcttgttcagtgtagatgggcataggggccactaagaatgagaggaagcacacagattctgaagagccattcaaacaatgataggctgaggtaccacagacaaaaaatattcctgagggtaggcagactattcgtgtgggaggagttacccacctgatgcattgggagttggttgtgtctatagtattgctaaattttacacaggtgaggtttgaggtatgggttatttccagattggaaagaggacctactaaaacagaagtggtgtttatttctgtgctgaagttgttccattgttcaggtatagggattgaaatgtgtggcctaaagtgcagggggaggcacatccaacagttagtagggttttgggccgagacctcatggagcccagtcagggtggtattaaataggcttaccaggccagtatgggtatggagggtttcatgtagttttgagagatctagtcctttgtaggggccaggggtgctatgtacccaggtcagttgggagattacttcctttatgtgtttttctgttgcctgatcttgaactccacccccatcagacatactggtatgagtgaagtgagtcctccaagtcctccaggacaactgggattaatcgtttttcctgtccaataatgagtatttgcatgcatgcaaagagtggcagagttatagcagttgtggggcatatgggtgtgggcagtgaaggtgggggttcccttagataaactcctatacaatggggcatcaatatttccgggacgctgcattctccatagaaactcttgctaaggggagctactggcatggacggggcatggacggggtgcagtggcatggacggggtgcagtgagagtgaaagggggtaagagaacagtaaagagaaaaatatgataagggagggccaggggatttacgattttagttactttccccctggttgtcatttgaagagcaggcgcagatcctctagaggttcacaggaatagctagcattgtctcatggatttttgagttcctttggcagtatccagggtttgacttgagtgtgatgtatccaagactccgctccagccactttaactgccgttagggtagataaaatggctgggtagtttccttcccaggatgtatctagggatggggaattagagggaagggacttgactaataccatgtcaccagggtggaatagttcctttccctcttcttggggacaggctccctgtaatgttttaagaacctgttgatatttggctaaggagatgatgtctgcaactaagttggctgtctctcggtcaagcccaagttcattggttaggaagggccgtccatacagcattttgtatggactaagtcctgctttttggggagagtttcggattcttagtaaggctataggcaacagagcaggccatgcgaggtgggtttcctggattagcttttttagatgtcatttgagtgttttgttcattttctccacctttcctgaggactgtggcctccaggcgcagtgtgagtgatattgtatacctaacacctgggatactccttgggttactgtagccttgaaagcagggccattgtcactctgtaagccttggggaagtccgaatctgggaattatttcatgaacgtttattacctcttgggccttttctgtcctacaggggaaggcctctgcccaaccagtgaaagtatctacccaaactagtagatactgaaatccctgagatttgggcctatgggtaaaatctagttgccagtcttctcttgggtagtggcctgttctttgttctcctgaaggagcttggcgataaggcaggggattatttctttggcacacttcacaggccctgactatctgcttgatagttttgaaaaggcctggtccagtaaataatgatttggccatctgatgggtgctatcaatacctaagtgaagggtttggtgaagggttttaagtaatttccattggttagctgcaggcaaaagtatttttccttctttggtggctagccatcctgaggggaggaaactatgtccccgtgaggttccccattctatttcttcttctgagtactggggcttggtttcctggaggggattaccccatactaggtgtccttctataagcatttctaatggagggtcctgccttgcggctcttttggctccaatatctggttggcggttcccttctatttccctttcctttcctttcctttctgatgacaccggcagtgtaagactgccacctctttaggtttctgtacagcctagaataatctcctgatggcttcccgatgtttgataggtgttccttggaagttaggaattccctttctctccatattgctgcatgggcatggaggactaggtaagcatacttagagtctgtatatatatttatcctttttccttctcctaattctagtgcctgagtgagggctatgagttctgccagctgagcagtagttgctggagtgagggcattactttcaagtattccattatcactgaccactgcataccccacttttcaaagtcctttttctacaaaggaacttccatcagtatacaagttgaggtcgggatcagtcaagggaacctctaaaaggtccacaattgggaattattaatctttttttttttttttttttctagacagagtctcactctgtcacccaggctggagtgcagaggcatgatctcagctcactgcaacctccgcctcccgggttcaagtgattcttctgcctcagcctcccgagtagctgggattatacacttgttaccacacccagctaatttttgtatttttagtagagacggggtttcaccatgttggccaggttggtgttgaactgctgacctcaggtgatctacccacctcggcctaccaaagtgctggtatttacaggcgtgagccaccgcgtccggccaatctttttttttttttttttgtacagatgggatcttgttttgatgctcatgctagtcttgaactcctggactcaaacaatcctcctgcctctgcctcccaagttgttaggattataggcgtgagccaccgcgcccaggcttattttctgaattaaaataattgatctgggtacaagctatttaatactgagttgatctgtagttttgaaattttaaaataggatttttgagatgacagaagaaatattgtttcatttagtttgggtttttattgttgtgggctcttattttggtttttaaaaaatatttttaaatttttatgggcagcacttcattccataaaagagaatgaatgttgctgttttggtctttattaattagtttctttttctttcttttttttttttaaattatacttttaagttctgggatacatgtgcagaacatgcaggtttgttatgtaggtaaacacgtgtcatgatggtttgctgttaattagtttcttagttagctattggcagtatctaatcctaactggtaaggccctacatttagaaaaattatacttacttgaggtgattatagattttaaatttggtgatagattcattttcttctcatatcagtgtcagcacattagagccaaaagtagtcattttggggtgacattttaaaatgcataatttaagaaaaaactcatgaggacaagtaaagtttttttttttttaattaaaaattacctatctggagtttgttttaaaagtatacacatacgtaaaattcataggccaggcacagtggcttacacctgtaatcccagcagtttgggagcctaaggtgagaggattgcttgagcccaggagttcaagaccagcctaggcaacatagggagtccccatttctacaaaatatttaaaaattagaccgggcacagtggctcacacccatagtcctagcactttgagaggctgaggtgggtggatcatgagatcaggagttcaagaccagcctagccaagatagtgaaactccatctctactaaaaatacaaaagtcagccgggcatggtggtgggtacctgtaatcccagctacttgggaggccgaggcagagaattgcttgaacccgggaggcggaggttgcagtgagctgagatcgtgccattgcactccagcctgggcgacagagtgagactacgtctcaaaaaagaaaaaaaaaataggccgggtgcggtggctcacacctggaatcccagcactttgggaggctgaggcggaaggtcaggagatcgagaccatcctggctaacacggtgaaaccccatctctactaaaaatacaaaaaattagctgggtgttgtggcgggtgcctgtagtcccaggtactcaggaggctgaggcaggagaatgacatgaacccgggaggcggagcttgcagtgagtggcagtcgcaccactgcactccagcctgggcaacagagcgagactccgtctctaaataaataaataaataaataaataaataaataaataaatgaaaaataaaaatagaattagccgggcatggtggcacgtgcctatagtcccagctactggggaggctgaggtaggaggatcacttgagcccaaagagtttgaggctgcagtgaaccatgattgtagtactgcatgctgtatgggtgacagagtgagaccctgtctcaaataaataaataataaaataaaagttatagcctctcaatatatagtgtttgaagccagatgagcattatgtagtttaaatattatttcaaacaaccattactctatccagacccttaccatttattcccccattactaacaaccaaaatatcaatatcacaacaagcagctttttcctactgcaaaggtttccccattgatcataattatttcctggacaccaccaaatgaaaatgagattaggaatgccttataggcttttgagaaaaatttctttgaggaaaagggaactggttttaatttatgggcatagttatcatgatctcaattttcctcccttgtagaaattaaaggccctgaaatagaatagccaaggaagttagttctcaaattgccttgcttccacgtctcagctatggtttattagatataacctctggctgacctcagatatagattattattcataacctgcctttctcacttttcattttctccatagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtaagagagagttcaatggtctacttatttaatctgtcttgttagttttgctgattatgttctgaaaagagcaaggatgatttcagctaagactgctttgccttttcctatgtcactgaactcaaagctttgttgaggaagtcagaaatgatgtatttttcagaaatcatgtatgttcccatcaaatttttcatgtcctactaggttttttttgtttttgtttttgttttttgagacggagtcttgctttgttgcccaagctggagtgcagtggtgcggtctcagctcactgcaacctccgcctcctgggttcaagcaattcttctgcctcagcctcccaagtagctgggattacaggcgcctgccaccatgcccagctaattttttgtgtttttagtagagatggagtttcaccatgttggccaggctggtcttgaactcctgaccttgtgatccgcccacctcagctttccaaaatgctgggattagaggtgtgagctaccccgcccagcctattttttttttttttttttgagatagagtctcactctgtcgcccaaatgggagtgcagtggtacaatctcagctcactgcaacctctgcctcccaggttcaagagattctcctgcctcagcctcctgaatagctgggactacaagtgcatgcccttgcgcctagctgatttctgttgtttttgatagacaccgggtttcgccatgttggccaggctggtctcgaattcctgacctcaagtgatccgcctgcctcagtctctcaaagtgctgggattaaagatatgaaccactacacctggccacttctacctgctaggtctttcagtgagacctagtgagtaagagttaggttgaggaacatcagtttttgtactactttgactaacattgttctaactatcttgatgattgataggacttctccaggtgttgtcaacttcgtagtaagtttttttgaactaattcatcagattgtcaggaagttatattctgtttctagcagggccagtccccaataaagggctgttaatagagctctcctttttctctagaaacacagttctccctaactgagaatgtcagtacatagtaacactagattgtttttatttatcgatgtttgattatataactagcgtgtgagatactaacctttggtcatttacttttcagttcttggattaaaaggtctggatcagtggttcttggttctcactgttcatcagaatcacctcggggagccttgggagataagccccatccccagagatttcgattcatttgatactggcttggtgtggaactggggcttttttttaaggtatccaggtgattgttgtgtacagccagcattcagattataggtgtaccctagataacataagttagggtggctgttgttgctgttactatcttggcacctttattattaatgggtcataaaataattcagctctattttatacactaaatatatcaactctataataaaatcctgtatgagatctggctggatgtgattgttctgtcttactgttatccctggggcttgggatcggggcttctgagagactaggcagtgttcgttagtggtcaccctcatttagctatgtagaggtcaaaagaaaagtgtaaagcaagttaattatgttttacttcacaggttcctagaattgtaataaaccagagagataatttagcctaacactttttattttattttattttaaaaaattaatttaaaacattatttaaatagagacagaggtcttgctatgttgcccaggctggtcttgaactcctggcctcaagcgatcctcctatcatggcctgccaaagtgctgggattacaggcatgagccaccacacctggccacaaaatactttttgatagttgggaaaactaaggcccaatgaggagaaataacttgcctaagtttgaatagccagagaacttggattcaaactcatatcctgattttatttcactaacttttctactctactttcccgtccatacaggtgtcttaattatataactagttcagacaaagttggttttatggagttagtgaacaaagcattatctctgggttaaaaagaggaatagagagcagtattttagtggcagggaaaagggattaggtctttatgtaaacattttttattttatagttcacttaatgattggctctaaggttaatactagtggtggcattcttctctcttgaggtcatttggaagtgtgttggggggttgtgactggcaggactacttgcatttatcggacaaaggacaaaggaccaatgatactaaaccttctgtggtatagtagataatcctacacaaccaagaaatctgctactcaaaatgtcgtagtgcccctgttgagaaagactggtttaactctaaatccataaaaccacacagcaccttgagaaatctgtccagtttgagtctatgtgaaacataatatccatttgctggattaggaaactgagtttggctatggtgagataaatgtgttataagaaactcagctagtgatatcacaaggcagtttgtagttgccaagtcattcccaaagttgatggttcttatgcaaagtctatgtggtcagtggcatgagtgtctggaatttctttgcatgccttactgttgcaaaaatcatgtccgtagctcgtggaggagccatggattgaagtgtgatcagcagcatggaaaggagacaatgccagttccaactcactcctcagctagctaatgttctaaaatagaaaaaacgttttctgtttatccattccttaagtcacttctggatatggtgacctttggggtaattttaattgagtcaaattcatttgataggtgaaagacctctgttatgacatctgccactaattaggtgtgtgaccatggacagtacatattatctccttggagtcatctataaaaatgaagatattgattcagatgctccttttcactcctggaactcaaagttaaatagagactaagttgagtttaggatcagctcttagaacgaatagcctaatccttcatgggtgacatagattaagggggcaggtacattcctaggagatgttaactggaggtcatctgaaaccaaatgaagtaattgccataatgtaagatgggactgagtctctctctcaagtttaggtgctgagaagtctagtggtatgatggatgagcccaaatagaaaatagacttttcctgcgatggagatgatttgccccatgtattttctagagtccaatgaaagactgggtgaatcactttcttttttctttctttcttttttttttttagagggagactcgctctgtcgcccaggctggagtgcagtggtaccatctcggctcactgcaaccttcacttcccaggttcaagcaattctcctgcctcagcctcccaagtagctgagattacaggcacccgctaccatgcccggctgttttgtatttttagtagagacagggtttcaccgtgttggccagactggtctcgaactcctgacctcaggtgatctgcccgcctcagcctcccaaattgctgggattacaggcgtgagccagcatgcccagccttttttttttttcttttgagacggagtttcgctcttgttacccaggctggagtgtaatggtgcaatctccacttaccgcaacctctgcctcccgggttcaagagattctcctgcctcagcctcctgagtagctgggattacaggcatacgccaccacgccaggctgattttgtgtttttagtagagacagggtttctccatgttaggctagactcgaactcccaacctcaggtgatccacctgccttggcctcccaaagtgctgagattacaggcatgagcctgtaatctgtgcctgtcagcctatgcctgaccctggccatttttttttttttttttttttgagacagtcttgctctttcacccaggctgaattacagtggtgcaatctcagcccactgcaacctccgcctcccaggttcaagatattcttgtgcctcagcctcctgagcagctagtactggaggtgtgtgccaccatgcccggctaatttttttgtattttagtagagatggggtttcaccatattggccaggctggtcttgaactcctgatctcaggcaatccgcctgcctcagccttccaaagtgctaggattacaggtgtgagccaccatgcccagctggatgaatcactttctaagctttatgacccaaacatttgaaaataagaccctggctgggcgtggtggctcacgcctgcaatcccagcactttaggaagccaaggtgggtggatcacctgaagtcagcagttcaagaccagcctgaccaacatggagaaaccccatctctactaaaaatacaaaattagccgagcacgatggcacatgcctgtagttccagccagtcgagaggctgaggcaggagaagtgcttgaatccgggggtgcagaggttgcggtgagccgagatcatgccattgcactcccgcctgggcaacagagcaaaaaaaaaaaaaaaaaaaaaaaaaaagaaagaaaagaaaataagaccctaagtaaaaagtagttatagcttggtgggaatatacagacctcattgtagacaactgatttggctttttatttttagatatgatcagctagaggttgatatatcagccaggttgatatatttctggaactcactagtattcaattgaacatttaagaagaaaggctgaatgtggactttttttttttttttgagactgagtttcactcttgttgtacaggctggagtgcaatggcgcgatcttggctcactgcaacctctgcttcctggtttcaagcaattctcctcccttagcctcccaagtagctgcgattacaggtgctctccaccatgccgcactaatttttttttttttttttgagagggagtctcgctctgtccccaggctagagtgcagtggcgccatcttggctcactgcaacctccgcctcctgggttcaagcgattctcctgcctcagccccctgagtagctgggattagaggtgcgcgccaccatgcccggctaatttttgtatttttagcagagacagggtttcaccgtgttcgtcaggcaggtctcgaactcctgaccttgtgatctgcctgcctcagcctcccaaagtgctgggttacaggtgtgagccactgtgcccagcccaccatgcctggctaattttttgtattttattttattttacttatttattcatttatttttttaatttaattttttttttttttttgagttggagtttcactgttgttccccaggctggagtgcaatggtgccatctcggctcaccacaacctccgcctcccgggttcaagcaattctcctgcctcagcctctcgagtagctgggactacaggtatgcgccaccatgcctggcaaatttttttttttttttgagatggagtttcactcttgttgcccaggctggagtgcagtggcatgatctcagctcactgcaacctctgcctcccgggttcaagtgattctcctgcctcagcctcccaagtagctgggattacaggcgtgtgccaccatgcctggctaattttgtattttttagtagagatggggtttctccatgttggtcaggctggtctcaaactcccgacctcacgtgatccgcccgcctcagcctcccaaagtgctgggagtatgggtgggcgtgagccaccacacctggcttatttattaatttttttgagacagagtttcgctcttgttgcccaggccagagtgcagtggcgcaatctcggctcactgcaacttccgcctcccaggttcatgtgattctcctgcctcagcctccccagtagctgggactacaggcatgcgccaccacgtctggctaattttgtatttgtagtagagatggggtttctccatgtaggtcaggctggtcttgaattcccgacctcaggtgatctgcccacctcggcctcccaaagtgctgagattacaggtgtgagccactgtgcccagctaattttttgcatttttagtagagatggggtttcaccatgttggccaggctggtcttgaacccctgacctcaggtgatccacccgccttggcctcccaaagtgctgggattacaggcgcccggccagtggacatcttaattttgataaccagtgtatgatttggtggcatataacagagccatctagttgtatggatattggcagtttctctgctcctatgggatgtcacttgaggtcagatcgttttgcatacttaaaattcaccgcatgctatcaaccaaatagaactgtaaacagtttgtcaactaataagctgaatttctggttgaagtacagttggaacaggttatctccacatttgggtcttttacctcttagcatagtgtgatttctttcctcttttttaaaaatccacctccttcctctctagcatagtgtgatttctttaaatcttttttatcctatgctaaatgtatgggttttttgtttgtttgtttggtctcactctgtcacccaggctgaagtgttcagtggcgcaatcatagctcactaacttccaactcctgggctcaaacaatcctcctgcttcagcctcctgagtagtggagattataggtgtgcaccaccgtgctgagctaatttttaaaatttttttagagatggggtcttgctatgttgccctggttggtcttgaattcctggcctcaagtgattgtctggccttggccttcccaagtgctgggatgacaggtgtgagctaccttgcccagtgtatacttcatgttatagtgaaacaggagagttccctcatctcccttgcaggatgtaccacagggatgtgtcttgcttgctccttcggttgccccactgctcaaacccctaaggggaggatgcagatgggcaggtgcaacagccatgggaagcacttttgggctccagccccacggcaccatcttggggtggtgtctgcgactctgaaagcccaagtgagcatgtgttacagtgtgctctttcagctttgctgtctgcagacagcttgtgttaaccagctcaatagaccatctgccttattgcaagggcagagggccagtgtgacagctttctgtatcctgagctcttgcccagtgtaccagaaaaattggatcacatgtgggctcgaaggatgagtgcaaggttttattgagtggtggaagtggctctcagcgacatggatggggagctggaaggaggggctggagtagggaggtggtcttccccaggaatcagggctcctggaggccggactcttctctgacggccccgagttgaattcccctcggtgtccagacgtccctcctctctttctctgccttgtcgttccaccattgcaagtctgctggcctgctggtgtctgctggtctgttcctctgctcctcttgatgttcaatcacttgtgtctgtgcctgctgtggtctcgggtttatttgggcacaggattgggggtgttgcaggccagagtggtcttggaaaatgaagcatttggatgcaaaaacaggcatgcctgttctcacttaggtccataggtacaggtcaaaggtggagcccttgacagggactctgcccttctctacccagcacttccctgtccccttcccatatcaatagtatttgaaacttgatctcaattttctctcatgtgtcttaaaacatatgttcaagtcactgaatgatcttcattttatggttaacataaaatgaagcatgtttggttaacaactttatctgagaacaatctgtatttgctgttatatgtgtatacctaaaaccagcgtaagatgtctatcactggggttcaagacaatagttgttgctttggaaggagaaagtatattcactcaggaagggctctgaagttgagttatatttctatttcttttctgatctagaaagaaaagtactttaccaatatttttgaaaattgagaattcagatgagattgcctgtaaagatgttggactcttcagaataatttaactagaaaattttgagctcttttgtaattataaataatttgtaaagtttctcccatgatactagtcatagtatgttaatgagtttggaataagctcctagataccacatttcatttttttttttttttttgagatggagtcttgctctgtcgcccaggctgggtgcagtggcacgatctcggcttactgcaacctccgcctcctgggttcaagtgattctcctgcctcagcctcctgagtagctgggataacaggtgtgcaccaccatgcccggctaatttttgtatttgtatttttttttaattatttatttatttatttttttgagatggagtctcgctctgtcgcccaggctggagggcagtggcgcaatctcggctcactgcaagctccgcctcctgggttcacgccattctcctgcctcaccctccccagcagctgggactacaggcacatgccgccacgcctggctaatttttgtatttttagtagagacggggtttctctgtgttagccaggatggtatcgatctcctgacctcatgatccgcccgcctcagcctcccaaagtgctgagattacagacgtgagccaccgcacccggccacgttttgtagttttagtagagacaccatgttggtcaggctggtcttgaactcctgacctcgtgatccacctgccttggcctcccaaagtgctgggattacaggtgtgagccaccacgcccagccagatttcattttcattcacaattcatataaagctgtgcagacctttatccttgggcagtaatagtgtcaaggtcagattctgggaggatctgggattgactttcaacttcttccattgggtcaaaagagaagtttagaggacaatagtgagagaaggcctatctattgttcctacattctatttttcacattaactttaggaaatattagtcaagttttctcagtggctaattagaaaaataatggtaataataggttacatttaataagtgctttactgtatgccggatactctgctgtgctttatgtggagtaccacactgaattatcaaaacaatcccatgaggtaagtattgtgctattatttcccacaatttttttttttcttttttttttgagatggagtctcactctgttgcccaggctggagtgtgatggcgtgatctcggctcactgcaacctctgcctcccaggttcaagcaatcctctagcctcagcctcccaagtagctgggattacaggtgcccgccatcatgcctggctaattttcatatttttagtagagacagggtttcaccatattgctcaggctggtctcgaacccctgacctcaggtgatccacctgcctcggcttcccaaagtgctgggattacaggcaggagccaccgtgcctggcctattgcccacaatttatggatggggaattgagacataaattaaataacatgcccaaggtggccagcttgggtattgaatctagtcagagctcgtactataaactactacactaaactaaaacctttggtgtaacagatatgcttttttttttttgagatgaagtctcgctctgtcgcccaggctggaatacagtggtgtgatctcggctcactgcaacctctgcctcccaggttcaagctattttcctgcctcaggctcccatgtagctgggacaacaggtgtgcgccaccatgcctggctaatttttgtttttttagtagagacagggtttcgccatgttggccagctggtctcgaactcctgacctcaggtgatctacccacctcagcctcccaaagtgctaggattacaggcgtgagccactgcgcccaggccttatggtctgttgagcagttcttctctaattaaatgttagccttgttagaaagggatagaagttagaaaatatatatttatatatacttgaaaaattttttttacagacagggtttctctctgttgtccaggctggagtgcagtggtgtgatcatggctcactgtaccttcagactcctgggctcaagcaatcctcttgctcagtccctgagtagttgggactacaggtatgtgccaccattcccagctaagtttatttatttatttatttattttttgagatggagtctcactctgttgccaaggctggagtgcagtggcatgatcttggctcactgcaatctctgcctcccaagttcaagcaattctctgcctcagcctcctgagtagctgggattacaggggcctgccaccacccccagctaattttttgtatttttagtagagacagggtttcaccatcttggccaggctggttttgaactcctgacatcgtgatccacccaccttggcctcccaaaatgctgggattacaggcgtgagccacagcgcctggcctaaatttttttgtagagatggggtctcaccacgttgcccagggtggtcttgaactcctgggctcaagtggtcctcccactttgacctgtcaaagtgctgggattacaggtgtgagctaccgtgcccagcctagaaaaaatattttttaaatcatgctttattaaagaagcagaatagaaaataaaaaacaacacaagcaagcaaacataaacgcttgtatatttgccacccaaaggttactccctaccatctgtatccttttctatgcatatatgtatatattcatatttttttactaaaatgaggtcatactgtacacactgttttataatctgctttttttagtcaaaaaaattcactttctatttcaataaattttaatctaatttaatatacacactctattcatttctccaaggaacctgaaaattctggttccttcatgcaagtatccaatccacaaattgtgtattatgttctttaaatttcttaatctgtcacattctatcacattaccaccccccacctttttttatgacagtgactagtgactcgtttaagaggaagttagcaaatcatgaaagtatatgattgctagtgaaaatttggtagcatatagagaaacagaaggaaaaataaaggaagatttaccattctacactttttatagttacagagcaacaattggtattaattgcattaatgatgatattttaatgaattttataatcattttatgtaccatttatgacagagctttttagttttagctatatatgtttgtgtttgactaggaaagacatacagattctcatttctttttagtctcactttaaactccttgagtttgaaatgactttatttaaatctagtggtagagatagagttaagtaatagctatgaaacttttggaatagtaaaatgtgccatattggtataatacattatttattatcaaggagtccttttataagataaaaattttttactggaaaaacctctttaagtcttttgcatgttagtgcttaaaacttggaaatttaggtctgaaagccttttgatgatggcaaatatatactatcaatattataattcaaacgttgagaataaccactattgaaaatgcaggaggccaggcgcggtggctcacgcctgtaatcccagcactttgggaggccaaggcaggtggatctcctgaggtgaggagttcaaaaccagcctggccaacatggcgaaaccttgtctctactaaaaatacaaacattagccaggtggtggcgagcacctgtaatcccaactacttgggaggctgaagcataagaattgcttgaacccgggaggtggaggttgcagtgagctgacagcacgccactgcactgcactccagcctgagcaacagagcaagactccatctcaaaaacagaaaaaaagaaaagaaagtgcaggaaattttattcctgcttcctatctattggttcatcactatcaagctttgacatgggaaataaggaaattggctctggttttgtttatattaaggctttgcttatggatagtttgagagtgttcttatgtattgactttcttagcatttttcatttagctttcctgagcttcttcccttcccctaatagctctccaaactttctactttcagtgctccttccttgatattctgaggttcccagttgccatggtgcctttgtagtgagtagacagagaaggtcattatgagatctgcaacttggtactcctttgctgagggaactagtttcctctttccatctcccatcctccccttctttccattcagaaaacaggagctgtctgtggccatatatgtattttagtctctggagtgcattctataaacttagctaattgtggaaatgaaattatgaatgttgtaagtaaggctcggtacagctgcttgacagtgtttattacttttattatttcaagtgtaatgcatgcatttccccctcttttctttctgttagcataaatttacaaatgaagtttgcatttactactttatattgttaaattattagaagtaatgtaggtttattattagaaaagtaggaaatccaagaagtttttttttccagatagagtcttgctgtgtcgcccaggctggagtacagtggcatgatcttggctcactgcctccgcctcccgggttcaagcgattctcgtgcctcagcctactaagtagctgagattacaggtgcccgccactattcccagctaatttttgtatttttagtagagacggggtttcgccctgttgcctaggcagggccgcctgccttggcctcccaaagtgctgggattacaggcgtcagccaccgcgcccagcctcaaaaagtatttaaaaaaatagaaacactgaggaatacaatcattccatagtaatcactattcatattttatatatttcctttctgtattttttaccacttaaggataaatgtcattaaaaatatacatatagatgatattataatgaatatacagctctgctttctgctttttttccccatataacaacactttctcatgtcattgcaaatctttttttcttttttttttttttctgtgacagggtctctgtcacccaggctggagtacagtggcatgatcacggctcactgcagcttcaacctccctgggctcaagtgatcctcccacgtcagcctcccaagtagatgggactacagacgtacaccaccacacccagctaatttttgtattttttgtagagacacggtttcgccatgttggccaggctggtctcgaactctggaccttaggtgatctaccctcctcggcctcccaaagtgctgggattacagacatgagctacctcgcctggcctgattctaaattttggctgttgtgaatagtgctgcagtaaatatggagtgcagatatctctttgatatgttgatttcctttcttttggatatatacccagtagtggaattgctgggttatatggaagctctatttttagttttttgaagaggtttcatactgctttccgtagtggcagtactaatttatattcctaccaacagtgtacgaggtttcccctttctccacatcttcatctcatgacactacttcagagggttcttgttacccataggatatgttagtgtctagccaaacattgtgtcacaggtgcttaacattatttctaatactcacaacagtactaattattattatggtgggctcaatgagttctgttaagggtccaataaggtcttggagatgtttgaactagaatttgaaggatgaacagaaaaaaggctagcaaagttaggggtgtgtgtgtgtgtgtgtgtgtgtgtgtgtgtgtgtgtgtgtatgtaagggtagagctggtagggtagacaatgtgcagaagtatcagtgaaacgtctagcattttcaggcaattacaagtcattgactattactgcaatggaaggtgggcagcatggttggtgcaaaagaagaggccggtaagacagaggtcaggtcattaagggtctttcatgtcatactgtgataataaataagcatttggtctctatccttggttcctggcacacagttcctaaagcccttgggatttcttgaccggtaagtatcttttatgataatgagatgactggggtctgagggcccctggatagcttcaggctggggtctgttaaccagaaagaccaaggaataattagagaattggaactttcaagtctgctctctaacctccagggaggggcaaggggctgaaaattgagctaatcacaagtggccagagatttaatcagccatgcctacttaatgaaacctccataaaaccttgtaaacaacagagttcatagagcttctgggatggtcaacacatagaggttctggtagagctgtatgcctggaggaaggtttggaagttctgtgccccttcccccataccttgccctatatgtctcttcctgagttcctgagttgtatcctttataaagcagtaatagtaagtaaactcttttcctgtgttctgtatgtcattctagcaaattatcaaacacgaggaaggggtcatgggaatctccgatttatagctggttggtcaggagtataggtggctgggatttgcaactggtatctgaagtaggggacagtcttgtgggactgagccattaacctgtaggatctgtgctaactctgggtaattaatataagaattcaattgtgagactcccagttggtagctggacagaactggttgttgatatggaaaaaaacctgtacattcggtgtcaaagtgttgtaagtaaatacagctcagacataagacatctgtaaaatggaaaacaatgtttaggttctccttaactgtgcaacagactttattaaaaatatggattccagctgggtacggtggctcacgcctgtaatcccagcactttgggaggcagaggcgggtggatcacctaaggtggggagttcgagaccagcctgaccaacatggagaaaccccatctctactaaaaatacaaaattagttgggcgtggtggcacattcttgtaatcccagctactcgggaggctgaggcaggagaatggcttgaacccgggaggtggaggttgtggtgagccaagattgtgccattgcactccagcctgggcaacaagagcgaaactccatctcaaaaaaaaaaaaaaaaaaaaaaaagcattcctggccgggtgcggtagctcatgcctgtaaattcctagcactttgggaggctgaggcagacaaatcacttgaggtcaggagtttgagaacagcctggccaacacagtgaaaccacgtctctactaaagatacaaaacttacccgggcatggggacatgtacctgtagtcccagctacttgggaggctgaggcaggagaatcacttgaacccagaaggcggaggttgctgtgagccaagattgtgccactgtacttccagcctggttgacagagtgagataccatctcaaaaaaaaaaaaaaaaaaaaaaagtgtggattcctgagtcctatcccggatttattagattacagcctctggtcgtggagcccaggaatcgttattctaatactttccaggagagtctggtatgaatcctgagccaagaagcactttttcagagcttagaacaatgcttggcacatttcagtgcttaataaatgtttgttacattgaaattaaagttgtacaaatggaaatctacttgcacaagaatatatagtagagtggtcgggcgcagtggctcatgcctgtaatcccagcactttgggaggctgaggcgggcggatcacgaggtcaggagatcgagaccatcctggctaacacggtgaaacctcatctctactaaaaatacaaaaaattagccgtgcatggtggcgggcacctgtagtcccagctactcgggaggctgaggcagaatagtgtgaacccgtgaggcagagcttgcagtgagccaagatttcgccactgcactccagcctgggtgacagagtgagactccatctcaaaaaaaaaaaaaaaaaagaatatatagtagaaaggaaatatgtcttagggaaatatctacctcattcttttttatggctcaatagtactccattgtgtgtatggagtagatatactctctattttattacatatttctttttatccattcatctgttgatggacccttacgttgattccaaatcttggccattgtgaatagtgctgtaataaacatgggagtgtagatatctcttcaatatactgatttcctttattttttgcatttacctagctgtgggattgctgggttgtatggcagttccatttttagttttttgaggaacctccatactgttctccatagtggttgtatggagatttacattcccattgtgttttaatttatacagccatcaagggaaccaccaatacaagggttcccttttctccacatcctcttagcatttgttactgcctcttttgggtaaaagccattttaactggagtgagattatatctcattgtagttttgatttgcttttctctgatgatcagtgatgttaagcgccttttcatatagctgtttgctaattgtatgtctgcttttgagaaatgtgtattcagaacttttgcctattttaaaattggattattagatattttcctattgagttgtttgagctccttatatattctggctatcaatcctctgtcagatggagatactgtttgttgaaatgaaaatgaagttgtaataaccatagtttgatatctcatatttttctgagtattctttctcccaagattcatagttctttagttctttttttttttcccttcaacttctattttaagttatggggtacacctgcaggatgtgcaggaggtaaatgtatgcaatggtggtttgctgcacagatgaacccatcaccttggtattaagcccagtatccattagctattcttcctgatgctctccctcctgcaaccccccaaaattcttatctcaaaatgctaaatttaataattcttcataagtaaaaattctaacctcctccctagtaaaatctaatgatagtcatgaaactgggactccattagtcaggaaaatgtctaggagttcatcaaggaaagattcttcagagtgttcagaatattgaatttgggttccaggatatcctgatctgccaaatgtatcatgacccactaattgtgtcatgtcatctctatattttttccctttatatattttttttgtttctttaaaaattttttttgtagagatggggtcttgctacgttgtccaggctggtttcaaactcctggactcaagtgattcttctgccttggcctttcgaaatgctgacattacaggtgtgagccaccgggcccagctgcctttattatttcagttcccaccatcactgactttatgtaggtgttcattatctctagcctagtctattacaatggcctttaactattttctcttactttagtctctccctgtttcacatctgttcaaaaacatgtaatgttttccctctgctttcagagtaaagcccaagataacaaccccaacttttactgccatttattgagcatttactgtgagttaagcactaagtgctttcaatatttatcttatgtaaccaaacaacagtcagtcctgtaaaataggcgttaattatctccattttccagaagaggaggatacaggctcagagagattatgtaattttcctacctaataagtggtggaggcattcagtcatggtattcagattcttccacaattaggccatagctgatttttccagtcttgtttctacccagtgttttttccctctttgcttattccagttgcagtagacaattgcctgtttcctaaaattccatatactttccatctttatgtcctttgatcattctatttgtgtctcagtctcttttcctgtgtctctctttgtcatgtatccttactgaaatgccatttccctgactgttgaaattccatttacccttggaggtcatcactcctttttttctttttaatgagatgaagtcttgctgtgttgtccaggctggtctcaaactcctggcctcaagtgatctcctcacctcagtttcccaaatgctaggattacaagtgtgagtcaccatgcccatctgaggtcatcaatctttaaagaccttctgaaatgctgcctctgctatgaagcttttcttttttctcttctccttcttcttcttctttttttttttttttgagacagggtcttgctctgtcacccatgctggagtgcagtggcatgatcttggctcactgcaaactccacctcctggattcaagcaattctcctgcctcagcctcccgagtagctgggattacaggtgcgcgccaccatgcccaactaatatgaagcttttcttgttctttctcctatattgtttttctcttctggtaatttggccttccattttctgcaacagtaatttcatttcttctccattgtccttaaaccagcagttccatttgtgccatttcctgcctcttctagacacttttaatttatagctttgccacattattttattaagaaaatagagactatctagtaattcttctaacacctcatttcaaacttacttttatctgtattctccttctcattttttcttcatgcatatgtatgtatgtgtgtgtgtgtatttgtgtgtgtgtgtgttttgtaacccagaacaatgctgacaacatttttccttctttcctgagaagtgttccaagtgcttggaacagaggatgaccaaaggagggagggtcctgagaagtgttccaagcactctgatttcttccatctttatagaaggcctttttttgatagccacattccctttggattattgccttatctctctgccccattttatggtcaagattttcagaagtgctatccctacttcctcatctcccattcattcttaaagctattctgttctgtcctctgcccaactatgctattgaaactgctctcgtaaaaaccactaatgactactgtattgctaaatcagtggatgcttttcagttctcatccttctaagtctctcaacagttccatacaagtgactacttttttcttgaaacacatgccttcttttctgctaaagactacactttcatgactcctgtgttacctccattctactcttaccaatctccagtctcccttgcaagtccttctgctttcatgcaacctttgagtgttgaatactttcattgcttggttctggtccttcttatctttttacttgatatacattttctttctttttttttttttttttttttgagatggtgtctcgctctgttgcccagggtagagtgcaatgttgcaatcttggctctctgcaacctctgcctctgggttcaagtgattctcctgcttcagtctcccaggtagctgggattacaggcgcccaccatcatgcctggctaattttttgtatttttagtagagacagggtttcaccatgttggccaggctggtcttggactcctgacctcaggtgatccacctgcctctgcctcccaaagtgctgggattacaggtgtgagccactgtacccagccacattttctatatataaaattcatccctttgctactgcttatatgctgatgattcccaaatttataatatccatcccagacctatcctctgagatcacttgttatgttcacctattcatatgacattttcatttgaatgtcttatagacattaaattcttgatttcccctatcttcttcataaatttgatcctcccccaatcttccacatctcactaaatagcacctccagccactctgctcaaaccaaaaaacctgggaattgtacttcagtttggttgattctatctccggtattgaccccagtaccttcacttgcaatcaccttagtccaagccttagcacgtcagctcttgcttggactattagaatgatcacctaactagatttcctgtctgtattatacttttgcctccttatttcttgctgcacatagcataagatacaaaattctagtttttctgtttttttgttttgaaacagggtcttgctctgtcacccaggctggagtagtgcaaacaggactcactgcagcctcaagcttctgggctcaagcctcagactcccaagtacctgggtcaataggtgcatgccaccctgcttggataatttttaaatttttttgtagagatgtgttctcactatgtggcccaggctggtctcaaagtctcggactcaagtgatcctctcgccttcacctctcaaagtgctgggattacaggtgtaagccaccacacctggcctagatacaaaatttttaactcagctcatgagaccctgaatgatctgacttctgtcaacttccatttgctgacagggcttcaatcatactggcctttcagttcccctgaaaagatagtagtccaatatttttcctatctcaaggccacatgcactggtccttatgcctagaattcactttcactctctttgatcacttgaggtctttatcctttaggtttcagatcaaatatcatttccccaaagaggctctattgttacagtgttcctttttttcccattgcaatagcatttatcacaatttgtaatgtttttagtaatatatttatttgatttcttgtctccattatactgtaacatgagcacagaagccatatattttgtttatagctgtatactcatcattttctatagcatataatagtcactcaataaatacttgttgaagccaggcatcgtggctcatgcctgtaatcccagcgctttgggagactaaagcaggaggtttgcttgagcccaggaatttgggacaagcctaggcaacatagagagacctatactctacaaaaaaaaattttttttaatagctgggcatggtgttgcatgcctgtattcctagctactcggaaggctgaggcgagaggactgtttgagcccccaagagtttaaggccgcagtgaactatgatcatgctactgtactccagcctaggcaacagagcaagactgtctctacaaagtaaataaaaacataaaataaatacttgtgaataaatggtagaggtataaagactgattgggaacagtcacaaaagataatagtagtagtttttgtttttccattttcatttttattttattttatttgagggcagtagcgcaatcttggctcactgcaacctccgcctctcaggttcaagcagttcttgtgcctcagtctcccgagtagctaggattacaggcgtgcaccactaagccagctaatttttgtatttttagtagaggcagtgtttcaccatattacccaggctgatctcaaactcctgacctcaaatgatccacctgccttggccttccaacgtgctgggattacaggcgtgagtcaccacacctggctagtagtttttaaattatacatattatgtatttgatttctgtagtagatttaggattattcagattttcatgtctttctgggtggaatggaaagtcgttaagaaatttatcaatttttttctaacatttcaaatttattggcataaagtttgtaataatatgcttgtttttcatgtctataggatttatagtgattcccttgtcctcattcctgatattggcaattagcatttttttcttttatttttatcagtcttagtagaaatttatcaattcagttccttttcaaagaattaacttctggctttgttgatatccatctcttcatctctgtattcactcataaattcgtcttattatattcctcaagcttggatatacattttcattattattcaattaaaatattttcttaatttccttgtgattttttgactcataaattgtttagaaatatatcaagacacttgtggattttattacctttgttattgatttttagtgtaatccattgtgttcagagcatatacgctatgtgatttcagacctttgaaatttattgatactttatggcttagtatatggtctattttgataaagtttcataaacacttgcaatgaatgtatatgttgcagttggtgattataggttctatgtatgttcagtttttcagtttgttgttcttctgtgtctttgattttttttttctacttgttatatcagttgctgaagaagaatattaaaatatcctactataaggatcttatgactgggcacagtggctcacacctataatcttaccaccttgggaggccaaggtggatggattgcctgagctcaggagtttgaggccagcttggacaacattatgaaaccccatctctactaaaaatataaaaaattagccaggcatggtgccacacgcctttagtatcagctgcttgggaggctgaggcacgagaaccacttgaacctaggaggtggaggttgcagtgagctgagattgcactccagcctgagggatagagcgagactctgtctcaaaaacaaagcaaaacaaaacaaaacaataagaaaaaagacattcaacacaatagaaatatggggaaaagacttcaacaggcacttcaaaagaagataccaaatgtcaagtaagtatatgaaaaggtgctcaatattactagtcatcagggatttgcaaattaaaattacaatgagttaaacacatagcccaaccaaaaaaggtaaaattaaaaaacgagcaatatcaagtgttagcaaggaagtggaacacactgactcttacacatcactggtattaatatgaattggtacagccactttagaaaactatttagcagtatcatttaaagctaaacatgcacatacctcactagtgagcaatttcattttagtgtatattcccagaggaaattagttcatttatccatcagaaataagcaaatattgtcaaaattcataaacaacccaaatgtccgtgaatagtagaataggtaagtaaatcatggtatatcatatgatggaataccatacagaaatgaaaatgaacaaactactgctgtatcacaacatgggtgaatttttttttccataaattcgaccaagtggtaagcatagataaattttatacacataaggccaggcgtggtggctcacgcctgtaatcccagcactttgagaggctgaggtgggaggatcagttgaggccaggagttcaagaccagcctggccaaaatggtgaaacctcatctctagtaaaaatacaaaaaaaattacctgggtgtggtggtgcttacctctaatcccagctacttggaaggctgaggcaggagaatcccttgatcccaggaggcagaggttgcagtgagccgagggtgcaccactgcactccagcctgggtgacagagcaagactccattgcaaaaaaaaaaataataataaatttatacacataatattgatcaaaagaagtcagacattaaagtacatacattatataacactatatttatgaagttcaagagtaaacaagactgatcaatggttataaaaggtcagagtagtctttacctttaagggagaatattgactaggaagggacacaagtaagccttctgggactctggaaatattctgtatcttaatgaggtgattggttatatggctatatatatattaattttacatatatatgttttatacttaagatttttccacttcattgtatgaagttatatcggtcattaaaaagtaaataaaacagggaggacttccaggtatagctgaatgaggagactggcagatcttcaacacaaaaaccaattatgaagattgacaaacttgacaaaattaaccattttaacactcttgaaatcaaccaaaaggcatacaataatttgagagaattttatgattaaaaaactgctggccgggtgcagtggctcacgcctgtaatcccagcactttgggaggccgaggtgggcggatcacaaggtcaggagattgagaccatcctggctaacacggtgaaaccccttctctactaaaaatacaaaaaattagccgggcatggtggcgggcacctgtagtcccggctgctcgggaggctgaggcaggagaatggtgtgaacccaggaggcggagcttgcagtgagccgagatagtgccactgcactccagcccgggcgacagaacaagactccgtctcaaaaaaaaaaaacaaaaaaaacaaaaaaaaaaactgctaaaattccgtaaaacagtaggagtttgtggtattcttgtctgggattgttcctattcccctttccccagctgatttgtcatgaaagttttaccagtgtgggtagaccatgaagaccagctgctttgatgctgtggttgaagggagtttactcagtttgggtggtggatgatgtccatgctcaatggcattgttgggagaagtgaccacttggcagtgggtgagtggcacaggccagtgactttgcctgtttgtggttggggcaagcatattgcaggctgaggcatgtacatgcacagaagagacatgataaggcccaacggaaagtaacagctagggcagacttgaaaaacctgaactttgaatgcactactctatatcccccatactccagacccataaacagaggataaaagcctttctagctttaagtatatgagcataaactctatctaatcattggctacacagacataggggtgactcctcaaaagccacatttaaacataaaaccaagaaataaaaagaaaatgagctgagacatcagtggctgcacactgttagggaaacagaattcacagatttagctcaggcaaatgattaagccaagaaagaaaaaaacaaactagtaacaacaattttcatgggtgaaagaaatcagaatccaaattgttcatatgttcaatttgtaaattgttcatatgcataatttgttttctaatcccatgacaggttatattcaatttttaattaaaaagccgtgagacatgtaaagatacaggaaaatgtgacccatgtttaggaaaaaagtcaacagaaattatctacaagtgtccctagatactggatttaacaaagatttcaaagtagcgactgtaaatgtgttcaaagacctaaaggaaaacatgtttaaataatttttaaaaacatatttatttatttttatttttatattttatagggacagagtcttaccatgttgcccaggctggtttcgaactcctggcctcaagtgaccttcttgccttggcctcccaaatctctggaattacaggtgtgagccactgtgccccatcttaaatactatttttttttttttttgagacagagtttcgctcttgttgcccaggctggagtgcaatggcacgatcttggtcaccgcaacctctgcctcccgggttcaagcaattctcctgcctcagcctcccgagtagctggtacaggcgtgcaccaccacgcccagctaattttgtatttttagtagagatggggtttctccacgttggtcaggctggtctcgaactcctgacctcaggttattgcccgcctctgccttccaaagtgctgggattataggcatgagccaccgcgcctggccccttaaatactgtttttttaagcatgacaacaatgaatcaataaatagaacttctcagctgagtgcagtggctcatgcttgtaatcccagtgcttttgggaggcaagcggggtggatttcctgagcccaggaatttgagactccatctacaaaaattttaaaattatttgagcatggcagcatatgtctgtggtcccagctacttgggaggctgaggcaggaggatcgcttgagcatattgagtgtttgcaccactgcattccagcctgggcaaaagagcaagactctgtctcaaaaaattaaaaataaaataaatagaaattctcaataagaaaagagaaatgatttttaaaaagaagcaaatgaaaccaaagaggatatacctatggcaaataaacacatgaaaagatgttttataattatctaatagttattaggtattaggaaaatgcaaatattaattagtattaggaaaatgcaaattaaaatagcaatgagatatcattacacacttatcagaatgcctaaaataagaaatagacacaataccaaaggtttgtgagaatgcagaaaaattggatttcttgtacattgctggtgggaatgtaaaatgatacagccactctggaaaataatttgacactttcttttttttgagacggagtctcgctctgttgcccaggctggaatgcaatggcgcgatcttggctcactgcaacctccgcctcctgggttcatgcgattctcctgcctcagcctcctgagtagctggtattacaggtgcctgccaccatgcccaggtaatttttgtatttttagtagagatggggtttcaccatgtgggccaggccggtcttgaactcctgatctcaagtgatccacttgcctcggcctcccaaagtgctaggattataggcgtgagccactgtgcccggctaatttgacactttcttataaaactaaactctcaccatatgaaccatatgatctggcagcttcactccttattgtatacccaagagaaaggaaagcatatgtccacataaaagtttatacatgaatgttcataacattattaataagagccacaaaatggaaacaacccaatatccattaactgatgatgtataaacaaaatatggtgtgtccacacattgaaatattgttcaaccataaaaagaaatgaagtactgatatatgctacagcattgaaaacattatgctaaatgaaagaagccagtcacaaaaggccacatattatattattccatttatatgaaatgtctgtaataggcaaatctataaagacagaaagtagattagtggttggctaggattggggagcatattggagaaatgaggagtggctgctactgggcatggggtttcttttggaggtaataaaaatgttctaaaattgccatgcgtggtgcacgttcctgtagtcccagctacttgggaggctgaggcaggaggattgcttgagcctaggagtttaagtccagcctgtgcaacatagcaagacctcgtctctttaaaaaaatgacacatataatgaaatgaaaatgtccttaaatttattgtgatgatagttcataactatgtgaatatactaaaaactattgaattgtaccctttaagtgggtgaaatgtatggtgtgtgaattgtatctcagtaaaattgttaacaaaaaatttttaaatgagtttatcaagatcacagggtgtaagatctatatagaaaagttaagtatatttctatatgctagctagaaatgaacaatccaaaaatgaaattaagaaaatattctgttcatgatagcattaaaaagaataaaataggaataaattgagcaaaaaaggtataagacttatacactaaaacttgtggaacattgctgacagaaattaaataaaatcagccaggtgtggtggctcacgcctgtaatcccaaacccagaggctgaggcggatggatcacctgaggtcaagagttccagaccggccgggtgtggtggctcacgcctgtaatcccagcactttgggaggctgaggtgggtggatcacctgaggtcaggagttcgagaccagtctggccaacatggttaaaccccatctctactaaaaatacaaatattagcctggcatggtggcagtcacctgtaatcccagctactcgggaggctgaggcgggagaatcgcttgaacccgggaggtggaggttgcagattgcagtgagccgagatcgcgccattgcactccagcctgggtcacaagagcgaaaccctgtctcaaaaaaaaaaaaaaaaagagttccagaccagcctgtccaacatggtgaaaccctgtctctaataaaaatacaaaaaattagctgggcgtggtggtgttcttttagttccagctacttgggaggctgaggcaggagaatcgcttgaacccagatggcagaggttgtaagtggagatcgtgccactgcactccagcctgggagacagagcgagactccatctcaaaaaagaaaaaaaaaagaaattaaataaaatctaaataaatggagaggcagtccatgttcatggattagaggactcaatattgtcaagacagcagttctccttaaattgatcataaattcacagtccatatcaaatttccagcagcctttctttttctttctagaatttgacaagccgatcctaaaatttacatggaaacaaaggacctagaatagccaaaacacttttgaaaagggaatgtgaagttggaggtcttcatactacctgatttcaaaacctactataaagtcacagttatcaagaccatgtggcattgcttcaaggctaggcatataggtcaatggatcagaatttagagtccacaaagaaacctttaaatatatggtcacttgattttttgacagagacacatccttgatccaagatttctctgcttgtaaaaacccaatgtaaaacagtctctcacagtgtgtgtgctgcagtataactcagactgtgttgcagtcaagctagcgaatgcatcactgtctgccgggtaaactgctacgtcatccttggtgtttggcatgttacaatgctgggatcagtgtgggcttctagttggattttgtgccaggtatgtgtctacgttggacactgttcatggtagattaaaagggggatgctttaaatttggagaaatgaatgtggctttttatttcttgtattctaatattagagaaagattgtgagcagcagtgtctataaaagatctatatagatctctagctttgcttttggacctgggtatgctgtgttagtgtttggttgtcgtagaaagatccgtttggtgaaaggaagcataaactcgattattgagtgtgcctctttagtatatttttctgatatagttgagtgcaaaatagtctgccttatttttacacttagtgctttatttgcatttttgaatggtgaacttgtataacaagtttgttttgtagacacttaagtgtgtgtaaaattgagcagcttctcatctgtggctactgaactttcctgaacaaaggctgcagtgctctatttttgagacaggttattctgaagagacgtaaagatagaagggctcctctgtgtcagcttggttctttaaagggaaagtaaacttgactaacttaatgggcattggcacattgtggaagggatgatgtgaagtacagaccagagaacaaccaggacttccattttttattatagctggttgtcatgttgggtggcctgattgagttgctttcaaatttgggcaacttgagtctttacaacttaagttgcccgaatgtccttcagatcaatgtttgtttgttgtaatcatttatcttttatctgattatttaacttctatctatgctccaggtcatttgtgtacttctgtttttgaaggtttttctggaagcttaatatattctcagcgtggttggcatcagattgttaactatttctatccagcattttgatgggaataaattttttatggttcatgattcaggttagatttggtgtacaggcctgaggacttgcctcaggaagttgtctttctatagattctaagcctttagggtcttttgccattgatttttctcctaatacacagaatatcatgagcatctacttaagtaaaagctaaaaacaggaagatattacaagataacattcagctagtgtttatttctttaagagatctgtctgtggcaaatttgctttcatagtaatatatgtgtctcagtaagtagtctttctaggcaggatttttcttccctgcttaagggggttagacctccaaaatatttgtcagggtctcttttccttttaagggtttaacccacaatcttttctgtatccgttttgtaccagctccattcctattctcaagctttggtgcataaaaccttagtttaggtgtctatatataccactactttggcctgaaaattagaatcgtggctcacacttgattctaagttccctagtagtggcgtgtttcctttctacgtgcttactttcccacctgacctgcttttccccaccgtgcagtctgataattggtattatttgttttgattggatctcagaaattacctctttagaccgagctgtgctcctccctctggatttcatgagcccattattttcttggcttaattgtccttgtaaatttggtctttttgtcctgggctttccctgtcatgtgctcctggcagccaggagaggcagtggagcttttctccgttgactgtcagaagaaagtgactgttgttgaaaatgtttgctgcaactaaaggagagctgctaagatctactttctagttaaacaagcttttatatttctccccggctcctctcagttcccttgggaaatcaactaattgtgtgtgtaagctaagtgtgtggaggagagaagatgcaaaaaggaagagaaaggtggggaaagaaggaaattgggaacaattagacaaaaagactatagtttgaggccatcaggagtattctagtctgactgaagccaggcagaaggcacagtatctcttgtcctcctgggttttaagcagctgcaacaggaggaggaactgcggcttgtgtttacaaggccgaaatctgaagaaaaagcttccattcttttcccatcttgatatggagggttctccagaggaaaataaggaaatgagatattacatgcttcaaaggtaagtgttaggctaccacatttgggtaatatatatatctttaaaaaaacagtaaggtactgacagctaagccctgagatttatttgatcattttttttctatctttaaaaaatgaaggctattttttttaagaaaatgaataaaaatgggcatattggctcctgaatgtctaaacctttattttatattgggaatttgaataaaagatccctgagcccatgtgtgatattttagctacgttgaaaacaagcaccccatgcagaccctgctgtgctattatttcctgaagggaacctcagatgtatcagatttactccctggatttggctagtatttccagtgaagtctcttcaactgctgtaaaggaaagatattgtatagttttgcagaaaacttttttagaatgtgtgtctggggctaggaaaggtgcctgctgtaattgtggtatgtagtcagacagagttgttcaggatgccgaactccttcactttgggacctttcttattgccattagaactcaggctgaggaggaaatgagtcaggccttcttgggccttcttcaggcctcttgcaggtctgcacctccctgcagagaattgacataaaagacttgaatgatttgcttgtgcagtggcgcggtcatagctcacagtagccttgaactcttgggctcaagtgatcctcccacctcagcctcctgggtagctgggactacaggcatgcaccatcatgcctggctaatttttttttcaagttttttgtagagatggggtctcactgtgttgcccaggctagtctcaaactcctatactcaagcaattctgccactttggcctccagaagtgttggtattacaggccactgtgcctggcatccctccattatcttttttgtttgcttgtttttataatgtagagtttttattttgaagaaaattactgaaagttaaactaaacttaggcaaagacagaaaataaacaaaaaacactgagttggcaaaatctgtctttagatcatccttttccattcctttttttcccccaactgcctctgtaattgcccctttttcttttttaccacttcttccaccctttgaggggataaccaagcaaaacttccactgagaggcaaagaggtataaaagtaactacaatatagctgagtgcagtggcatgagcctgtagtaccagctactctgtaggctgaggccagaggattgcttgagcccagcagtttgaggttgcagggagatatattcctgccactgcactgcagcctggtcaacagtgagaacccatctctaaaaattttttttccaaagtaactgagatatatataatctatgtttgtgtatatatataatatagtatcaaaattttttatgtatatacatgtataaatatatatttcaaaaatgtatatataggctgggcacggtggtggcttatgcctgtaatcccagtactttgcgaggccaaggcgggtggatcacctgaggtcacgagtacgagaccagcctggccaacatggtgaaaccccgtctctactaaaaatacaaaaattagctgggcgtggtggcaggcacctgtagtctcatctacttgggaggccaaggcaggagaattgcttgatcgagcaaacccaggaggcagaatttgcagtgagcagagatcacgccatcacactccagtctgggtgacaagagcgaaactccatctcaaaaaaaaagtgtgtatatatatatatatacacacacatatacatacacaaacacacgcacatatatacatatatatgtacacacacgcatgtgtgtgtggtttttttttttttttctttcgagacagagtttcacttttgtcgcccatgctagagtgtgatggcgcgatcttggctcaccacaacctctgcctcccgggttcaagcgattcccctgcctcagcctcccgagtagctgggattacaggcatgcaccactatgccccgctaattttgtttttttagtagagatggggtttctccatgttggtcagactggtctcgaactctcgacctcaggtgatatgcccgccttggcctctcaaagtgctgggattacaggcgtgagccaccgcgcccggccttaaatgtgttttatatataacatagtttttatataaaaacctcatggctatacatatagaaataaaacgtgcatatatatctctataagtatatattgatatatagtgtctgaatgtgtctttgccaaaatttatatgttgaggctgggcacggtggctcatgtctgtaacctcagcactttgggaggccgaggcgggcagatcacctgaggccaggagttcgagaccagcctgggcaacatggcgaaactccatctctactaaaaatacaaaaattagccgggtgtggtggtaggatcctgtaatcccagctactcaggtggttgaggcacgagaattgcttgaacctgggagatggaggttgcagtgacctgacattgtgctactgtactccagcctgggctacagagcgagactctgcctcacacacacacaaaatgtatatgttgaaatctaattaccactatgtcaagaagtggggcctttgggagttgagtagatcatggggcagagccctcatgaatgggattagtgcccttataaaataggctccaggcgaggcatggtggctcatgcctgtaatcccagcactttgggaggccgaggcaggcggatcatgaggtcaggagatcgagaccatcctggctaacatggtgaaaccccatctctactaaaaatacaaaaaattagccgggcgtggtggcgggcgcctctagtcccagctactctggaggctgagggaggagaatggtgtgaacccaggaggcagagcttgcagtgagccgagatctcaccactgcactccagactgggagagagagcgagactctgtctcaaaaaaaaaaaaaaaaaaaaaggctccaaagatctgcctttccccttccactctgtgaggacacaatgagaatcatgcaagcgagtaggacctggaggcagggaacccaagaactttctagaactaaatcaaatggaaacaagcacttcagttatgacaggaagcatcctcttcctttacataggatatacactgaataaatgactttgtaacttcatcatctttatttacacagggtgtataccaagtaacaatggaaatctctagagggtatttaaaccccagaaaattctgtaaccagacccttgagtggctggcttgcttgggccagctcccaacctgtagagtgtgctttcattttcttttttttattttttattttaattttttgattttttgaaatggagtctcgccctttagcccaggctggagtgcagtggtgcgatcttggctcattgaaacctttgcctcccgggttcaagcaattctcatgcctcagcctcccgagtagctgggactataggtgcccaccaccacgcccagctaattttttgtattttttagtagagatggggtttcactgtgttagccaggatggtcttgatctcctgacctcgtgatccacccgcctcagcctcccaatgtgttgggattacaggtgtgagccaccgtgcctggcctaatttttgtatttttagtagagacaacgtttcaacatgttggctaggctggtctcgaactcctgacctcatgttatccccccacatttacctcccaaagtgctggaattacagacatgagccactgtgcctggccgtgtgctttcattttcagttaagtctctgcttttgttgctttattctttccctgctttgtttgtgtgttttgttcaattctttgttcaaaacaccaagaacttgtacagcctccactggtaacatattttggcaagccagccaggaggtaatcccaaagtttggggtttatttttcttgtttgtttttcctgctccatacaggggaatctcagtctctctctctcttttcctttccaacttgggacggttggtgggcagcacctaaacacagaggcaactgcaggtttctggccggggccactctgaaggactcctttctatcttttccagttgtggtccctgatccctacgtgtggcacagcttggggcgagctggcatttgtttcagtgacttaaaccttgttttctcatgctaaattcttcccttcccctactctactggctaaggacaaaagaaacccacccagcctccagttcctatcattacagttcatggctatcactctagtggaacaggaagcatgggaaagtgtggccttatcaaattataaggatgccagaagtccaggccttcatccagggacaaaaggaaacctcatagtaggccattgcctctgaagggaaaacatgctaagcagcaccagtgcccacctaaggtcagagacgtctgacactctgagactggaccccaaagggggacggcccagggatcctccagacctcaacttctccaaaggggacaccctaggcagagttctgaggtctagtattaagccctccttagaattttctctcgcagttgcaatactgtttggcccaatattgtttggaatctggagcttgctgttgaatgggaaagtgggatggagttgcatgtgtcaaactgctgtggaaactgctatatctgaaattttggttcacagccttcattggattatctgttggggcaaacaaaggaaaaccccccaagcttgtattgctatctcatgccttaagattcccagttaaaagcgattgaatcttcgtttgtgtgcgtctatacatgtctagatgtgtttatttgtatgcacacttattgttacatgttgtgtctaccaaattggcttataaataaaagagcacttaaaaattaagtaaataagtctaagcaattttcaagttcacgtgacttaagtataactttactaaacaagctggctttaaaattattagtaaaataaaactagaaatgccttcagaattgtcagaatacattctttgtctggattttatatttgtctctgctaaatattttgagatgtcaatgtttggcatagaaggttataaaactactaacttagcccatacaaaatgatcttggtttgtgtgcccttttttttttcaacgaatgagagtaacttaatgttgttaactaagtcttctgagttattggcaaaaaaaaataccagtgtatttacctttaaggctgttacttaggtttaggtgagcaccttatgttcgctggctattaaaaacatggttagcaaggaaataactaactttaaatgatagtgtctgatatctctgtttatagaagttatctaaataaaccgttaaacatgaaagaattgagtacagtgaatgggataaatgttttaggtaatctttttgtgtaaattaaaatcttggccaggcgtggtggctcatgcctataatcccagcactttggaaggccaaggagggtggatcacccgaggtcaggagttcgagaccagcctggccagtggcgaaaccccatctctactgaaaatataaaaactagctgggcatggtggtgtgtgcctgtaatcccagctactggggggctgaggctggagaattgcttgaacctgggaagaggaggttacagtgagttgagattacaccactacactccagcctgggggacagagcaagactctgtcacaaaaaaaaaaaaaaaaaaaaaagtcctaaaattatttttgatgctcattgaatatctgggtcagttccaattaagaaaaggttgtgacatggggaaatatgtttctacaaattgtggaattgttcttatctataatgcttttatctctgatggttcaggatttcttgctttttcgggtttcattgaagttttaggttactaaggataagaattctagttaacacataattctatatacaaaatgtgccagaaagtgttgtgtgattagtgagaaaaaataataattttgtctaattcggaagttttctaaaagttagttcaaattacagatttgaaaaggttatttatgaaacaatgtagtaaggaaccggtaaggaggggagaaagacgtggaaaagtttagataataaaatattgcttaaaacctgatagagaactggagaaatttggctaattaacattttcatagttaaagttcttagtcttgattaaagtaaaaataagtattgtaaaaaaaaatgtgtcggcagtttgccagtttttttaatatatagttaagcatgaagccggatttagtgtggagccaaatttcacatatgtgcttgcattgcttcacactttgtttcctgttttgcacgggtagtgccggcactgaagtacttattggtcatttgcctagagtcaatttctttttttttgagactaagtcttgctctgttgcctaggctggagtgcagtggtgcgctctcagctcactgcaacctctgcctcccagattcaagcgattctcctgtctcagcttcccaggtagctgggactacaggcacacaccaccacgcccagctaatttttgtttttgttttttttaagtagagatgtggttttgccatgttggcaaggctggccttgaattcctggcctcaagccatcctctcaccttggcctcccgaagtgctgggattacagatgtgagccaccgcacctggcctttcttaaactctttatccttttttattctcttcttttcattttgaaatctttcaggatgatgcacagaaaaatgcttatgtttaaagtctgatctttcttttaacttgcttatagaatgccttttttttgttaacttctggctttcccttgagaggactttatatactttgccctgtttagaaagttccaaggggaatcaaagcttgtttttctcaagatgctttgagaatttcatagcagcataatggcagcaagggtaaaccttgaaagactatcattacaaagtctaactgtttaatgctttttaactggtaagtttagtgtttgccccttactgctttacttagcaagttgaaactatattcacaaaacaaaatcatacaaatttacatgatgttatacagttatatagagctctacaaatgctcgtatcaccctctttaaaattacctattatcccttaggccattgaacaggtaacacatttccgcaagggtagttcagctttgcttactagatgcataagcacatttttaattgaatatatgacattcatactatgttttgtgcaaagttaaaaaattacttcttagagcagtcaaattaacattctagtatcttcacatttttacagtttcaatgaaaaaaaaaattctcctaaaaggcactgccttttactcttgccctttccttcatgtttaattttatcttaattttttgataactataagactacatttatttagtatatgtcatctcagattagtataatcgtatcagtcatttatttaataacatcatcaggtgttctttcagttcttgagagaattgagatttgtaatggttagtatgactggcatgtatttggggcttatatgtaaacattggaagacatgggcagcaaagatctaagaaatttgttctccaaaaactgttttaaagaaacatcacctggtatttgctctaaagtaagctcgtccaaatcactgcccatggactgcatgtagcccaggacagctttggatgaggcccaacacagctttggatgaggcccaacacaaattcataaacttgcttaaaatattatgagatttttgaccaggtgcggtggctcacacctgtaattccagcactttgggaggctgaggcgggtggatcacctgaggttgggagctcgagaccagcctgaccaacatagagaaaccccatctctactaaaaacacaaaattagccgggcatggtggcgcatgcctgtaatcccagctactcgggaaggctgaggcaggagaatcgcttgaacccaggaggtggaggttgcggtgagctgagattgcaccattgtactccagcctgggcaacaagagcgaaactccatctcaaaacaaaaacaaaaacaaatattatgagatgtgtgtgtgtgtgtgtgtgtgtgtgtgtgtgtgtgtgtgtatgtgtttttcatcagctatcattagtgttagtgtgtttctttttcttttttttttttttttttgagacagagtcttgctctgttgccaggctggagtgtagtggcgtgatctcggctcactgcaacctctacctcccaggttcaagtgattctcctgcctcagcttcccaagtagctgggactacaggcacacgccaccacgcccgactaattttttgtatttttattagagatggggtttcaccttgttggccaggatggccttgatatcttgacctcgtggtccacctacctcagcctcccaaagtgctggaattcaggcaagagccactgtgcccgccagtgttagcgtattttatacgtggcccaagacaattcttcttccagtgtggcccagggaagcaaaaagattggatacccctgctctaaaaacataattatttacatggatatacagtgaataattaactgtgactatattcagtgcaggttaacttgaggcagtattgtagggtatcaagttcaaggacttagagtcagaaaggttgaattcagatctgttttgttacttctggctgtgtgaatgatcatgggcaagttacctaatccctctgagcctcacttgtaaaatggtgctcaaacatcatagcattattgcgaggattaatatgccagtgcatgtgaagagcttagcatagtgtctgtcccatagcgagtactcagaaatagtgttattttgtgtagttgtcaataattaataaataataatcaccattcaaaaatgtttgagcaggctaggtatggtggctcacacttgtaatcccagcattttggaaggctgaggcaggcagatcacttgagaccaggaagttgagaccagcctggccaacatggtgaaaccccgtctgtgctaaaaatagaaaaaattagtcgagcgtggtggcacatgcctgtaattccagctacttgggaggctgaggcacaagaatcgcttgaacctgggaggcggaggttgcaataagccgagattggaccactgcactccagcctgggtgacagagtgagactctgtctaaaaaaaaaacccaaagatgtttgaacagcttctatctgtgccaggtaccctttggtgctggagatacagcaataaataagaatctctgacctcaagggatgaataagagtatctgacctcaaggaacacacactatttatcagggaaaacagatgtgttaagctcatgtaacagtccagtgtgattgggaggaaagatgtaagtgcatgttctggtgtggcacagaggaagctcagttacctacctccttaaggggtgaagttggaaggatccccatcagcaaaggctcactgggagcactgacagtttagttgcattttgaagaatgaattggagtagtactgacaaaaatactataatgcagtggtggattcctgttgttgagaaagccaagctgtaatagagtagattatattactgccggagagcacatggtattggttaggtatctaaatgtatatggggtaatggaaaaatggaagttcctaagaagatcagtcctagtttgcattttgattgacatttttgtatcctcagactttgaaatactcgtgggatatgaagtggaggtgcctagagggttgaagataatgaggacagatgaagaaatgtttgattgtgccatacttacagttgctgattttcaaggtgtgggtacttccttagccttattctctgtgttacctttcaataccattagtaacagttctttaaaagccaactttactgaggaataatttacagccagatatacctgttttatgtggacagttaaatgatttttttgttttttgttttttttttgagatggagtctaactctgtcacccaggctagagtgcagtggcgtgatcttggctcactgcaacctctgtctcctgggttcaagcgattctcctgctcagcctcccaagtagctgggactacaggcgcctgccaccacgtctggctaatttttgtaattttagtagagacggggtttcaccatattggttaggctggtctcgaactcctgacctcaagtgatccatccgcctcagcctcccaaagtgctgggattacaggcgggagccaccatgcctggcaggtaaatgagtattttcaaaagtcaggtttgttgaggtataatttaagtacagtaaagtttaccctttttttttggtggagcgggggcaggatctcactctgtcacctaggctggagtgcagtggtgtgatcatagcttactgcagcctagtcttcctggctcaagtgattctcccacctcagcctcctaagtagctgggactataggcgtgtgccaccaaggccggctaattttttgatttttttgtatagatgagctctttctatgttgcccaggctggtcttgaactcctgggctcaagcaatccttctgccttgccctcccagagtgctgggtttacacgtgtgaaccaatgtaccaggccaagttcaccttttaaaattatgtagtttgatggttttaacacatatatctacccatgtaaccattactatgagatcaagatatagaacgtttccatcattcccatactcccttgcagtcggttcccacagccccagcccactgattcgtgttctgcactgtagattagttatccttgtcatataaatggagtcatatggtatatacttttttgtgtctggtttccttctctgaacatgaggtttttgagattcattcatgttattgctcagtctgatacactgataatgatccatggacttggggcccaaaagaaataggttcatgacaaagttaaggacaggaaggtaatttttatttatttaaaaatacatgcaataataaaaaaattaaaaagaatgtatgaaagaaaaatgaagtgattaaaaaaatgaaacaaaacatgtacactggcactgtttttagacctctggtgtttattatcattagatatgttgcatagtgtaattggaagaacattgaaatgaccatgaaacctggttttctggtctatatatgctacagacttcctttgtgaccttagacaaatcattctccttgtgggcctctttttctataaggtgcctcttaactttaaagttccagtccagatgcagtataactaaatacctggatagaaaaggatgaagaaaattttaatagattgaccagcttgaaatgtcagtctctaagaagggtacagagcattttatattgagtgccaacagcagagtgcatagcctttgttatgtctgtccttaagtctagtaggcaaagtagctgctagactctgaactgtcccttcttgtttttttttttttgtctttttgtttttgagacagagtctcgctctgtcgcccaggctggagggcagtggcttgatctctgctcactgcaacctccgccccctgggttcaagtgattctcccacctcagcctcctgagtagctgggattacagacgtgcaccaccatgcctggatatttggtttttttttttttttttttttagtagagacgtggtttcgccatgttggccaagctggtctagaactcctggcctcaagtgatccgcctgccttggcctcccaaagtgctgggattacaggtgtgagccaccatgcctggccttgtcccttcttgttatactcccgtaggtggtggttttgcaagttaagagccacactaagtcatgtgaagtatagggaaaatgcccactcattgagttttatgcatagagacactcagagaagaaagaaagactggtcttatttatgtatgtatatgtaaaactatatgtgcacagaaagctagatattgtgctgcatgtgggaagattttaatcataccttcttattttgaaaagacaccttactgccccatcaagtttaaattgtaggggaagggaagaaaaggtgggaataggaaaagaaaacagctgtctatcaaacggtgtacaaaggagcttatgtccactatcttatttaatcctctgaacactcttttggagggtctatcagtcaaggtgcagtcacaaggaaaataaattgtagtaggtgttataaacagagaacattcaatagcgagaattgcataattgggtgttagaagaataaaagaacaacaacaaaaaaggcatgctgaggtaccccagagttaataactagaggaagtagctatcacctctaagtctgggagaacaaaaggggaggtagtgttaccagaactaggagcttggtggagatctcctggagggctggtgcctggacctctgggcataagctttgggtagctggtactcagatccttggcctgacaggtgattgataggcccaggcagtgaggtccagaggatgagtgagcatggcaaggttgatattctgactgccaaagagccacaacccactgctgctggtacctctatggcttttcaccagactgttgaaagaagctagagactggaattaagtttctgttacagctggagcaatactgataacagctgggaaataggaaggaaggcccttttcttacctttctgccttccggtttggtgaacagaacaggaaggagctagcaaaggagtcttggaaatgaagtttgcagaatcttggccccattgtcacagagcacagcataaaagggtaggtttggagctgagagacaataggtaaataaccaggacagtaaatatcatgcatattttacaaagagaacactgaagctgaaaaggttaaattatttgcaaaagatcatttaagtggacagatctggaatgtaaacccaggcctgtgctgtttccactatcatattttgtctaatccaaggtgccattgattgttagaaacactgttattttatgtaccactaagaaaaaatacagtactgccagccaggcgcggtggctcatgcctgtaatcacaacactttggaaggccgaggtgggcggatcacctgaggtcaggagttcgagaccagcctggtcaacatggcgaaaccttgtctctactaaaaatacaaaaattagccaggtgtggtggcgcgcctacagtctcagctactctgcaggctgaggcaggagcatcgcttgaacctgggagtcgaaggttgtagtgagttgagatctggccagtgcattccaacctgggcgacagagtgagactctggctcaaaacaacaacaaaaacagtactgccaatttaataaggcatcaattgtaaaatacataccaatttcagattttttttttgagacacccatctcattctgttacccaggctagagtgcagtagcatgactatgacttactgcagcctcaaccacacgtgcccaagcaatttatctgcctcagctgcgccccccaccccccaccccaagtaactggggctacaggaacacacgactgtgccagctaatttttgtattttttttatagacagggttttgccatgttgcctaggctggtctcgaattcctggtctcaagccatcctctcatctcagcctcccaaagtgctgggattacaggcatgagccactgcacccggcctaggagatttttttaaagtaaaaagaaaagaagtagaaccttaaaactgattaaatatggcatattatgctgccttgtaaagaattttgttttggagttgttgattttgaaatacctaggagatacccaggtaaaacatttagtaggcagttttaaaatgtggagttatagctcagaagaaagatagaagtcagagatacagaggtgaaggtcatctgcacaccagagtcgtgatccagaaacaaccctggtaacttgttttttggctttaacggtctctgagtctattatttctaccatttatcctttgcctatctctttgtgatggcatctgctggtaaaccttgatattatcttttattattcagaaacgcttttttttccttaaatttccacaagcaagatcattttcttttctctcttttatttgaaaagtacgtgacctgccagcatgcagtcttcacaggatgcagttgtgaaagtactgttatgggtatggtagtgaaaagcaggtctccagaaaatataggtggtgtttttatggcttctgtatttttataggtccagcatgtctggcttgcacctagtaaagcagggccgagacagaaagaaaatagattctcaacgagatttcactgtggcttctccagcagaatttgttactcgctttgggggaaataaagtgattgagaaggtaagttgtaacttgctgaattattttgtcaaaagcacttaggatttaatgcttgcctagatttgttgtctagatttgctcccaattgatatttagtttctcagaggctttgcctctttatgtgaattttagcctttctgcctccctagcatcctattaatataatttcactgttttcctataatatgtatttaccacagataatttaatcatagctaattaaggagttaaaatagtgctcataaagttatttttgagtcccagcaacttggggggctaaaatggaaggatcacttgagcccaggagttcaaggttgcagtgagctatggattgtgccactgcactccaacgtgggcgacagagggaccctgtctcaaacaaaacatgtttttgaaagatcttgtggttttacagggtggggctgcactgatctgacagggtatgaagaattgattagcttgtgggtgctggtggggagataatatgccacagcactggtttgaaagctaagggagtagagagagtttcagaagagaaggcttaaagagtttgatacactgtgacttactggcttccaccaagtatttgagatgtttcaagggaatataccacatgatatacttagagattccaggtattttgaaatgtaattccgtgtcacttttgtctaaaccatgtcagagctgagaggatgacttggctgaaatagcttccagtgattaaaagattaaaggatggggacctgtatttccactcctaaaagtattacttcatcagcatccttttattagtcttccaataaagacagattatgtgtctattagtctgtgttatccttagaggcatgactgcaagataggtaaggagacgaaaggtttgtttacagaaagtctcaggattattctatttttctacaacagtgaccattctttctgaggcattctctacaattctaaggtattggagttcagtattttggagaaaagtaactaataccagggtttttaaacatgttcagtgctctgtacctcattttattgcaacagagaagagtgcatggcactgcactggttggccttcccccattcctgatttcataatataccatacccacaatatggtagtatggtagaataattcacaaagtcacagatttaagtaattgtgacttttcccttcaaataaatgaagttagaaaggagtatgttttagctggcacatactcaagtatttgcttagttaacatttaaagatactgcttggccttggggaagccagtttctaacagtctggaccagtaacaagaattcttggttgaaagtatgacttttacacagaaagatagatatgtaaaaattctctcatctcttttcctccattgttgcttttttctgccttttcttcccattcccatctccttccccctcccaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcaggtgagttattagcattatgaaagcatcactctcaaaactaaaacatggaacagcacagcctttaagtaggagaatgttaacttagggggattcccaaacataggacttccaagtaaaatccttttaaaataatttctgtttaaaatgtgtcagtaatagacatataaaaatgattgcactatagtcaacctcgatacagattcctgtgtcctagggataagtaggaagaaatttaacaaaagtgttgatttgggctttcaagtgtatgcctttttcagtgttaaatatttgctatgccacattctttggaatgcgtaagtggaaagatttagaaggaaatgctgttttttccttatgcgttatattgaattatagaaaaactttgggttaagattttttttttctcttcctgagggagagaccttttgggaccgaagtgtgtttcactctgtaaattcggctacatattctttttactcagatggttctctgtctgatagttgtagataaagactgttggtatagctgaaagatatgactagtctttcttctccataccttctatcactaaggtataatctcttaaggtagagtacccacagataatgtgaagagctatgtttttttacttttttttatcttttactcctaggaagctgcgaaaaagagctatccttttatacttattttagtctgcatatgttttttctttgttgagacaatggtattatgattattcctaagaaagaaaggttattatatcatcttatttagaaattgagaagacaccaatttattagaaagcaaatgttatatattagatcattcttgcattgctataaagaaatacctgaggctgcgtaatttgtaaagaaaagaggtttaattggctcacaattctacaggctttacaggaagcatggtgctggcatctgctctgcttctggggaggcctcaggacacttactgggggaagatgaagggggagtaggcacatcacatagccagagcaggaacaacacagagaattgtggggagggtgccacacacttttaaacaaccagatctcatgtgaacttagagtgagaactcacgtatcatcaaggagatggcccaagccattcatgagggagctgccctcatgatccaaacacctcctaccaggccccatttccgagactggggattacaattcaatatgatatttggtgagggacatacattcaaactatatcatgttattatatgaaatcatttagatgcacactttcacatctctgagccacaagtttcatacttataaaaggaagatcctaatgtctaattcactggataattgtaaagatgagatcatctataataaatacagattaacttgcgtggtttttttcttttttcttttgagagggagtcttgctgtgtcaccaggctgcagtgcagtggtgcaaactcagctcactgcaacctccgcctcctgggttcatgcaattcttctgtctcagcctcccaagtagctgggactacaggtgtgtgccaccatgcccagctaatttttgtatttttagtacagacagggtttcaccatgttggccaggatggtctcggtatcttgaccttgtgatccacctgcctcggcctcccaaagtactaggattacaggtgtaagccactgcgcccggtccggtttctttttcctcattcatttctacctggtactccaattaattcatttattcattcacttaacatggagactgacagttgaataagatgtgatcttgttctaggaaacaaatgatttcaatacaatgaggtaagtgctataaaagaaacatgcacagggtccggtgagaacacagagatgagacatctaattcttgggggcaggcttaagagaaagctttcttaggctgagtgtggtggctcatgcctgtaatcccagcactttgggatgctcaagcgggtggatcacttgaggtcaggagtttgggaccagcctggtcaacatgatgaaaccccatctctactaaaaatacaaaaatgagctgggcatggtgctggtgcccgtaaatccagctactcggaagctgaggcaggagaatcgcatgaacccaggaggaggaggttgtggtgagctgagatcgtgccactgcattccagcctgggccacaaagcgagactcagtctcaatgaaaaaaaaaaaaaaaaagagagaaagacagctttctgaaagagattatgtctaaccaagaatgagtaagagttagtgaagcaattggggggagagaaaggtgtaccagacagaaagaacagcattgcaaatgcataaaggtatgacacaagtggttttctagaaattacggatggctacaagatgtgatgtagtatttgccaagggggaccttgttttccatcctcaaaagcacagactttgtcttttaaggagagtatgtgtgtgtgttggacatctaaggatttgcattttaaatgaatgtgttttttggggtgtgtgtgtgtgtgtgtgtgtgtgtgtgtgtgtgtgttaactatgtaaaagttgaagagtataatgaatcccttcccatctacctgtcatgcaatatcaataattatcaacttatggcgaatctagtttcatctatattcttaaccccgtgcacaattattttgatgcaaatccttgataccatattattcttcatgttatctgtgaagatactctaccttaagattaagagattataccttattgataaaaagcatggagggccaggcatggtggtttacgcctgtaatctcagcactttgggaggccaaggcaggcggatcacttgaacccaggagttcaaggtcagcctggaccatgtggtgaaattgtctctacaaaaaatgcaaaaattagctgggcatagaggcgcatgccggtagtctcagctactccggaggctgaggtgggagaatcactttagcccgggaggtcgaggtcgcagtgagccatgaccatgccactgcattccagtctgggtgtcagagtgagatctggtctcaaaaacaaacaaacaaacaaaaaagaaatctaaaccaaaacaatactaaagatttttttttaacttacaaaactcacaaaattgaagacattgataatacctaacataggtgagagtatttggtacccatgttgctagtgagagtctgaaaatgtgaataccttttgacccaatagttttattgctagtaacatatctgtggatataattggacagccgtacagagacacacattattttattatttttcaaattatacataatctgtacttccattgataagttagtagtcaaatgaattatataggctattgaaatattaggtatccataaaaaatattaaacatatatataccaaaaatatatatatttatgtacagtaaagcataaactggttgtctttgaggtgggacaataggtgagagtctcactctgtcccccaggctggagtgcagtggcgcaatctcggctcactgcaacctctgcctcctgggttcaagcgactctcatgcctcagcctcccgagtggctgggattacaggtgcccaccaccaggcccagctaattttttttttttttttttagacggagtcttgctctgtcacccaggttggtgcagtggcgtgatctcagcttactgcaacctctgcctcccaggttcaagcgattctcctgcctcagcctccctcagcctcactctgtctgtggtgggactacaggcttgtgccaccatccccggctaattttttgtatttttagtagagatggggtttcaccatgttagccaggatggtctccatctcctgacctcgtgatccgcccacctcagcctcccaaaatgctaggattacaggcgtgagccactgcgcctggccaattttcacttttaaaatatagtattgttatattctgttgtattatctaacattgtttaataatttgcatgctttccttcctataatcaaagagaacaataagcctattttaattttgaagaaattctagcggaattttttttagtagaattttttttagaagggacttaaaatcttttagaaataagaacaagataatcaccattctgactggcatgagatgatatctcattatggttttgatttgcatttctctaatgatcactgatgttgaggttttttttaaaatatgtttgttggccgcataaatgtcttcttttgagaagtgtctgtctgttcctgtcctttaccagtgcatgtggggcttaatacctaggtgatgggttgataggtacagcaaaccaccatggcacacgtttacctatgtaacaaacctggatgtcctgcacatgtatcctggaacttacatttttaaaaaagaacaagataaaataaatttattattagtaaataatggtggatgcttgagttgaaatttgaaagctaaaataaatttataaatggtggaaatgaactttgaggaagttacttaactcctccaagccatcattttctgtcacatattgggttgatgagagaattaaatgagataatatatatacaaagtgctagttacagtccctacacgtggtagctcttctgttacaggtgtcattgccagaataggaaaatagagatgttaggtgacaaatttgaaagggaatactgtacaacaaatatatatgagaaagtggttatctttctaaagtttcttacaaatacctgttaccctcagtattccagataaactctttccagacactcctgtaactaacctttcttgtttagccagtttgcaagccattcaggctctcctatctttctccattctgtcaagctctgtaccaggaaaagggctttctctaggtccagtaccagttaaagacaaaggatgtcaggactagaactttttctcggaatagagtaattgcacttgggcccctaactgacagacacatcagccttgatatagaagtcataaagattcctcagaaagattacatagtgaaatgttggagaattgctattttactataagagcttctaaatatgggattaactcgtattagtgcttgtgacttaacaaactaagagcctcgaactaaatggtcctggaaattatcctactaatgctgtttgtcctgtggttacttatgatagtccctgacctttacgtagttttgctgtgcaattatatttctggaaaaaaaaatcatgtgttctctattaattcgcttgcattttcagaatacattaagatggcagatcactatgtgccagtgcctggaggaccaaacaacaacaactatgcaaatgtggaattaattcttgatattgctaaaaggatcccagtacaagtaagagatgccaatgtgtcctttaaaaccaaattcagccattttatagttaggcacaaggggatatctagagaagaacatttttgtaaagcatcattttcgaaaattattaaatgcctgtgtatgggataactaaaccaaataaggaaaagaaagatggaaataatggaatggctaaaaataaagtaaacgtaatacaaacagaaggtttggaagcatctttcagagattatttattctaggtatctcacctttgagccagtaaaaattacctgtttgttgtggaatattagcctaaaggatggtggtatattaaagaagtaggctgtttcttccctgtcacattgtgttagtaagtttagggtaggtaccttaaagcccaaagaggaaaaaactctaaacttagatggcagtgtaatcaataatgatgtaatggcgtggccatagtaattgaatatgtgaaacatagccagtttttctagaaaacgccctttacagcctaggctatgaattgagtttcctaaagagcaacaagtataactggatcttaatatcaatttcaacttggttttgaccccttcagaaatcttgccacaatggactacttattgttactctgtaaagagtttgccaacaatcaagcatagaagctgaattaagcattaggctgctgtggaactactgtacctcaagaaacagggccagcctggatagagactcttgcagtttgtgggggttttgtatgaattttaagaatgaattatattgtattcccttgcaggcagtgtgggctggctggggtcatgcttctgagaatcccaaactaccggaacttctcttgaaaaatggcattgccttcatgggtaagctgttctgacatattgtccgtctttctgtttctttctgtcaattttgcccacattttactctatagtctgattttctgtttaacatgtgctgggctctctctctctttttttttccctcaatctattactaactctcagagtaaccctcttcatttctttcttttttttcattttttgcttatctcacttcatcttgattttgttttctgtccctgggtcagatatggagatatggagaaggctttggtttctaaaactctgaccttttaaaactttgcagctaaccttaagaaagcatgtgggaaaatgacctgtttttagatagtgaagataattgaatactcaggatgccttggcagtgtgcccttaaatatgaatcagcacctgtgcatttaagcatataggtgatactcctacaagtgagagatacttcttctgacttttctgctgtcattataccagagagaaaaacagaggttatatagctcaaagtatttttctctctgtctcagagaccttaaacaatgaagattatgttttgtaaacctttttaaagatgtctcctttttgggttcccctaagaccaaagagcgtatactatttcagacttgaatcctaaaactttaaagtccttatttcaggatattgacttaaaaaagaagactttattgatctggtgaagttggatcatgaagaatgataacattatagctagatttgtcaaaaatttaattcagcatacatttatatatattgagctctcactctgcacaaaaagcttactacattaggttttacagatggtacaaagataagtcaaagcataatagtccccataatttatgatctccttgatatgtgaggggtggggggaggacaagacaaatacataaatagctataatacaaggcaactacatgtgccagaaatgaggccaaggggttacagtcaggattcttttcctgtttcgtttttaggtcctccaagccaggccatgtgggctttaggggataagattgcatcttccatagtggctcaaactgcaggtatcccaactcttccctggagcggcagtggtaagaactgaattcttgtttgtatcttgaagtacagaatagctcagtaggatatttgggacttacctcttttgaaaaagtattggtatacttgacaagaaatggaatactggttgattaatggtaccttgtagctcctagcttaattaatacacctgtgattcttttagtaatataaatttagttccaggtacacagatgctaaattgtgatctggagtgatcttgtgagttaacttagaaaaactctgggaaaacatatatatggttttgtgggtttagatgtactctgggtaggctagaatcttcctcagaggtgggcttcccagggggaattgggtcttcagacctgcctgggagtagcctggatcactaggaaaaacctaaaacccacttactcaaatgtttccttgccaatgttttttttctttttttttctttttttttttttttttttgagttggagtctcactctgttgcccaggctggagtgcagtggcatgatcttggcttactgcatcctccaccttccgggttcaagcaattctctgcctcagcctcccgagtagctgggattacaggcacccgccaccacacccggctaatttttgtatttttttgtagagacaggctttcaccatcttggccaggctggtgttgaactcctgaccttgtgatctacctgccttggcctcccaaagtgctgggattacaggcatgagccaccgcgcctggcgccaatgttttcttgatatcaacccacaatctattgatgatttgatttgactgtttaaaaaccattcaacctcagttgcccttgatgcagaaaatgaggtcagtaattaacctttcttccaggcatgccagaggggcaagaattttcaaaaagtgatttattctcaacacatcccttaaacagttccatgtgaattattatagctgataacaatatgaaccttttttttttttttcttaagtactcaagcactgggaacagacatacactaaaacctcttttaaatgggaatgaccactgtcttgaggctgaacagatttgaacccttgttactctggctctccagggagattgcaatatcctctccagatctgctgggtcaaatagtttaaaataaaaggttgaatttgttcttgtttgaatggagaggctatagtgttccccttatggctgagtacagggacgttcagagagcatggaatcatgactctgctgaggccaataaaaccgccatttctatttccaagggctcataaagattgaattatttcccagacctcttggccctggagcaggcctgaacacacagtttgaaggtattttgcctgctgagttgctgtgagaagtatgctatgttctttttttgtttgttttgatcttgtacgtctttgcatttttataagttgctccctgttagttcggctggcttttgccagcgttaagaacccaagttgccgggtcatgctgtggctaaatcctgttaaccccaaggactgatcagggttttatggcatccttctttctcccatccactctcagttttgggtaaatatgatagcatttcaaagaatgcagagcagaaaattgacaagagcagaagatcttgtaattgccctaagttgctattgtctgttgcaggtcttcgtgtggactggcaggaaaatgatttttcaaaacgtatcttaaatgttccccaggagctatatgaaaaaggttatgtgaaagatgtggatgatgggctacaggtaggttactaactccagggagtgatacctttcagctgaccagttatagtcacaaatgtggagattgggagcctggctcgtgatatatacccaaggtggtgttagggatgtaagaccaggaggtgtagtttgaaagtatagaatacgctggtttctctttagattgcataagtcttttgcctttaaaaagtacagattgaggaagtgactttaaatgtaaacaatctaaattcattttgaagcaggctgctcatctggacagaacatttcttaggtgattaagtcagagttttaaggaggtgctgattctctctctctctaccacctgttagtgtgtgagggcggggacaacaaacaacatactttttctactggttgaattcagaaccaagaagccaggaagcagagatcaaacagtcagctttattatgaacagagatgttgatgaaaatggcttaagtgtgtagcaacattcagatttgtaaactaaacaccagagttaagcaggctcactcacccactggttactggcagtgctgaatgaccacagatttccctcgacagagagagagagcttaattcagcttagtgtatggctgagagctgacaaagagcatatgtcctgtgcagtgggctgatcccaaaggggaaaaggctgagctatgcatattcagtccctccttccaagttgaccaatcacataatttattatttttcccttggggaggagcaagggagtgaaccaagaaagactgaaagtgttactcttaattattgtctatccatgtagaaatgtgaacctaggcaaaaggagatcctttccccaacattaccttttctttccttacagttccctccaatttgttcccctttcacttttataaatagtttaaagtgttggttatgcttccaggtataatgaaagataatgaaagaggctattgtagaaaaatacactgcttgagtttgacttgtgtcatgtaaattcaagagggatgctgaatgttcaaataattttgttgtattgtttgcattttaagttaaacatcctgtaatctccttaataagaagaattaatatttctaattgaatttcaaatgctttattttgtttgttataatttgcaaaagagtagaagctctttgtaaggaactagctattctagctattttgcttatcgactaacattcttttttattttttctggttataattataaacagcattttctggtagaaaatttgaaaagccaaagatgatgataaagccacatgcaaacacaccatccaaagataatgcccattaacctattcatttttttatcccttttcaactcatagatttatatcatatacaaatctttattaatagattcctatacttataattatgataattataagttttgggtcttactatttgtattgtgttggtaatcataatacttttttctacttaatatttttttgtccttctacctccccgctccttacttaacattatattaaagtgttaaaattcttccaaaatatttttaatgggtgacctgtgactaaagctttcatatatttttaaaaggcctaccttcttacttactgacctcctatgggatacccccttttttttttaagtctttctcttttttttaagctatctctttgatcatctatcactcagcaattgagttcatcatactaattctgtttatatgagcatagaaaagaataaagaaacattagaaaaggtgagactgtgcataaaagattttcattcattaagtaatcgattgacatagattaaaaattgaaatgttctttttctgggtgatacttattttattttatttttttgggttggagtctcactctgttgcccaggctggagtacagtgatgccatcttggctcaccgcaacctccacttcccagattcaagtgattctcctgcctcagcctccaagtggctgtgattacaggttaccgccaccatgcccagctaatttttgtatttttagtgcagacagggtttcaccaagttgggctggctggtctccaactcctgacctcaagtgatccacccactttggcctcccaaagtgctgggattacaggtgtgaagcactgggccaggcctggtgatacattttaaagatattcttataatgtagcaaaaccttaaaagactggaatattttgacaaaggaatgacttggttattttattgaaacagggtctcactttgttgcccaagctggaatgcattggcacgatcttggctcattgcaacctttgcctctcaggttcaagcaattctcgtgccgcagcctcccgagtagctgggattataggcatgcagtaccacgcccagctaattttttgtatttttaatagggccaggggtttcaccatgttggccaggctggtctcgaactcctgacctcaggtgatccacctgcctcagcctctcaaagtgttgggattacaggcacgagccactacgcccaaccccacttcagcttattttaagtgaactccttatgtcttttttttttttaattgtaatacatgtatgcctgcatactataagcaagaaattccaataatgcagaaatacatacagtgaaaaaggaaagttttatatccacgcatctttctttgttttttgtttttgttttttttgagatggagtttcgctcttgttgcccaggctggagtgcaatggcgtgatcttggctcactgcaacctccacctcccaggttcaagcgattctcctgcctcagcctcccaagtagctgggattacaggcatgcgccatcacacccagctaattttgtatttttagtagagacggggtttctccatgttggtcaggctggtcttgaactcccgacctcaggtgatccgcccgccttggcctcccaaagtgctgtgattacaggcgttagccactgtgcccggacccattcttttctaaatcattgctggtatgtactctggacttcacttctttgcacttacatgtgtgggtgtatgaatgcatatataattttgtttttgacccatgtgacattactttagattgaaccataagaaattgcctatattcagtcatttttttaaatctatgaaaaaggcaatttcttttggttcaacctaatactacaaatattgttctactatttattttttcatagtgtatcttgaagatctttctattttattgtatttagaattactaaatgactgcattcttaaagggagaaaaatgccagttttctccttccctggtaataacactgtttcttctattttttttttctttctttttgaaggcagctgaggaagttggatatccagtaatgatcaaggcctcagagggaggaggagggaagggaattagaaaagtcaacaatgcagatgacttccctaatctcttcagacaggtagagtataagctgtttttgtttgtttgaactaacatgtatatcagagatatatgatttaactcatactataatttggatgcccagaaaatatttaatttttaattttgtctatagctaactgtctttctctctagtttctacctgcatattagcagagaaaaaaggttaatgaaatgtccaactcaattttaagttttatttaattaggtaattcaaacagtagagttattctgtcttatataaacgtgctcagtttgtcagatagctctttcctacatggtgcgtatggcttataggacctcataatgacaaagaaaaatcaatacctttctgtatttttgtgcccctgttctgctgactttgtaggtcatatgtgatatggtggtatgatactgatatggttgctcttggcttggccaggcccaggctctctgattgactttttctcactttagttcacattgcctagagacctctgagtttctatcatatgtctcatctaccctgctgtcccagcactctataccctagcccgtgttgcatggccaccacaccctggcacaggaaccctatggcaggcctacagtatataggaactgagagtgactcaggaaagctcgatgtaggatctctctttgccttaccctctgctttgcagccaagttgatgtggccatactatacattggttgcggagacgaccaaagaagtgatgtctttttagaatcttaaacagaaagagaaaagggagacaggggtctctttttgttctgtcctcagagttaccctcacatatttaactcactttttttcctcctaccaatacatagtaaaagatttgtcaaaaaatggaaaattgggacagaagtctgctcttttcactctcctagcttccctctttttcatagtttcctcatcatcttctactttgcacttcttttactagtgtgccatgctaccttttatttcgctttttttttttttttttttcccttaaaacacttagcagcaaactccttgcttcactgttaagagttaaaaggaaagtcttatgagctgggtcttccatgatttcatatacaggtggtccccaacttaaaatttcaacttacaatcaacaaacaaacaactttacaatactgtgcaagtgataatgcattcagtataaatcttactttgagtgcccatacagctattgtttttcactttcagtacaacattcagtaaactacatgagatagtcaacactttattataatataggctttgtgttagaagattttgcccaactgtaggctaatgtgttttaagcacatttgaggtaggctagactaatctatggtgttcattaggttaggtatattaaatgcaattttgacttagaacattttcaacttatgttgggtttattgggacataaccttattgtaagtcaaagagcatctgtactagataaaggaagtgataaaggtgttgtcttggccaggattggtggcttatgcctataatcctagcactttgggagtctaaagcgggagcattgcctgaagccagaaatttgagatcagtctggaagataaagtgagactctatctctacaaaaaattgtaaaataaataaatcaataaataaggtattgttttgctacattatcctattttaagtgtcagaaattgaatattaccttgggttttttttttttttttttacatttttttcattgaattctaatttcataggtagatcagtgactcagagagtctagagaaaaaagactgctcttagaagcaaaaagaaaaaaaaggcatgttaattaatgttaactcttacagacatttcaaaactactcattacttatggaatcaaatagtggaaaagtcttaaaacactaagggaaggttttctgtgaaagtccttaagtttcaatactagttggctgaataaactaatcctcccattgggaacaaactagaaaagctgaaccagatatatatatatatatatatatatagatagatagatatagatatagatatattacattttacggcattagagaccattcaagacagtgaagaattatggggctaacatacaagagaaaaaggaaacccagagatgtgagcctgacatatgaggctacttttcccctagatatatcttctagttcaagatagtagaaaggctgataagttttcaacagtcttaaaagactaagagggcttcctggggaggggtgccctggaaaacctcccacattttaggttaggatctttaaggactgactacatcatgggagaaagggtgaactggaaatagactagccctcacagggactaaatcttggcttcaaaacattcaacctctgatttaagcaagatgttttaggattgctagtgcttctagacacctgcaggaagcaaatgtaaatcctttccagagaaagataacatccagaacttaaaattatttctattaatttttcttacagcttatcaaccactcaattgaaaataggcatacaaaattagatgattgaaaaccaagaagaacaaaacagtagaaacagacccacagagggtttatataatgagattatcagacaaggactttaaagtaattctgcgtaatatattcaaggaaagtaaaggcaagattgagaattttggtagagaactggaaatcataaagaagaaacaaaagttctagaactgaaaatgcaataactaaaattaagaagtcaatatcaggggttcaagaccagcctggccaacatgatgaaaccccatctctactaaaaatacaaaaattagctgggcctggtggcacatgcctgtaatcccagctacttgggtggctgaggtgggagaatcacttgaacccaggagacagaggctgcagtgagctgagattgtgccactgcactccagtctgggtgacagagcaagacattgtcttaaaaaaaaaaaaaaagaagaagaagaagaagtcaatataggagtttaaaattatagcatattagatgcagttgaagagaatcagtaactggcactggagactgagatgggagaatcccttgagcccaggagtttgaggctgccttgagctatggtcatgccactgcattccagcctgggtgacaaaacaaaaaaatctagaaaaagataaataattaacgactggtgagtagatcagaaggaaattcagactgaagcatgaagaaagacaaaaggatgaaaaacatagagcaatgtgagaaattatttgcaatggttttgtagttgttgctcttgctgtcttggagcaagccctcagactaccatgtgaagagcccattctagcctactagagaaggagaggtcacatgagcagagatgagttgtcccagctaaggcctcctagtcctactaggacagtcagcagcaccacatttgagacatgtaaatgagaccatatttgaccatctaaccccagttgagctgccagatgactatagctgcatgaattactccaggcaagatcagaactgccagttgtgcccagttcaaaatgctgatccacacactcatgagcaaataaaataaaatggttgctataccaagtcactaagattttggtagtttgttaggtatcaatggataattgacacagaaattgatacctaacggtatgatgttgccataacagaaaagtaaaacgtaagacattgactttaaaactggctcataggtgtaggctgaacattggtgaggaggatgttaatgaagactggaagaatgatgaattgttaagggaggctggaaaagcagtgtagtaattgttactggagtctggaaaaaagatccatgttctgtaataatggaacaattggcaaaaaaatgttatctgaggtaacttggaagacaaataatatatttaatgaagtcatggatctggttaaggagctctctacaagtgtttaaagtatctgtggagtgcttctagttgcttatgctaaaaaactgtaaaagagaggtaagctaaagaagatgttttgcttacaagcagaatttacagaaatgtaaaggacccagaacttgttgaaaatagaattgtttctcatcccgagtctctccagctggcaaaagatttgcaaagtaaaaaatgcctcagagtaaagaccaagtcaagagtgcctgtgactttaaggcctcagaaatctttaaggtagtagctaataaattaccctttcagctagaaagatgcttctaagtatcttttttttttttttaatgctttcagctggaaacatgcttctaactatctttttttttttgttttcttgagagggagtctcactctgtcgcccaggctggagtgcagtggcgcgatctcggctcactgcaacctccacctcccaggttcaagtgattctcctgtctcagcctcccgagtagttgggattacaggtgcccaccacaatgcctggctagtttttgtgttttgactagagatgaggtttcaccatgttgctcaggctggtctcgaactcctgacatcagatgatcctcccaccttggcctcccaaagtgctgggatcacagacataagccaccatgcctggccctaagtatcttaagggtactgtctcacagcatcctgacgtgcccaaagtatagagaggtctatgcagacatgagttgtggatgtgtctctttgggtgagcggtgaaccccaatatgattcataggaaacccacaaagttgtcaagagacttgtgttgatgaatgcaccaagggactgaaagggccagaaacagttcaaaatgaaaagtgacctctgagccttaaactttttaatgagcaggaagcagacagaaagctattcagctgtaaatagctgtcatttcaaataaaaagagggatttctcagagagtggagtcaggagcccagagggcagagctaggagcaggggatgccatggattaaggacctactcccagggaaccaaactagatcctgaaaaacaaaacaaaacaaaacaaaatgaaaagcattcctgaccctggagtaagggaatctgacagcatgtacctatctggatttcagaattgctatggaccaatgactactatgtacctcctatttcctcctctttgaacagcagtctcatttgcagttatcccctcccaatatcatcataaatattgggagtgttgggccagataacttgtcttcttagttcccaggtctttggatcaagagaaactgtacctgaggagttgcacccaaggaacctcattttcttctggacatgactcatgagaaaatggacgtcaagcccaatgccatgattggatgagactttgggggtcttgggagggggtgagtctgttttgcatgtgggaggtatgtgaattattgtggccatagggtagagcatagtaagttgtttgcaagagatggcgacaataactcctcccattcctgtatgtacaccctttgcaatgtgactttgctgttcctcccttccaggggtggcatctattttccctaccccttgaatcttagctggctttgtggcttgcttagaccattagaatgtggccaaagtgatgtataaattcgaaagcctagacctcaagaggccttacagcttcttcccctcttggaacacatcactgaagaagcctagtctagcctgctgcaggatgagaagccacctgcattggagatgaacgattccagctgaggctccctagacctaccagccagcagtcagcacaaatcaccagacatctgagtgagaccattctaccccactcaagctaccagatgatgatatgtatgtaagtgcaagaccagaagaagaactgcccagatgagaacaacatcataaaaggttgatgttctaagcaagccactgagttttgagatgacttgctacatggcaaaacagagcaaaaaagatacagagcataaaagacatatggttatgtgaaatggtctaacatcatgtactttaagtctcagaggagaagagaaagagaatggagcagaaacaataattgaagaaatgatgaagcagaagccatatttgaagagagaaaagctaagaatttctttgaacagataaaagataccaaggacagattcaaaaagcactatgagcctcaagcaagacaaatacaaagaaccacatctatgcttatcagagtaaatctaccaccctcccccctataaaagacagaaagagagaaaatcttaaaccagctgaggaataaagattactttcaaaatagtaacaataagattgacagttggcatctcagtagaaacagtgaaagctgaaaatcattgggattatttaaagtgctgagaaaaaaaatagttaccattttagaattctgtccccaacagtaatattcttcaaaactaaagatgaaagtcctttggctgcaacaataccatatatgatgtaatgtgaaccaggaaagtatcttgtctggaacaagttgtacatttggttgtacagagtacaggatggcagtattttgccctgttgttggatttgtgtatgtgcctatgttttcaaatattttgttgtttacctttgtgatgcaccagatgttcgtatgttttcatatttatcaattaatattggttatgtaagaatgcagcatcttaaagatattaaagatgacagcatggactgtattttattcagttttgtatttctgctgattaacatggttcctgacacttctggacatctgcttgttgaaatcaaagtagcttatcaagatagataaaaagtttaaaatttaagaattggttttttttttcccccttttctaatacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacaggtacatatattaaaaggcttactttatgttttcttacatagaacatttttcattcagttcatgtaccaatctgagaacaatggcattttaagcaacgattctgaataattaataaaattatatccttttcttagagaaaaaaaattctactgttctcccactaagagaattgtcaaggaacatgtcaagcttctaaaagtagttaacgctttctaaaaaaaatcagcgtaccatttcaggatacagggataaagaagagaaatgttttggaatttttaatcttatgattgatttttttaagaggctcataatcaggtagttttatttgctgggttgagtatcatcaagtcttcagctgaatttaatcaactctattatcgtttttggaaagtcctctaaatatcttcagagttcacacattctatctttttgtatagaaagtagtttctcaaagtcatgagcgatgccttcggaataactatagtttagaggcctgaacatagtcttttctggagtcctaacccagtctctacatcaaaatagattcttcaaaatatatttcatgtgtgttagaggtctatttcctatgttgtgtatatattaggatgtactcttgaactgctgtaataaagatgccttcaaaatacagtggcttggccgggcatggtggctcttgcctgtaatcctagcactttgggaggctaaggcggacagatcacttgagccctggaattcgagaccggcctgggcaatatggtgaaaccctatctctactaaaaatacaaaaattagctgagtgtcatggcacacgtctgtactctcagctgcttgggaggctgaggtgggaggatcacttgacactgggaggtcaaagctgcagtgagccttgatcatgctactgcactccaacctgggtgacagagcaagaccccatctcaaaacaaataaataaataagcaaaatacggtggcttaaacaaggtgtaagtttctatttctctttcatcatagttcagagatgagctgttaccagaaacaggtttattgctcacctgttgcctgtttttgtaaataaaattttgttggaacacaatgatgcttatttatttatgtgttatttatggctgctttatcactacaatggtagaattgaatagttgtgacagaggctatatggcccacaaaattgaaaataattactatctggctctttaccaaaaaagtttgccaaactttgctcttggacattgtcatcttcatgattaagctaactcacacaagattatgttcacattgtggcctgtgggaggaagagacaggggatgtggagggcaagcatatggaagcatgatcttgaagtcacatacatcacttctgctcacattccactggacaaaattcagttacacaattatacctagcacaaaggatgttaggaattgtgatcactaactgggtgaccatgtgctcagcaaaaatttcgattttattcctaaaatgatgaagtagagaaaagtcactggagggcatttcataatctgtgcctcagtctgttcctctggctacctattatccctttatcctttttcctactttcagagcacacatagcctttgtccaaggaagacaacctgaagccccatccagttactagtaactggatgggttattactggaggtgattccggatctctatatgatgtatattcttctccattagatatgtattgtggcttttcatgggccagtgactcaaaatacaagttatttacccagtattatatcccctgccttcaccatacacccatatacaatgatggaataggaacaggataactctcatttggaaaaatgaaaaatacatagcaatcgttggtccatagcagttatcaaatcctcctttttaggtaggaattgcaatgattccctgctatataatagaatactacctcagttagacctggctgtccctggttctgctactgcacactccagagaagtgcaataagggagtaaatcccttgttcattgtccttcaagacacctgacattgttttctgggaagttcttcctcattcagttttctctgtgagttgggctttggagactatgccttctttggcagaactttcacaacccacttcctgctggtgcaggattgagggcacaaatatcccaatcatcagtcgcaggcttttgaaggccaggtttgtggtttgtttagaaatacaattccttcaaatacttaactaagcttctgggctatttgcttgcaatcagctttgggttggattaatcatactcatagatttcttctagatatagaaacttttcttctattatttactggcttctgtgcttagcctatctctcttgccttgatttaatattggctatcttggggccagctgaaactaaagcagcacgtttgatctttgacactgagttgcttcagggtgataatctcattttctgtttggggggatacaaaagaagttggctttttcgacactctgaccctttcagaccatcttttttaaggtttagttggtgtgtggtcagtatcccaagttattgtaggaaacagtttaccaaatgttgtgttatcccaacaaggagattatcacctttccagcctgcagtatctgtttctctgctacccactacccttttgctaagctagcatctcatattttaatatttttaaacagcaacattctacctgcacttaataattcctgtatcgattaggatacaggttaaactgctataacaaaaaggtccaaaaaacacagcggacccccccaaaaatagaagtttatttttctctcccatcctagtctgaggtgagcttttcagggctggtggaagtgttttattccacgagaccatcttgggattcaggttcattctttcttttctttttctttcttttcttttcctttcttttcttggtgttcttagtgtgttctcatttgcatgattgaagttggcttatactatcatgactatgttccaatgaataagaaggaaaaagccaggaatagagaatgagacatttccttttcaaaatatgacttagggctgggtgctgtggctcacgcctataatcccagcactttaggaggctgaggtgggcggatcacctgagatcaagagttcgagaccagcctggccaacatgatgaaaacccatctctactaaagatataaaaattagcctgacatggtggcatgtgcctgtgatcccagctactcaggaggctgaggtaggagaatcacttgaatccgagaggcggaggttacagtgagccgagattgcgccactgtgctccatcctgggtgggtgacaaagcgagactccatctccaaaaaaaaaaaaatatatatatatatatatatatatatatatatatatgacttgggagttatgcatatcacttaccaatgctggtgtcctgtttgtcaaaacttagccactaaccaggccaggcatggtggctcacgcctgtaatcccagcactttggtaggccaaggcgagtagatcacttgaggtcaggagtttgagaccaggctggccaacatggggaaaccccatctctaccaaaaatacaaaaattagccaggcatggtggcgcatgcctgtaatctcagctacttggggggctgaggcaggagaatcacttgaacccgggaggcagagtttgcagtgagccacgagattgtgccactggactccagcccaggagacagagtgagactctgtctcaaaaaaaaaaaaaaaaatctagtctctaactagttagctatgtttctagaaagaagaggagcatattggaaatactggaaactggacaagagtctgtccccatgtttttttgtctgcatgcatttatgtctggtggggtgaggttgcttttgatgcaaagtgaaaaatgctcttttctcccgatttttcattgagtttttcatccttgtccagggatattgtataataatcagaaatgtgctctcatgtggctaaaagcttttgatggctcttatacacactgaacagttgagtcagtgagaggctgtagtggtctagcagttggataaggtgagatacttatgtttgcttatctctcttctttgagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccaggtgagtctccctgatctgggttgcagagcctagaaaagtcagagaggcctgaaaaatgggtttaaccagtgtgtgataagagaaaagcacctcctatctgagtcacacctaatggtcatttctctttcaccctgtatgtgttatgcatgtgtggtttggttttcctgatgtagtacagacataggaatgttattttttctagccagacacatctgatataatgtgtcatgttttagaaataaatgttaataatgtatgctttattcaattatttagctatagtaaacttcacaactttgtattataattattccctactcatttttgtttttttactagtgttctttattgaaataattctgcatcagagattagtggttgaagtttttccttacaagagtgtggtagcacacatatatttttataatttgtaaagtgcttgctgtcaatattattgtcttctctcagcccaggaaacaaatattatggaaagcagtaatagttaatgataaggcttgatattatttttatctaacatttgcccacatcgagaacaccttctgggttcctattaaagactaaagatttacttacttcctccagtggtttgcagggatggaagagataattatgacacaattaagactttctagctgtctgtttttggatggctattaacatttactcctctgttggatattttcattcttattacgtgatggagaaatgacaacaggggaactggtgtctgttgcattaggaatgtggggacttctttagaagtggagaatattctaactacttatctgtagtgatatattgtatttcaagcaacttagagttgatgattgtagaatacaggttataaaaatagaatgttttagggagtggctccaaaaataaaaatattttaggttatctgatagcctctacactttaagggaagtaactgaaaaattaaagatgtgtgttttattacctttcagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgaggtaacccatcacttaaaaggtttatacctccttttaatgaactttaatgttaagatagtatctgaaagtatacttctgaaatatcttgggacttcctctggagtgggaaacatagaggtttctcagagcagataagtaaatggttgttgcttcattggttacttaatcccacttaagtcactgtagagtcttcagtgggtctgtggcactgggtcttggcctttatcatttttgtgtgtcttctctgcttctgtgtgtgattaacagagaacttaaacaatgaatatataaatcttctcttccttcgaaacataatatggtctctcattctttattctctaacagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcgtgagtataatagcatttgattgcattttacaaaataaatttgtgctaatcttaagtgaaggtgtgagcatgggaataggaatcatctgctgtcaaagtaataatatgaacaacctttttgaagaaattttgaatatctttaattacacttgcattcatgttgtattaaattatgcagtgcttggcagatgtttttctgtttgttgttctgagccttttgaagtatttttcctttcaaatatttttgataaatgtataaaattgattgctttaaaggtatcttatttttccacaggaacagtattgttattgaggggaggtagattcttggccaagaactaggtatcaaataaatcatagacttttattttatttttttcttgtgagaagacttaaaatctattagcaattttcaagtacacaatctattgttatgagccatagtcaccatgatgtactcttatagttatttaaaataataaaattatactgctcatattatgaaaaggacataaagaaactgtctacattgctaatacaagagaccttagcatgctgtatataacagcttatgcaaatataactgctatatcataaatgttagataatattctattaatcataaacaatgaatattaaattaacagcacttttgcttgcctaaaacatagggctgaaggaggtaattttaacagcttagatcttttggaatatctatctaaaattgaaacttgaactagttcttttctgttttttaatggtttattgccttgtatcaaacatttaataccattccctttacctttgtactgtacatggagtaggtaattaataagtgtttattagtattaattactaataaatagcatttgtttattagtaattaatcctaatatatggttgtttgtattaataaacacttattgattagttttatatttttatcaatttcctgaattaattaattttaagaggcagagtcttgctctgtcacccaggctggaatgcagtggtgccatcatagctcactgaaacctcgacctcctgggctcaagcaatccttttgcctcagcctcttgaattgctgggactgcaggtgtgcaccatcatgtccagcaaattttaaattttttgtagagatggggtctccctttgttgcccaggctagtcttaaactcctgggctctaatggccccacaaagtgctggtattataggcatgagccgctgcacccagccttgattaattagtttttaatattatttttagaagtagggaaatctcattatttctctattttgtcctttacatttcttctcattcttcaaaactataagtggaatttttcaaaattaaaacactgctaccagaaaaaaacattggtatgaagttgccttttaagcatattcgctgccatattatgctctgcaaagtgaaaaaggtttacactagagcttgcaaattgttggctttctggtgagtctcaacatacagatgtgttttgatgggctcacaaagtgttaattttttttaatttgacaatattaaaaaatcaggagattgaaatcaaaatatggatttctgctagctcttaaaagtaggactataatgacaacattggttgtacattctagttgttaaaagttagctaattttgcctgggcacggtggctcacacctgtaatcacagcactttgggagaccgaggctggcagatcacttaaggtcaggagtttgagaccaacttcgccaacatggtaaaaccccgtctctgctaaaaatacaaaaattagccaggtgtggtggcaactgcctgtaatcccagctactcgggaagctgaggcaggagaatcactggaacccaggaggctgaggttgcagtgagccaagatcacgccattgcactccagcctgggcaacaagagcaaaactccgtctcaaaaaaacaaaaaacaaacaaacaaacaaaaaacagctagttttgtgtgactgcttcttttcgacgggacataaactttgtagttaacacagctcctattcagtctgcctcactcatttatgttcccagactggcctctgttggcatttaggtttaagtcctgatttggcagaccactgtgtattttcttcagggaatgtcctataacccaatccagaagccttgttccttatttctgaccagctctgtacatttgtctacagtacaaagctaactagcttaatttttagcatgttaaaaatacgttatctacaataagtctccttcttgacactatgccaaaagttcattcttcagcttagagctttctttgtttcttatttcttcatttcattaggtctatatctcagcttggggtttggactcttgtttgccagaatgccccaactcatatattccagtatattccagtataatttcccatgggtcataatctaaataccatgagaacaggactgtgtcttgttgctgctatatcccctgaacatagtaagcattcagtaaacgttggttgaatggattagccactcattcctatccttatacctctgcttcaatcataccattccctgaactcaagctgtattttccttttttttttttgagacagagtcttgctctgtcgcccaagctggagtgcagtggcacgatctcagctcactgcaacctcttcctcctgggttcaagtgattctcctgcctcagcttcctgagtaactgggattacaggcacgtgccaccatgcctggctaattttgtcaacctgtattttcttccctctgcttctttgttcttgctatttcctctgttcattcatttattcttttttttttttttctgacatggagtgcccgccaccacacccagctagtttttgtatttgtagtagagacgggtttcaccatgtcggccaggctggtctcgaattcctgacctcgagtgatctgcccaactcggcctcccaaagtgctgggataacaggtgtgagccactgtgccaggcccattcattcattgtattcaacaaatatttactgagtatctgctatctactggttctggcaatacagtgaggtccaagatagaatctctctcctcacaaaactttacaatccagagggtgtaagacaattggcagttaaaatacaatgtattaagtatgatgatagtcagattatttaagggcattataggatcatacagatgagtcaactaactcagtctagaggggttctgggaaggtatcccagaagacagtgacatctagattgataattgaagtttgtagaagtaagtcaggtcaaaggaggacacagaaaggaggacagaggtgggcaacagaataatattttaggctgagggaatgcctggactacctggaatatgattcctctcacagttataattatcagctatactttagcccatgtcagtttccacatttttcatgaaactgtagggagatgaatttctcccttcttacaacctctccagaactttgtgtaagtattctgtctggcattgatgatattctgccatatattttgaaagtgattattgtatttatgttcttccttacaatcatagtatgtgtcttattagtatgaggtacataattagtatttgtggaagtaagtacctgtcccatgcaggatagacactgggcataaatatacagaaaagccccatagtatttgaaattctgctaaaattggatcactttgcacttaactgggaagtaataaaagtaatgagcaaatcattgcatagatatccaaaatgcagttttaaaaaaaacactgtcacatgcagtgtcaggctgatatatgactgcacccagagagttgctttactgtatggaaatctttaaattaagcacttgggaaaattcattgaactgtatacttaaaataagtatattttattgtatgtaaattatacataaaataaataaggtacaaggatagggagaattaatgccctaattcttgttagccaacaacaaatgaatggaataatggaaacttagtaagtaaaagctgagggtgacttgcatataatttgttataatttgttctgtactcattataatgaaatgtttctgatttgctgatgctcttatggtaatatcagttagaattcatacgttttctgactttttgcaaatttccctctcttgaatgcacatgaatgagcacacttgacatgtgcacccttatttgtttttggaactgcctctctcccttccctctcaagattccaaaggaatgaaacagttctttcttttatttttatttttatttttttggggggacagagtctcgctctgtcgcccaggctagagtgcagtggcgtgatctctgctcactgcaagctccgcctcccgggttcacgccattctcctgcctcagcctcccgagtagctgggactacaggcgcccgccaccacgcctggctaattttttgtatttttagtagagacagggtctcaccgtgttagccaggatggtctcaatctcctgacttcgtgatccgccttgtcttggcctcccaaagtgttaggattacaggcgtgagccaccatgcctggccaaacagatctttaaaattattgaaaaacattaaagtgtttgttgctgaaacagattggcttctgttctcccagaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggtgtgtatttctccacaaacagatgctgggattgggtttttatagacttgtgtactcaatccctgccactacatgaaatttatttgattctaatgtaaatggttcttgatctacctggaaaaatctaggagtcagtgtaattttagcactctgatggttcctgtgcttgtgtcacacagtcattttatgttctagcattacttcctgaggtatatttgaagtgaggcatgcagggatttaattactttctttttcttcatttaatgttaaacctggtccatagttgccaacttctgtatctaccagatgctgaagagagaggcctcatttagatcaagagttatcacttattccttaattcctggggctatgctaaattatccaagattttgtataaaatcgttagattcatataatttggaggtccaaattttggctatacaccgtttttctttgagattatcagtagccaaatcgttgtgtctttttaaatttatttctgtcagaagcctatttttgagctattcaatgattggctaagtggaagtcttagggagaaaagaagaaagttgtttttcatttctcttcaagtggtgcctctaatcaaattctaaaagtgaatgtgttcatttttatctaaaaaatcagttgggcagtgagaatggagattttcattgctagctgtttcatcacaacaaatttgagcctgatttcatttgagaggctgtggtgccaagtgaccatgcatttgatctgccctctttttcctcctttcaggctgagcgacctgacaccatgttgggggttgtgtgtggtgccctccacgtggcagatgtgagcctgcggaatagcgtctctaacttccttcactccttagaaaggtaggctttgtttcttgtaggctacacaaactaatcaatggccctgagtacagggactgaagctcaaagacccatttattcttctgtccattcctggcagcttatgagtgctacttgttattcatggaccatggtggcaagaaagagaggggatgttgacatttatggcaaattatttggggagtcaaactgcagattctagacattaacttataccacagttagaacaggttgcttctttaaaaactggaatccatctgcagtagatattctgtcctgtataagtatcaaatctctccaaaccctggtgataaaaatctggtatttctccctagcactgaaccctaaatatttcatgtattacttgtaccacctttcagaagtaaataattaaggctgatattcaggatgacctcatgagtctttcaagtagagggtcagacatctatggggctaaactaatttctattgctgattgaggagactaagctctgcctttgagtccccagaggaatgttccaagtggctaatcattttaaagcactttaatcacaggcacttttatttccttctgtgttgttagacttatatcaactcccttttgaggtatctgaaagaaagaaaagaaacaaaatttaaaaattgaactgagatttcagagttattcaagtcctatgataagtatctttcactatgttactctcatgtagtaaaaccttcagcagcttggcatttctcttctgtatcaaatctaaatcccttggcgtgactttcaactccctgtatacatgggccgctttttaccaatccagtcttatttatttctgttctgcaacatataatctgtaacctagttaaatagttttcttattggtgtacaaatatgtcaaatgcattttcctctacaagccccccacccacctccttttaaaatgcttttgttttttacttattttattatttttattttttttatctttgagacagagtctcgcactgatgcccaggctggagtgcagtggcgcaatctcggctcgctgcaaggtccgcctctcgggttcacgccattctcctgcctcagcctctcgagtagctgggactacaggcacctgccaccaggcccggctaattttttttgtatttttattagagacagggtttcaccgtgttagccaggatggtctcaatctcctgaccttgtgatccacccgccttggcctcccaaagtgctgggattacaggcgtgagccaccgtgcccggctgcccggcctttttaaagactctcaaataaagtttcagttgctaggagcagatatgcttacactgaagttttataattttttcgcgtttaatcttaatctttttttttgagatggagccttgctctgtcaccaggctggagtgcagtggcgtgatctctgctcactgtaaccttcgcctcctgggttcaagggattctcctgcctcagccacatgagtagctgggactacaggcacgcaccaccacgcccagctcatttttgtatttttagtagagacggagtttcaacatgttggccaggatggtctcgatctcttgacctcgtgatctgcctgctttggcctcccaaatagctggaattagaggcgtgagccactgcgcccaaccttaatctttatctttaagaacagttaacacattcatgtggttcaaaattcaaaaggcacaaaaaagataagcagtgagaagtctctctcttacctctgttccttggccatccagtttccgtcccctatagtaaattcatattaccaatttcttttctaaccttccaaagataccctaaacttacatgaacatatatatgtgtattagtctgttctcacactgctaataaagacattcccaagactggctaatttataaaggaaagaagtttaattgagtcacagttccagatggctggggaggcctcacaatcatggcggaaggcaaaggaagagcaaagacacatctttcgtggtggcagccaagagagaaaatgagagccaagtgaaaggggtttccccttataaaatgatcagctctcgtgagacttattcactaccatgagaacagtatgggggaaccgcccccatgattcaagtatctcccactgggtccgtcccacaccacaagagaattatgggagctacagttcaagatgagatttgagtgggaacacagccgaaccatatcaacatgcaatatttgtttcttcccacctcctggttttttaaaactcaaatggtagcatgctgtgaagctgttatttaccttgcttttttaactcaacagtatattttttaaagtgttttttagttcacatctttttaatgtctgtatgttttgttccacatgtgaaaacatgcgcaacatcactaatcattaagtaaataaaatcaaaaccatgatgagataccacctcacacccattaggatgcccactgtcaaaaaacagaaaatagcaagtattggcaagtacgtagagaaattgggacacttgtgcactcttgatgggaatgtaaaatgatgcagccactattgaaaaatggtattgcaattactgaaaaaattaaaaatagaattaccctatgatctggtaataccacttctgggtattctgaaagaattgaaagcagggtctgaaagatacttgcacagccacattcataggaggattattcacagtagctaaaagatgggagcaactcagatgttggttgatggatgactggataaacaaaatgtggcatatacatacaatacagtattattcagccttaaagaagaaggaaattctgacacatgctaaaacataggtggatcttaaggacattagggcaagtgaattaagcctgtcacaaaaagacaaatactatatggttttacttatatgaagtatgaagagtagtcagactcatagaactagaaagtagaatgacggttaccaggaactggggggagggcgaaattgggagttgttaatgggtgtagagtttcacttttgccagttgaaaaagtcctgcagattggttgcagaatagtgttaatatccccaacactatagaactgtgcattttgtaatggttaagatggcaaatttaatgtaatgtgtattttaccctaatttaaaaaaatccattgtaagattcataattgatgtgatcaattccttacaaacgatcatttaggtatttaggttgtttctagtcttttgttattctaggaaatgctacaatcaataatgttttagattctcttataactgttagaactttgtagtaagttcctctctcatcgttctttcaggggtcaagtccttcctgctcatacacttctgaatacagtagatgttgaacttatctatgagggagtcaagtatgtacttaaggtatgcagaaccccattggagcttgcaccttacttttttagctatctttctttaggttgagaggcaggagaaaaagtttgatttaatgcagggatgggggtattagtgaaattaccgtcattatttttgtcagtgtcctgaagcagcgtttgttgttctatgaaaatcttttttgttgttcttcaacttcacatacactgccaagagataaaggagagacagggaacaaccacagttggggaaaatcaactaaggttgccctctttgcttacagcaggactgagccatgtccacagacactgatgcaaatagcatcagtgccatgaattttcttcctcctgacagatctttcttatctgtatttttgaagcattcaaatttcatttggagctgtacctggaagggacacactgatcctcattctcattccctacaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggataggtaagtggctgtttgaggtccatttgctggtcatcctgttagccttttctcttattagctactagctcttgggattttcccaggcttttcttggtactcatttgtagttaaaaaaaaaaaaaatagtacatgcacttaacaaaaatatcaagagtattaaagtgtttataattaaaaacatgtctccctaccactccagtgtatgtggacaatgaaaaataagttcccctttttataagtaaccattgttaaaagtttcttacatatttgagtagaaattttatatgcatatacaagttacactcatgtacatactgtttttctttaaatacattcacaaatgtggctgggcgcggtggctcacgcctgtaatcccagcactttgggaggccgaggcaggtggatcacctgaggctgggagttcaagaccggtgtggccaatgtggtgaaaccctgtctctactaaaaatacaaaattaaccagatgtggtggcttatgcctgtagtcccagctacttgggaggcagaggcaggagaatcacgtgaacctgggaggtggaggttgcggtgagccgagatcacgccattgcactccagtctgggcaacaagagcaaaactccgtatcaaaaaaaaaaaaaaaaaagaaattcacaaatgttcaacaccagttatggtgttatgagaatgaaataaattaacatgttgaaaatgtgtagaacattgccacaacatagctaggcttcaagaaatgttagctattacgtcatcaatatctttgtgtgtgtttttttaaatggtggtacctgttatttttaatagtcatgtggtattccattatatgattatactatatttaatctgatccttattgaaggaaatttatgttaattgacattgtaaacaaatatgcagtgaatatgtctgtgtgtgtgtataataaagttttcaggattttttttctttgaaggttgacattctctaccattctcctttacatcctgaggtgctttcttagcttacatacttccacttgtctcctagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtcagggtggtgaaaggactgtgggatcatgggaggggaaggtaggaaaagggtcggctgggatggactaggactgaaaagttacagaaaggaggctgggcacagtggcttgtgcctgtaatcctaccactttgggaggctgaggcaggaagatcgcttgagcccaggagttcgagactagcctgggcaagatggtgagaccccatctctatgaaaaattaaaaaattagcggcgtacagtggcacatgcctgtagacccagccactctggtgtctaaggcgggaggatcccttgagcccaggaattcaaggcagcagtgaatggagattgtaccactgtactggagtggtacaatttgtggcctgcgtcacaaatcaagaccctatttctaaaaaattaaaaaaaaaggtaacagattggaaataagaatgaaaaagaaacatcagttggcttaattagaagtgcgaaccttaagatttttaaaacacataggcaaatgaggaatctctagttctaaaaatagatactaggcaatagcacttgttgaatgttaggtgtcctaactgctggctatccagagaaaatacatggaggtggggcacaaaacagacaagaaatgtcatgtgattaattttaagagagctaagcatagagtgcagagggtcacctaacccaaatcaagctaagcttgtatgggaagatattctgaaagaagagacatttgatcttagttttgaaagacagatagtgatagagcaggtgaagaagggcagggaagagtgcttaaagttgaaggaatagcatgtacaaagacagaagcaagacagcacagtgtatttagggaactgcaagtatgtgttggtgtggcttgagaatagactaaggtttaatggggagggacaagcaaaggtgctaaagaagtaatgtgagatcttgaatgtgaggttatgaaggatcttataaaccatactagtaagttttcactatcctggaggcagcaggtaatctctgaaagatttaagtggaaaagtagtatgatgagatttggggtctaggaagattgcttttcgtgaccttgagggaggtatgtagcaagtagggagatctcttagggggtctttgaagtactttgggccagaaatgaagaaggcgtaaaccgaagagatggcaagagaggaagatttttgagaaaggtttagaagatatgtctggctgggttggtaattggtaggtaagggagaaagaggagtgaagaatgatccttaggttttggcctggttgtcttagattggattcactggtatgaggatattaaattgttccttactttctaagtacaaaacaaatataatcacaaattatgccaaaatggttgtaaaagttagaaaggagaaatgtcaataactgttattaattcctaaagtgaggtactgagagattttctaattgcttgccttgatagtccctaggagatgatggtaaattcccattttttcttggtcaaattaggtgtggtccaacttagatgctaagggaaaaattttagttcttttaagcactcatctgtgtaaagagagataaatctgagtctagtttatttttcactataggtaatgaagatggtaatgaccttaacagctgtggagtctggctgtatccattacgtcaagcgacctggagcagctcttgaccctggctgtgtactagccaaaatgcaactggacaaccccagcaaggttcagcaggtgagtaggaaggtgctccgaatattgctctctaagagctaaagaacttggtggtttggagaggcaagtgatttcaatgcttggtttgccagtgttttctttagctttgtcccctattaatcttatgccttgtatttgtgcctgtagtattatggaactagagtttgcaagagttactgtagtactaagattctgtaatttccttatgatgtttcctctattgacttccctcctggtagctgggtatgatgtctcgattttgaatgataactcttaagtgcagtggtgtgtttgtaccttagatcaaaagtagtagatgacttgatctcttgttggggttgacaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtatgtatcacgtctcctggggaagggatgtacaaatgggatacctattctccaaaatagttccaagtctcataatgattgtttaagagggaggaaaagaaagctgtttggcctagaactctttcaccttcagttgtgggacttgaggtctttaaatccatgtttcttatccttgtcatggacttcacatttaattgtggttactcctttttttttttcctcgagacggagtcttgctctgttgcccaggctggagtgcaatggcacaaactcagctgactgcaacctccacctcctgggttcaagtgattctcctgcctcaacctcctgagtagtggggattgtaggcacgtgccaccaggcgcggctaattttttttttttttttttagtagaggtggggtttcaccacgttggccagactggtcttgaactcctgactttgtgatctgcccgcctcggcctcccaaagtgctgggattataggcgtgagccactgtgcccacccgtgattagtcctttttaaactggagaataggggcaatgttagatgcttacgttgcaatttcaaagtactctatgatagttggctcacgcctgtaatctcaccactttgggaagctgagatggaaagatcgcttgaggccaggagtttgagaccagcctgatcaacatagcaagaccccatatctattgaaaattatataaatttttattgaaaagaagtagtatatgatagtgaattcagatatagttgactcttgaacaatacaggtttgaactgtgtgggtccacttatatgtggattttttcagccaaacatggatcaaaattacagtattgatgagatatggaacccacaactatttctatacatgggttccgtagggctcaagtatgtgcagattttcatatatgagtggtggttctggaaccaatttcccacgtatacagaatgacaactatatatctttttatttgggggattgtgttaacttgggtcctattttaccaatgctttctttctaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcaggtatttataggataacactatatttttttctggctaccaatgccagagtttatgttgtaggattccttcctatttggatcctccttactttttggatgttgtgcttgtatacttttaagcattgtattcctcacaaaactgcctcagggtacaaacccaacagtgaaagtactgtatgtgaaggataagtatctgtagttatgagaaaagcacacttggatcatgtataccttatagctttgttcctggggctattccctaattagaggtattttcatgaattgaaaatagagtgatattagttgattgattgattcattcattcactcattgatttagagatggagtctagctctgtcaccaggctggagtgcagtggctgatctcggctcactgcaacctctgcctcccgagttcaagcaattctcctgcctcagcctcctgagtagctgggattacattcacacgctgccatgccagctaatttttgcatttttagtagtcacgggtttcaccatgttggccaggatggtctcgatctcctgacctcgtgatccgcccacctcggcctcccaaagtgctgggattacaggcgtgagccaccatgcccagctgtttatttatttatttatttatttttgagacagggtcttgctctgtcgccaaggctggagtgcagtggtgcggtcatggctcgctgtagccttgaccccataggcccaatggctcatcccacctcagtctcccaggtagctgggactacagatgtgcaccactatgcccagctaatttttaaaaaatttttatagagatgggggtctcgttatgttgcccaggttggtattgaactcatgggctcaagctatcctccctccttggcctcccaaagtgctgaggttacaggtgtgagccaccacacatggcctattggtagttttattttcagagacattcttactaccttggcagcatctttactctttacccataaagcagatgtatgtgtagggaatataggtagataagtggggagtgatgtttggatcttgaccttgaacagatattggtaagatgatagtttttgtaatgtagtcattaattcatctgggaaagggtgacaagggatgaaatctgcttgcttatgtagcgtgattctctatatagactacgcctggtaacttccagctgctgccaacatgtgagataggaactgccatgttataagaagaagattcctactggtcgtgctatagaggctgatgctttggggcattttgttgggttgggcctcatttttttcccttttttataccttagattgcaaacatcctagatagccatgcagctacattgaaccggaaatctgaacgggaagtcttctttatgaatactcagagcattgttcagctggtacagaggtagtaacttgtaactccagattcccagacctgtccatactcatgtcttcctttctttcaagtggtcacaaaaaaatttacctcagatttgacttcaagaaattggaaagcatcttatatcttagaaagtaccttgtcttttctaaatatcttagaattgtgagctaactctcatgctcaatatttctgacttcttaatattctacatttttttctgtcaattatttattattattattattttttgagacaggatctcactctgttgccccgactggagtgcagtggctcaatcatggctcattgcagcctcaacctcctgaggctcaggtgatcctcctgtttcaacccctctgaatagctgggactatagctgtgcaccaccacatccagctaatttttgtatttttagaagagctggggttttgccatgttgcccaggctcatctcaaactcttgggctcaaatgacccacccgcctcggcctcccaaactgttgggattacaggcatgagccactgcgtccagcctgtcaattaataaggcacagaaattttgttgttttctttttccttgccattttgatgaagctcctaatttttcttctgtcacagggcccagtatgacattttttcttcttagcttatggagcctattatattaggttggtgcaaaagtaattgtggttgttgctattaatactaaagggatattcacagagcatatttatttatttatttatttatttattttttttggagacagggtctcacactgtcatccaggttgtagtacagtagcacaatctcagctcactgcaacctctgcctcccaggctcaagcaatcctcccacctcagcctcttgagtagctgggactacagtcacatgctaccatgcttggctaatttttttgtattttttgtagataagaggttttgccatattgcctaggctggtctggagctcctagactcaagtgatcctcctgccttggcctcccaaagttctgggattgcagatgtgagctaaggcaaccggcctcacagaacacttttaactttaagatacttataaatttttcagatatctcagccatttcaagagtatggtaataatttctacttagcagtaggaactgaatcaaggtgttggtaggtggggctatgcaggattttgttgtcttctttattaaaaaaggtcttgtctatagtgagatttcttttaggcttagaatttaagttaattttgtagttcattttaggctgttctttattcagagggaaagcagttcagtggaatgtcgtggaggtaaatttggcctttgggtttattgcttaatagtgttggattgtcaggtttttcagtggagactttctatttgcctaggtaccgaagtggcatccgaggccacatgaaggctgtggtgatggatctgctccggcagtacctgcgagtagagacacaattccagaatggtaagcctcttcctgaggactctctagctaagaaagccttgattctgataaccaacccaaactatccctataggactgtgtaagagctaagccccctcctgtcaacaacacttcccattaataaacagtctcctatcactactcccttaaaaactaaacctctatatccactagctctaaagaaagaacaacgaaacacagcttgatgaaattaggaatccagtgtgcttctgagaaagggctgaagtaatttttctaatagagattaccattcctgttgatatctttttgaccttgtgtagtgtaagttggttgagtcatcacaggctgaaattgagaaacccatatctgaagagcttgattcttggcagctaatccatgaattgaaccagaggcatctaggaagagcaagttcaggttttccaatactttttagtatatcatttaggtagactttatccctggctttctctgaagagcttcactaaatgataaattgtctcttaagtgtgaaataaccttggctaaaattttaaagctgtttactgctgacattgcttcctgccacaagatggcagtgaaacatcacagaatttgaaacattatctgaaatttgaaacattttcctttatctgctccttttcacttcctttaaaagcagcctatgccactcatgaccagcaaaaatcctcatgtagatatcagcaaaccgcatccaataacatacaaaataatacataacaaccaagttggctttatcccacgcattcaaggttgatcagtttggagaaagtcaattaatataatttatcatgaaatagatgaaaggaggaaaaacatgctcattatctcaagataacagggtgtggagagggagcatttgacagaatttaacatccattcatgacaaactcttggaaactaggagtgaaatggaacttttaaaatcttgtaaaagggacccacaaaaaaatctgcaggatacatcatgcattatggtaaaacgttgaaaacattatctttaagattaggaataagacaaggatgcctgctgtcactacttctattcagctttatagtggatgtcctagccagtgcagtaagacaaggaaaagaattaaagggtataagagctagaaagtaataaagcaatatatctgccattattaaatatgatagggtgtctctttagaaagcctcaaaggattcacagattgattattaaattatttaaaatctaacatgattgctaaatacaaaagtcaacatacaaaattcaacagtatttgtttacagtagagcaattgtttagaaaagcagttcaggaaaaaaaaaattaaaatagcaggctagatgtagtggctcatgcttgtcatcttagcactttgggaggccaggacaggaggattgcttgaggccaggagtttgagaccagccttggcaatatagtgagaccccatctctacaaaaaattaaaaacaattagccaggcatgatggcacatgcctatagtcctacctactcaagaggctgaaacaagaggattgcctgagcccagggattcaagggtgcagtgagctatgattgtaccactgcactcagcccaggcaacagagcaagaccctgtctctaaataattaattaattagttgataaaatagcaacccaaaacatgaaatactaaggagtaaatctaacaaaaaatgtgcaagcctcttttgaggaaaattataatcaagaatattataatagtaaagaagatttaaataaattatcaaggtcttaaattggaatgtacactattaggtgccgattcttcctaaattcatctgtagattgacatttcaataaaaattctgttagtgtatttgtaatgctaattataaaatttccataaaagacaagtctcacaataaccaagatacttccaaagaaatacaaggtgaaaagatttgcctaatcagatatcaagatttaatataaagccatattaattaagaaattgtgagataggtgtagagatagatttatagatcagtggaacttaatgacccagaaacagatccagccatatatgaaaacttattttatgatagaggaggcattgtagatcatggggaaaggatagatttttttttttttcaataaatgataccagcacaatgggttattcatttaaaaaaaaaaaaagaggaaagaaagaaatggaatccctatcttatgcctatacacaaaaatcaattcccgataaagacttaaatatgtactaaagaggtgaagctgttaaatggttaggagaatatcgttataacctcaggataggaagattttgttgtataagacacagcaagtacaaactacaaaagaaaagattgattacttaaactccactcaagaacttctgttcatcaaaatacgtcataaggagtctgaaaagcctgtaatcctagcactttcggaggccaaggccggcagattgcttgagcccaggagttcgagaccagcctgggcaacatagcaagaccccgtctctaaaaaaatacaaaaattagccaggtgtagtgttatgtgcctgtagtcctagcttcttgggaggctcaggttggaggattgcctgagcctggggaggtcgaggctgtagtgagctgtgattgcatcactgcactccagccccgttgacagagcaggacacagtctccaaaaaaagagactgaaaatataagctacaaagtgtgagaagatatttacaaaatatatacctaaaaaataattagaagtatctagagaattggtatgaatcatcaagttaaagacatcctaatagagaaatgggcaaaagatatagaaagatattttacagaagaagaagtacaaataatttataaacttacacaaagatgctcaatcccatttgtaattagaggcatataaaccaaaaccacaatgagagtggcaaaaatttaaaagtcacatcatcatcttcattgcttctgtacatggaagtacaaattggtatataccactttggtaacagttggtcagtacctaataaagttgaacttatttgtattctttaacctagtaattttactcctagaaaatatactttagagaaactattacacatgtttactaggatacatatacaggagtatttgtgacagcactgttcataatcttaaaaaagacaagaaacaatctaaatatacataggtagagtggatcattgaagtctggtatattcctaccatggattactatgcagcagtgaaaatggatgcaccaaggcatacactgaacaaaaggatgaatctcaaaaatacaatgttaaggaaaagaaatggtacagtgattccatttttttcaggttcaaaaaccaggaaaattaagctatacatacattggtgataaaagttaagaaaaacaaaagaataattaacataaaattcagcttagtagttgtttctgaggaggggtacgcaggggtcttcaaagatactagagatgttctattaaaatgtaatggctttaaaataacacatgggtgtttatttcaactgataccatatattctatatattcttctgtatatatatttcataattaaactgttttgttttgttttttgtttggtgtgtgttctttttttgttgagatgaagtctcactctgacacccaagctggagtgcagtggtgcaatctctgctcactgcaacttctgcctcctgggttcaagcaattcttctgcctcagcctgctgtgtagctgggattataggtgtgtaccaccatgcctggctaatttttgtatttttagtagagatggggtttcaccctgttggccagcctggtctcaaatgtctgacctcaagtgatccacccgccttggctgcccaaagtgctgggattacaagggtgagccaccgcacccagccaattaagtgtttttaaaaaagagtgtcttggtatgcaggatcttcaaagtaaaaaaaaaaaaaacaagaaagtatcattgctttctttctgttaatgtctcccctcaccccgggtaaatgtgttctttttatttcccctggtcctattgccaaagtttatttgtgttgtcacttcaaagctaagtcttggtagagaaaaatattaatgcagaacagctaatttttaaacagcttcccttttggtctaaatgtgtcttttatgaaattggcagctctctcgatattgtagtccattgtttttcaaatataattttatttggaaaaaaattgcttatgtcaatctctaatatttagaataattaaaagcctggttacactggtccagtgtactcagtgttctaggaaaccatgataatgcagtttgaacgtcactgttctggtttgtaacttaacgtggaatctgaactgaggtgataatcctttactgttttcatgatttcataaaattctgacccttgagaatattcaaacactaattcctctttacttggaaatttaattctgaggtaagctgttttctaaagaactgaatattacttatatcccatggcagatatcactacagtgtaccagaggcttatgcttctgttgtaaaacatagctttcctactcagaactaacctgcccctggtggccttagggaaggcaagtgaaaatatgcataactttagtctccctacagaccttttgacttaatgcaaggttctccttgatctataccttgggttggatttggcgttcctaggcattgcttagctgtttcaaggactaacagaagaaaatgttgattccaggggtagcagtcacacttctcatggatattgctaagtttggtgtggttttattttttgagctaaaactgttcctactgattagggtcaactattttctgcaagtcaaacatggaatcagaatctcaagctctgggggagaccttaaagatcatcaagtttaatgatatttacatttctttttaaacagaaatttctcgtctaaagaaatcatgagagagtttagagtaagactggggtttgagttattcccaatctttcagtctttaaggtacacccacctccccaatttttaaaaaatttaatgaaattgaggcccagagaggtaaaatgattttcccaggagcacacagtaaattgctaatagaactaggccttgaacccagatcttatatccaaattgcctgactcctagtccagtgttccttttactaaatcacattgccagtttctgtacaaatccatccaagaaaatccttatgatgtttcttctcactgctcgtctcataaattatagacagtacaaaacaaatagcatgtaaatgtgaacatttatacatgggtgagaaccagttcttttcatggtgtgcaggtcactatgacaaatgtgtattcgccctccgagaagagaataaaagtgacatgaacactgtactgaactacatcttctctcacgctcaagtcaccaagaagaatcttctggtcacaatgcttattgtgagtaccatttttcagaacttgtaaagaccgtcaatgatatgcaaaaagtatttttttccttttgatggctatggccagagaaaaaaaactactgccttttataattatgggatgaatggggcttgagctgtggattaacagtttctcacgtctacctttgtccttggtctgaaggaacctgctttagtgagaaaatgactcttctggccattatgcatatactcattcacaggaacttatacctcctaactctgtttagaaatgcctcgtgcttcaccattcctgtggtcatcatgacagcagctttaaaatttcatcttatttagccaatatattctaattttaactcttgttccatagatacaagcaatggctctcatgtcaaacttgaaaaaaaataaatagaaatccagcactccccctctctgaccagagaaatttaaatgtattctgcatcttcattggtccctttttatttacattgaaaatctaagctcggattattgtattggtagtaaatgtatgatttttttccctataacttagtaaaataagaattagtaggaagtaggaatagggagtgagcctggtaagtttgatgagagctaatgtgcattcagccagtgggtggaatttttgtgggctgaaggatttttaaagatgacttgcaagtccttcactcctagctcattctggttgagttagttgtaggaattagtacagtaggactactcctagagtccctcaccccatggtcctgagcatttgccttgctgctgcatgcctgtctttttggggactgtagtgccttttcactcctagagttttctttttgtctctttgtggaattgggattcttggtaagttaattacatcattttttcatggaggaaaaaaacatacatcttcatgctattttttatttcttcagaatgaagggaaactatctaccatacacctctgattaacaagagtgccactcattcagttatatgcctagctggttaactctaaagcgtatcacattttttagaatagccactttaaaaaatatgtaattatagggagagttcattgcctttgctaccctagaatagctagatggtagggaaacgagaaagatgcagttgagagggaaaaatatatatgttagtacaatgtaatacttcaacttcccccaagtgacaggtttcagctaagaaatgatacaatctatggcagcttgctaattttttttgtcagtcaaaagaaggaagaaagactatttagatgttttttttaatttaatgaaaggattgttaaatctcatttggataaagccaagactttctgtcagaaaagggtaatgatgaggagggtaggagaatctgtcagtttggacctagaatggggtggaatttgcctttataggaagctaattatggtgagtttttctttttattgtgattacgtttttaagaacttaacagttttctgcactaaaaatagaccaaagcctagaatccttggagcagcggaagagtaatgattgtccaagactgtcgctgggtttcttaaattctaatttgtaagatataggggctcagctcgctccttttgcggagtgattgtaagtaacgcttgccttaagaatctcattattggaacacggagccatatttcctctgagaattctggagtagctttgagccagggctgttcatttctcaagtaatcacgctggtgtgatggagagagaaaatggcagctgttcggagctcaggccttcaattttcttcagagtccagtcactcaagtgtgtaattacgcggggggtgctgcagaggcgttgggccctgtcagagaactggtttgaggctttgctttctgcttttgccagtcaggacaggcagaagccaatgggactctgactttccacgctgttctttttttctcccaccttgtcatcctgattacttcttacctgcatggatagtacccagactttctttccaacaggctgagctctttagggaaaagagctgtttcagagtttgagtttgggtgaataggatggaggaggaggaggacaagggggatgggaagaggaggaggaggaggaggaggataaggacggttgaacatgtgaaccaggaagccagatttgtccctttctttattttggtgtcattacatttttctttaaaaaaaaaacaaaaacaaaatgagacccagtaaacataagaggatctctaagctttcatgtcattaatttcttttcaaatatcagttgttttcatttcatcttagagatttggaaatcaagaagttaatgatatgatcaagctcagggccagctagcagtgacttatggaacatgggtaaaagctcaagacggtgctcttttctgatctgatgttactgaatgccagacatgtcttcctcttttcctctttgacaacgcttagctgctcccccttccttcttcctctccctcctcctctcccacatctgcattaatggtagtagctggtaagagccattttggttgtttggattattctttcctcggatcttagtatcttttacagatgtcacctgcacatggtagcactttgactcccccagcttgtgttctctgctggttcccctttctttgcatatcttggcttcctgattgatggttatgtgcccagtattccattctctgctttctagaagtaggaatgttgatagtatgctttgctgagctagatgatgatttctggggcttttgaacctacagggagggaggtatcaagaaactcaggcttccgtgagtcaatgtcatgggatatgcgttgctctagtaaagaggtaccttcatcctctccaggtgttagcataacctgcccagtggtaacttgcctcatggactctcaagcagatttctggtaatctttcactctgtctggaaagcaaagtatcaggtaaaaggctaaagtcctatcaggtttcctccatttaaagggacattgtaacacaatttaacacaaagtctggaagaccaatagtacatttattttttgaaagctcttcttatttcttaaatttaactttataggaaaaagcttagaactcagaacattgtttatgtttgcttagagatatttaaggaactctttaatctttagccagattaagctaattggtacaaatacaaagtatcaacatcttcatagctgtctagatggcaatgtacatatcttctagccaccttgatggtaagtagtcttcccctcactacttgtaacttatttttgatacggtccacatgaacatgctataaaccatgcttctgtatgagtaatgccatgcctatgaacccctgatttggtttagatggggagaatttatgatgctgatcagcacctttccttcctccacttaacctgactgcaaataattttgtccaatatgtaaataaagaagaaaagtctttctcagtgattccacattcactgaataagggtgatattaacaattgttaaacttaccctatgacattttttgggatatcaaaaagtgcagatatgactagaagaagctaccagttcattgctgatcctgggtttagtgcctacccggctaaataatagttaatgtcttgagggcattacacataaggtcacattcttttcgttttgaattgccttctaagatcaagttggactatgttggtttcttctgtcagtcaactgtgtaactttggctatgctttttttttttttttttaaattaaagatgtggtctcactgtgttgcctgggctgctgtcaaacttctgtgctcaaacggtctcggcctcccatcttggcctcccaaaatgctgggactacaggcatgagccactgtgcccagccttggctatgggtttaacgttttatcatgtttgttgtatttctgcaaattcgaactatttcctatagttagctaccatctaggtcaaaagtaaaagcaagaaataactgttttgtaccagtatggctgaataataattttcacttcgttttatgactctggacagttggaacagacctttggttggtggattgggatgccagatttttgcaagtgacctgtaatcccaaaatcagcaggttggctctttaaacaaacctttttatgttgactaaacacatctgctgacctagacaccatctaaaggtatccttacaaaatgttcaccaggattagatggtgatgtttgtttgtccagttgcccaaaagaagcctgtctctaggacagagggtaataaacttcctgttggatgttagttggcatcttaagatgggtggttctgaaaaaccctgatgttttcttgcagaacctgaatgctgtgtctaggtcagggacaagacagggttgaggaagttattctatacataattttctgttgccaatttttttctaagtattaatgatgacagtggagaaaatatttgaatggaaaacttccaagtcagaatagactaacgaaaatagtggttaattcatactgtttgataattacttcacatttatttatttatttatctatttatttatttatttatttattttttgagatggagtttcgctcttattgcccaggctggagtgcaatggcgcgatcttggctcaccacaacctctgcctcctgggttcaagcgattctcctgcctcagcctcctgagtagctgggataacaggcatgcaccactgcacccagttaattttgtatttttagtagagacggggtttctccatgttggtcaggctggtctcgaacgcctgacctcaggtgatccacctaccttggcctcccaaaatgctgggattacaggtgtgagccaccgcacccggccttatttatttattttaattttattttattttattttattttgagacggaatttcactcttgttgcccaggctgtagtgcaatgacgcaatctcagctcactgcaacctccacctcctgggcaattctctggcctcagcctcccaagtagctgggattacaggcatgcgccaccacgcccagctaatttttttgtatttagtagagatggggtttcatcatgttggtcaggctggtctcgaactgacctcaggtaatccgcccacctcggcctcccaaagtgctgggattacaggcgtgagccaccacgcctggcccacatttattttttctaatctccatagttcgcttttcttacacatactgttgttttctcctgaagcccttttttactgcctttctctcatagtggaaagataaaataaaaaagtggtttttaaaaaaaagtgcttttacgtgttttgctttgttttgtcttttaagttagagcatgatctgtaactgccaggcgcagtggctcacacctgtaatcccagcactttgggaggccgaggcgggtggatcacaaggtcaggagatcgataccatcctggttaacacggtgaaaccccatctctactaaaaatacaaaaaattagccgggcatggtggcgggcgcctgtagtcccaggtactcgggaggctgaggcaggagaatggcgtgaaccccggaggcggagcttgcagtgagccaagattgcgccactgcactccagcctgcggaacagagagagactccgtcttaaaaacaaaacaaaacagaacaaaacatgatctgtaactatgcaagaggataactccatttttaaaaattttagtttcatctgtaaaggtaaacctatatttcttttaaagggaatgcattctatatcaaatctgatacaggttgcggaggtgattagtgtgcttttttttttttttgagacggagtctcgctctgttgcccaggctggagtgcagtggccggatctcggctcactgcaagctctgcctcccgggttcacaccattctcctgcctcagcctcccgagtagttgggactacaggcacccgccaccacgcccggctaatttttttgtatttttagtagagacgggtttcaaccgtgttctccaggatggtctcgatctcctgacctcgtgatccgccctcctcggcctcccaaagtgctgggattacaggcgtgagccaccgcgcctggccctagtgctcttattttgtcatgttggcttttgtttttaatgttgagactttagtctggctttgtacagaggagtcgagttgtggcattacccagtagacttcttatgtttttaggcattttggtgggtcattccaatgcttttagtaagtacttcggaaaggagtatgtttgctctattaagaacattaggaaagggacttaggtaggaaaaaattatgttggtttccctacctactgttatctgtcaattctttccttctgtctttctatggtcctgtttctggtagttttacatattcctttgaaattctgttttgctcattagttctcagcaaaaggtgagacttacttgcatttcctttctcctgtttgcttttatgcctaggataggtagaacagattctctaatctgtgctacctgttcaatagaacctctgggtttatcttcactttaatagcagcttttatttttctcactcagatgagtgaattatctgggtgaaatgggtgaaaacagtacttgcacttccttaattataactcccatcatatgttttatgactctggacagtcagagcagacctctgattggtggattagggaaccagaatctcattatatcattttctcaaaaaaaaaaaaaaaaaaaaaagggtttgagaaaccttcccagcataatggcattgagtatttcaaaagtatttaccttgtgatgtggaaggtaggggttttggaaaaagcatgtcttttatttatactgcatttatttatacttctgtgataaaggtctataaagagtatccctgagatggggaaggttaagtatgaaatagaaattcttcaagaaaagggctgataatcaaagtggggagattaacatgcagcaacaagcaggccctttgggtcttctttcatgtcccattggtagtagggggagaataaatatttattaaaatacaaaggcaattctttaaaaaaaattttttttttttttttttttgagacagagtctcgctctgttgcccaggctggagtgcagtggcacgatctcggctcactgcaaggtccacctcccgggttcacgccattctcctgcctcagcctcctgagtagctgggactacaggcgcccgccaccacgcccggctaattttttgtatttttagtagagacggggtttcaccgtgttagccaggatggtctcgacctcgtgatccgcacgcctcggcctcccaaagtgctgagattacaggcgtgagccacagcgcccggcctaaaaattttttgttttatttatttttattttttatttttagagatggggtctcaccatgttgcctaggctggtcttgaactcctgggctcaagcagtcctcctgtcttgacctcccaaaatgctggggttacaggtgtgagccaccctgcccagccaaggcaattatttaaaactccaagtagaggtagtgatatctaaatggatatattttatatggtgtggtgttaataattactactaccagtagctctgtaaagttcaaaaaggacagacatttataaaaactgcatttacatttttttcagcttagatggaaattgcatggataatggatgaatttagggaataaactgatattccactggactccagtaaggatatttctctcagaatatgattgagattattttcttaacattttttacttcttagaagaggaaggacccaatactgaataaaccatggattctatagtaggagcctgtttttttcctctaattcagctaaggattcacatgtttaagtatcatggaatgattcttggtacaggaagaagagaaatgatttgggatgcagaattgccagcatatgagatggtgttttagttagtgtgtgtttataaataaataatttattcttgtgtttctgttttgcatcctcctgggttgctgaaaatttggtttatgagatgaaaaccactggggtggttctttttgccttatatctaccttctttccaaaagtgggaggggaaacaggaaggcctttagtccctgttgtttaaaactttctcttaaaactttgagacatatctattatttcttactcagaatccccttggccccttttagtggtctctaatgattccttctgcgtgttaaaagtatagtgttgatttataaggaaatacattaggaattttgaatgagggatttgggctgcctctccttagccaaacttcctctgggatcttctttaccacattgtttagggtaaaaataataggaagtttgcattttcttattaatccagctgggtttactttgttttcattccttttctctattttaaaatcctatccacctgttctttttaatatgactatctatgttcttttttacattaacaattaggatcagttgtgtggccgggaccctactctcactgatgagctgctgaatattctcacagagctaactcaactcagtaagaccaccaatgccaaagtagcacttcgagcacgccaggtaaggacatttgttggttttcttaaaggagggatggctttcatagatcaggcagtcctagacacaatgaacttttgcttaatcactttacaaagaacatgttattttctatatatgtgtcacgttttcctcagaacaaatgttttcatgtggtatgtttttttaaagagaaaggaaaagattagtgctgcgtctctttaaaatagaagccctttccccattaaaaaatcctggtatcattcccttccctccctagtagccctgtgatagtaaaccagggtcaggtggaggaaaggacactcagggaagaaaatagactcagtatttcttacttcccaaagggagcttagaagcagatgaaaacttccaagtgtacaggaaataatcaagtgtggaaagcagaaagataatgaaatgaatcttaggcggcagcaatcagaacaaccccagagaagtccagttagtttcaccctgcagtcttcatttccattccaaaaggtttcagcagggaagccaagagttggcactccctttgtgtttcagtgcatgggcattgacaaggaagcagcatttgaagctgttcagtgaccttctgctttctctacaattgtatccatgtcactgaactactcaaagctattgaacctctcagtgacctgctgagggtattcagatcctaccgtgtcactgtttgtttgtttgtgacactgctttcactctctctgcccctcacacactctggtgttacttcctgacgcgttctccttggtgccgagtacctggggctgtcaaagcagctttccctagtctttctttctacttcagagttgtaaaaggctagctctgctgcatctacctttcccacagctgctccctgccagacctgattcccaattaacagctagtcatgcagtccctaggaccagcagctttgcaatggtaaatcacatacactgatggaacttgatcgaagctgttttctctcccttccccctacccaccatgggaaattggccacaatgcaaatcatggtgagagtcaactgagattcagtatttggtggcactggctttatgttacaggacctagaagttgttttacttggtctctgttttatctgtgatgcctgcacttacagatttatatttattgcttttgtatcagagctgcctaataggagtctagaataatcactccgaggaatgtgtgcctcctattttgttctcactctaggttcttattgcctcccatttgccatcatatgagcttcgccataaccaagtagagtctatcttcctatcagctattgacatgtatggacatcaattttgcattgagaacctgcaggtatatatatatatatatatatataaccctttcctgcctatctggactcttacctcctttattctcaagcatagtttaagtaattagtcacttaattaattaattttgattttccatataatggagtttcatatcttgactttctaaaatgatttatacttatgaatatttttttcatacaaatgctgttagaattgtggtttagcttaaaaatcaaataggcctgccttgatagaagtgtcctattgaagtctttatctttgtactttacctagaaagtattctaggccagaattaaatgacaaggctggttgatttctgatatatatatatatatacacacacacatttctctgatgatttatgatatttgaatcagatgtatacataggtagttgttactcttctggagacaaagctatttaagtatcatttaattttaattttatgttaatgcttattattaagctttataagaagcccgtttttaagagattattgtctaattttactactaatcagaaggaccaccgcaattattttttaaatgttatcttctcaggaatgactttatatttttctacctggaaacaaggataccattgttatatctggcccaggggaatctttagactttctgtaacatttcttcctggggaatctagaggggaaaaaaggatgttttttcttatttggttaatagctgaaatctagggtttcaactggagttcaaatctagggtttaccatagtggagtattgagacaatatttattttatttaatttttctgagacagagtctcactctgttgcccaggctggagtgcagtggcataatctcggctcactgcagcctccacctcctgagttcaagcgattcttgtgccttggcctccagagtagctgggattacaggcactcactaccacgcctggctaatttttgtatttttaacagagacagggtttcgccatgttggccaggctggtctcgaactcctgacctcaagtgatctgcccgccttggcctcctaaagtgctgggattataggcgtgagccaccatgcctggtgaagacaatatttagagagttcagataaatgtcagaaaagaataacagtcataaacacttatattagcatacaaataatgcattgttaattcagtattccaagaattttacatgtatttactcatataatacaacagccctatgaggataggtattttattttctccattttgtagctcaggaagctgaggcacagagagattatggcattcagagacaaaattcttaggtttcactaaatgcttcaaatgccaaatagtgtccattgaaattgttctccttttgatgtaaggcttaagcctgtctttgtatcttctagaaactcatcctatcagaaacatctatttttgatgtcctaccaaacttcttctatcacagcaaccaagtagtgaggatggcagctctggaggtaagtatttatggtaatgggacatgaccttttcctttgtttctagctggtttcttctgtctatttggctgccatgtcagttctagttctctggccttaaggttggttcttaagggtagttagtctcttttcctctgaaacagtatgtgcttactcagatactttactcaagtgtttcatctgaactcatcaccagcttctaggttccaatcacaggaaaatagctgccagcatttttcagtagtttctattttccaggtatttgaattctcccatttcataatgaattaggattccttgtaacacaaaaagcgaaaatatatggctgatcagagcatgtgtcatcttaccattgtgtgatttgggccaaattaaaattgattttagttatgtttggattgtcaagcagctcttatgaaatacttcctcaaaggaaagaaagtaatagcatttaatgaactgtgttttaggtattttatctttctcatttaatcctacagttactttaggaagtaagaagaaagtgagactctgagaggttaagtgatttgtccaaaatcacatagataataagtggaagagtttgcatttgaactcaggctaatctgactccaaagacttctgtttccgctacagcacactacctcattaagcacaaaaattgcaggccctgaataccactgtaaagttgccaaatagttgttttttgaagatggggaaaaagagtgttttagatgattttatgtaatgtaacatcacggtagtctgttgccagctcttttgtgttactttttatttgtactctgtggtagagtgtaaattatcctactcagtaaatgccaaaagttttaaaacatttaagtgttttgtagtgtttttatgtcatttaatgagaagcttccttatatacttcccgtgccatagaatctcaggtagcattttatgtgcatggcaaatttgctgtgaaatgtgtgaggttggactgacagtttttgcagagatgtagcctattgctgtttctttttttaatttatatttatttttattttatttcattgctgttcctttaactcttgagtcaagttcaagtatttgagatattatatgtcaaattatgtcttactgcttatgccttactgcttttgatcagagtttgctgaaaactgattttgagcgggtggggaagtcggggaggacgcaagacaaagacatgagatagtaaaagagttgaactgtactgtgattgcttgtgtcttctattttcactctgtaagtggctcaaaatcagcacctctcatttttctcactgcttaatcttctgttgaaatgatcatgcttaatagattaatagttgtagttctatatgctgtcttttgctaaagattaaaccttctccagggtttaggttagtgtggaagaaggtttacagtgcacataggtgtccagcagaggcagcctagttttgttttcattagtagtcatggttatagtattaagactccagctttattaattaaagcaatatatgtacgtatacatagggccttgggacttctctccccacagagcaccttctgcctcagatacctcgtttcaagactctttttctgggctattttcttaatttctgtttttgaaatttatttactgagggtttcttttgaaccaggtgtatgttcgaagggcttatattgcctatgaacttaacagcgtacaacaccgccagcttaaggacaacacctgtgtggtggaattccagttcatgctgcccacatctcatccaaacaggtgagtttgaggtggtatgtgcacccgagccagccagaggtataccatgagaatcaaggggagtaatgtgtatgacaattccatgtttttttagttagaaatgtagggcaaaaaatgaacaatatgaaccaaaagagaagagccttttggtgcccacttctttgatctaaagagaaaaattatggtctaagtaagatgaaagtttaggattactccattcattcttgcttgtattatgtcactgaggaaatagtttctttcttttttaaaaaattagaaagaatttactagcattttacttgctagaactttgccagaaaaatcactctttttaacaatttaaatcagcaattagaccaaaaaaatactttgggtggaatgcttttcttttctatatgtttgctatgggttgaggttatatctgagccagtttcattatctccctaaaacagaccacctgaatttagcagttgaaattcaatcagtttttaaaaattacattgcagaaccaaacttcttaatctcaaataaattactgaattaagccatgataattacattatttgtcccttcctgtcttttaaaaaataaaatgtacatatggacgtttttgtttcagaattgcttttgttttaaaatgaaaatactttatcttatagactatcttttaaaaagtattctaaggcaatgaaaatctaggaattccacccacacataggttcatcccctcctgtactttcattctttttagtaataccacaggaaatataaataccacagccaatcttaacctgcccctctccatttcttctttatggcctttggttcttcacttggtattacaaagtactgtgtcttttgggaaccttagttatagacaccagaaatggttttgttctaaattgccacttcacccaaagcaatagaaaccctttctggagacaaagaagtctgtgctgagacttttggccactggatgccactgttgatccagcagaggtcggcagatgagcagaggcatcttcagaaaaagtacctctcttctttgtctcagaatatcctttcacttctctacctcaaaaataccttatggctggcagagaaaagcatatatccttgatttagcaagcatctctcggtacatttttgcctccatggatttcagaatctcattttctagaaacgaatggttgtccttcagtgagcggcgaagtactcatggcacacataggcacagcactcagtcttctttcttttcctgcattccttgaataattgtagagaactacacgctgtacttaatgctctttgtaattctcagggcagttctccttttcttcctgctttttcctgcttccctttgggcagtgatttgtagtcaggctgcagggctgcttctgatttccttccctcctcatcactctccttgtctctcttaattgttctccctgtcctacttttttttatttgaggatatgtccagtttggtgagggaatgttggctgaaaaatgagagaaattcttcttgactgctttgttaagaaatcttattcacctttctatgtcaagagtatgaatcttggttagttcaatgtggttacaaaacttatatgccagtccctcccaacatctggacatgcctgtagataaagatcagacttgaacataacagtaatcctgtaatctccctgaagtctcccttggttgtcagtgtaattctaaacctgctggattattattgttattgtcatcattattattggtataactgtgaaggtgaagataattgcaaaataaaaaggaaaaataaaatcatctttgtgaaaaccagaaaaatgttaaaatttctttaattttttttttgatctaaagttctgtttaggatcaaatgatcaggtttgatcataaaatgatgtattcagtttcagagtatagcttgttcagttattgcagatttactacttgaatttagttttataagattatatacataatatattataatatatgaaaaatgtgttttttatatatataatatatatgaaaaatatgttttttatatatataaaatatatttttcccccaaatgtttttgttaaaatttggatttataaccttattatgacaccagctggtgtactgcaattgaattctgacactagccatctgaagttagatcagatgccacaggctaagggctcagtccaccaccaaattgtccctacttcagatggggccataagtggggtcccctggccacttgcacttctgaccaactggctacaaatttgagggtcccctcaattttctcagtttgataattccctcagaacaactcacagagttcaagcactacagttttattgtcaggatcagccaaaagcacgagacgcttagggtgaagtgtgggatggtctcaaacacagagcttcccagtttgttccctgtggaatcagagtttatcaaccctctcagcacatccatgtgttcaccaaccaagaagctccattgaccttcagtgtccagagtattttaaaatcagggcttcattacgtaggcatgcttgattaaatcatagcctacgtgattaaactcaatctcccctcccagaggtctggctggctgaaagccctcaaccttctaatcacacagttggtctttctagtgaccagctcccctcctgagtcatctcatctcttagcataaactcaggtgtgatccaagggacttaaaataacaatgacactcctattacttgggaaattataaggatttagtctctcttccaggaaccagagacaatggccaaagtctttattatacaataggcctgctcatcttaaacagaaatctaagctcttttagatttagctagttttgagccaagtacttttcttctttttctaactccagtactttttttgtatgttattgttttgatcaagcaggcgaaaagcatattgtttctcattctacagaaagaagttacagagggctaccaatatttgttccactctgtcctgtaaggctcagttatgtccactaacctctagattaatgattctcaaaattatctgaggggtaatttgaaaatacacatattggagtcctgactttcaagacccgattcattttggattagagtccaggtgaccactttgaaaagctcctctgaactctgatgaacagctataattgacagttactacttctaaaccagtactgtcaaatagaaatataatacaagctacatgctatttaaaattttctattggccacatttaaaagtaaaaagaaacagataaaattaattcaaataacatcttatttaacccattatatccaaaataccatttcaatatgtaataacaattgttaatattttttcttttattcatactgtatctttgaaatttagcacgtattctatacttacagcatatctcaatataaactagccgtatttcaagtactaccctagctgcatgtggctaatggctgctatattagacagttcaacttagaccaaaaattaattaggacagtcacactgagccctctttttttttttttttttttgtgttactggtagtgcccgtggagagaggaaaaattattattcttatgttgcttattcttagtagttacaggaattattcacagttgatattatagatgttacactacaatattttatgcatgctttaaaaatcagtgagaataaagaaaaggtatatgaatcatacatattttacttatcaatataaaacagaattttatatttttcccaattgaggttaacaaaccaatttttttttcccctcccatagagatggggtcttgtcatgttcccaggctggtctcaaataattctcctgcttcagcctctcaagtagctgggactacaggcatgtgccaccatacctagtacagaccaaaaattattgggggagaaaacaggtttttttttttgtttgttttttttttttttttttgagatggagtctcactctgtcgcccaggctggagtgcagtggcgcgatctgggctcactgcaagctctgcctcctgggttcaagcgattatcctgcctcagcctcccgagtagctgggactacaggtgcctgccatgatgcccggctaattttttgtatttttaatagagacggggtttcaccgtgttagccaggatggtctcgatctcattaccttgtgatccgtctacctcggcctcccaaagtgctgggattacaggcatgagccacagtattttgtttaaccaattttttgtgttttctttccttgcacttggtcttcacattcctagctaggtgtttttgaagtagacaaaatttgtccagcacatcgttagaagtgtcttagtaagctgtaatatcaaagcaagactgcaatctcattgtgtatggaattccattcctgcagcttttttttttttttttttttttttgagatagagtttgctcttgttgcccaggctggagtgcagtggtgctatcttggctcaacacaacctctgccttccaggttcaagcgattctcctgcctcagcctcccgattagctgggattacaggcgtacaccaccacaccccactaattttgattttttagtaaagacggggtttctccgtgttggtcaggctgtctccaacaccctaactcaggtgatctacctgcctcggcctcccaaagtgctgggattacgagcgtgagccactgcacctgcccttgtttttaactcctcttactataattcccagtcacgcagtttgtttttgactgtgatttagcctccataggttggggtgaaacacggcactctgtctgcaaactggcagcagagttttttttgtttttgtttttgtttttttttttattcaggaaaatcccttagttgctgttgggattgaagacctgtatcttacttattaggacctattttgatttttagagaagtaggcaaaatatattgcaaatgactaggggagcctctgaaaagggagaagacacctgtttttagcacacttgaacagttgctttgtagtaacatatttggtacatttttgtttttcttttaattcatcataggactttgcattgtttgacatgttgcggttactctgttttttggtataattcgactatttttagaaaaaaaaactccaataatttttttaaaaagcagattactaaatagtttattcctaatctgtgtgacttcctatttcatttcttgctaggtgtgcatcagtcgaggtatattatctcctttttgatcttctacccaagacttctaaattttttttctggggactgtagttccaacttatttggcatctgtaggtcttattcagcagaggatccagttattagaacttcactcaggcaagcttctggtctggatttaccctttacttctaaaatttccttcacttgaacagcagctaaagagatttttctgatttaagcatagttagaaacatatatatatatatatatacacacacacacacacacacacacatgtgtgtgtatgtatatgtaacgtgtatggggtgtgtgtgtgtgtgtgtgtgtgtgtgtgtttccttttttaccttcttagcattaaaggctgtgtgattctttttgaggggaggggattttttttttttaatgtgtcattttttaactgacttgtgttcttgaaggagaagtgactatctcaagttgttttcatggtgcaggaatattcagggcaactagtctatactaagggagcattttattattgtgcagacttctagaacctaattctctcattgaagattctgtgagcccagccctttagtgagttttacatgaattaaccctggagttcaaactatatcattgaatattcctttttctccttctttccctagtgagtcttagggtttagagcccaagttttgtatatgtctgtcttttttcctattcagaaacttaagtatcactcactggtgctggtgatgggaaagcttgttacactgaagcatcatcctgaatgtctgtattttgcacaattcattgactcatttgaccttcaggatttcactaagctttgggcatattaagtgcctcaggataatctggaaacaaattcttcagtcaactagtatttgatcttttaaaatatagttatatttatacaaacatatgtaaagtatattatcccataaattgtgcctatacatatgactctgtataatataatatgacagtctgggagtacacaatttaaaactccaaatgatttttataattaatatacgctagtgaacatgagtaatctttttaacctttactctgtgattcaaataagaagcatcacatttgatgcaggagatggaggtgtactttgttgtacgtttctgtacatatataatgggtgaggacctattggtgtttatttccacctatttcatagatggaaatccatgctttagttaagtcggattccactgtaccttctctgctgtttgctacttgtgaatttggccttctgtgttataatgttttaattcaaatacttcccttttctcaagtcttacctccagaagaggtcggctgtgttttcccctgatagcatgtgttttggtcatggctgagtttaggctgcttggcatccatcctcaatgttcagctgtcagtgggcggcctctggactttttattcataaggaaggttagaaatcaggagccttccatgtgactaattggtagccaactgccattctcaagaattctgataatctttaacacccagagattagacctttctttggatagtactgagatactcagaagtcatccaacttgtagcattgtttctgcagtgggagcacttgttgtagttagcaagccagaatgagctataaataaatgaaatcttacagtgcttgcttccttcattcagggtagtctgctgataagatgcaagtatctggcagaagagaagattctcagcaggtttaagtgcttaccaaagtgctttcctgtatccgtggctcagcttctagtctctgctgtgttattttggcactctagacttgtaagattggagagttgagtttaaaactctcaatatatcattagggtagcccaaggtcccttcttgtcaaggaagactagctgagtcctgggggaaggaaaagcagaatccaggacacctgtaaatccccgtagttttgtgctgtgggttcgtagctaattatatagcaggcaacagtaatatgctgtagctctgttgatgtacttgtttcagaaagagcaaaaccttccagcagagcaaagaaggggctttggaggggctgcaaatgaatgaagtaatgatcattttattgtaaactaaagctctgcagtagactcagggcatctgaactgcaaggaggtggtgggggagatgccagtagaaatacgtggttcagatgtgttttacagttcttgatttggattttcctgcagaaatatagtcatgcaaagagaccaccactggtcacagccagtcaaattgctctttctcctatggtactgctgttagtggctgctagtaggttattcagccgacctcttctgattctgctttgctgcctgatttcaaaagagttgccctatactggctttcagtcacagcttgatgtaaccactgcttgtttgcatgcatccccatcattttcatatgggctcttttttttttcttcttcaagttaggaagcaaaagaatcaggagcatttttatatgataaaagatttatataaggccagctagaatcaagccaaatgaaattcagctggaagggatggtaaaaaggctcacagaacttgtggctgccagagaagtcagtgttctttaaattaaagagggttcagctagcaggcggcaactctgactttgcattcatattgaagcaagctctccagccattctgggcaggcagagcaataaaatcagaggtgacttagtgccgggaacctcagaattcacaggatttctcttgtctttctctaaaatctatactgatgtggaatgctaacttggagagcggagataagaaaatgccaagtctagattgtggtttatgacaccatattgaacaatgtcattggaaagcatcctctttggttttttggttatcacatctgtaaaatggagctaatctactagaaagaaagtggttctaatattcatcaaatgttgtaaatgaagattcattataataagtgttttgaatagcccaaacagcagataggaagtgaatttatgtcccatttatgtatttgaaaatatacttgattgccttatcaaagattgagcaattttactttttttttttttttttttttgagacttactttgtcacccaggctggagtacagtggcatgatcttggctcactgcaacctcagcctcctggctcaagcgatccttccacctcaaccttcggagtagctaggattacaggtgtactgtgtgccaccacacctggctaacttttatatttgtgtgcgtgtgtgtgtgtatgtgtgtgtgtgtgtgtgtaaagatggattttggagatgttgcctgggctggtcttaaactcctgggctcaagtgatccacccacctcagtctcccaaagcgctggaattataggcatgagccactgcgcccggcctaatttgactatttttgcgtgatgagtatgcagtggaatgtggcaaattttattttcagctacataaatggaatatttgactcgtatacaatctcttcccttagttgtgtgtgtggcttttttttttttttggtacagagtgttaatctagctttctggtgtatcacagtagtgtgcgatatgccacatttgtcatattcttaaattgaccatatagcccttgtataggatgaaaaatttgtagtggccaggtttgctggctcatgcctataatcctagcactttgggaggctgagataggaggatcacttgagctcaggagttcaagactagcctgggcaacatagtgggaccttgtctctatttcttaaaaaaagaaaaagaaaaaaaaaaagaaaacatgtaaatgatcattatggacatgaccaaatatttatctgttaatagacagtttatccttccttccttccttgcttatctcccttacatccccacagattcttattctacctaagtggataagctggctctaaacctacttacatgattgatttgggaccattcctttaaaaattagagatgttgggagtttttgctttttgacccatactgtgtagatggtgcataattcttataacaaagcagcagggggctctctgtaggagcttgagagttgctgatggagaaagcctggctttttgttgttattggtgttcttttcagttcgggcctttttctactgaaaacatggccgtcatcctgtgaagactcccaaagggattagaatgtagctacagaagcagttagattattttattagattaggaaatttgttaacagttgagagagattatactggtttctaaactctagaaacctggatgaatggaacctgaggtttctttggttgtagagttctctctgaactgagattcatgctaagaaactgtgcaggcggcccctttctttagcatcctttatatcgtaaaaggaaaactattctcattagcatctgcagttagttttctgttcagctgtacctccctctgttctagaacctgtgcctattttttctgtattgttgaggcccaagtgcattataactaaggatctcttgtaaaaataaaacccactctcctgagtgagaggcttaaggaatccaaacagcaaaggttcaggtttctgcactcagaggttgctcttgctgtcttatgaattcactctgtgatacaggtttgatgcaaagagcatttctactcacaaatcacatgaggtatacagtttgtgtgcagtgatatgtcacagctttttatttatatggcctgctcagtctattctgctccttctactgccatggaaagtgcatcgttttcctccctctatcttcctttccacatatcatcagcaccacccactatgttctgcccattaagtcctctgtgtgctagaaaaccccaacagtgattaaatgctgataaaagaatgttagaaggttaagatatcaaccgatcagcccccttacaatgcccctaaattgtaggtggtaagtataactttgcccatttaacattgaaaataaaggtttttatttgtttgattatttttcagttggggaaatcttttaaaaggagttagtggcaaaggccaaagagaatgtgggagatgtgccttgtagtttcctattcttatcgtggtctttctttcatgatttggcacattctttataaggaagttctgtggtagtcaaatttagataaggttttatttatgagaggcctagagtttttaagctaacagcaatttttaaaatcattatgaccctaaactcatttaattacaaagtattaattaattttaacaacttatcatagaatcatttatcattactttcctgcatgattttcagttcttttaagctcctagaatacagtaccttcccccctgctctccttcatgggaggaagagtatggttaaaaagacttagagcaggtagctgggaacccagattcctggatacttttctttggtggagaatttgtaggtctgtcacatatcctggataagcgattaaagtaggaggagctgtggaatcaacttccctggacctccttattacaccttcagtaataggaacaagaaagaagagtctctaagaatcctgtgaagaattatatttcttattgaagcttgagttaatataccatatcatatagcttaaattaattttcatcagcctgtgttttaccactactctaaatttttttttttttttttttttttttggtaatagagctatttttaaaatccatggtaaatacattttgaccctttccatcaacagctggtgtggtgaggtaggttaggagcatgcctctttggaggtatcctgggggttgaagggtaatgagcacttaattatgtctgctgaatgccagagctgccaaactggagctcctcatgactggtctatatctgctctgacaattcttttattatggctttcactaacttatcagtaactaactgtggttgtttaattacagagggaacatccctacgctaaacaggtaccgtatgtttagtttcttttccaattaaaagcacctttatgtaacttagaatagtgaaaccaggaaaaaaaaaaccacaacacttgacaagataatgtgttatctgctagggagtcctgagctcccctttggacatactaaattattctttctgtttggaaaacatggcttcagcttttcttcagctgttcaaaaagcactacttgaaaagcctcagtatggagaagctcccatctagctgtatatgatagggggtttatctgccttatgtccggccttgctagcaacatcttcttttgctaagttctctgtgtagtttggggctttcagaggagaaacccttaaggttactcctatcctggcaaattattcacagtttttacaatttttagtttctctaatttgcttctccttttagaggagtgcagatccagaaatagctgatctcatgttttatcagtttgttagttaattttctaaagtgttaaaatgttatgatagtcagtttttatttcagacctataataagattaacattggaaaagtatatttaagttttgatgtgtttaaccctgtgtggaggtttccaggctaatataacataagtgatattttagtattttgggtttctcctgtctcttgaaccaagcaaggcaacacaatgcaagtttgagaggataacaattctgattggaattgaatccacaaaatgcaaaagcaatagtaagttgatggcaaggtctttgcagataatcagctacacgtggaactatttatagatttacatttattttgtccctctccctttaaaatattaagtaatcaagactaatcatagcttttagatcccaatttggatgtggagaggaaagggaatgcttttaattggtcttgtagtcttcccttggtgagtgggcttggctcattcctgcctgcctttagccaccctggttcacaagcatagcagtgaggggaaactgaatagtcgatatttcccatggggttcagttgagtgaaaaagctacttaaccccatggttgccacaaacatagtttgttaacttcttcagagggagttccctttaaatgtggtctggaacccttttatctttcctgtctaatgccaagcaagtagaaaagatacaatgcctcacaaacttgcttttttagtaaatatatttggtgatcctagaaaagaggaggatgatagcacttctgtggtaatacaactctgaatcccagtttctagtgagcaccatgtgtaagacttgcttgatgtgtgtttcatttgtttgtttcattcattgtatcaatggtttcctctcccactttgccttctactcccaagtactgtcaaaagatgatgtaccttttccatagtcatcactcgccaaaggaataaaaacctggagtgtcagtctctatagtctgtgtgagcagcactcccatcctacaaagaattccattgccttgtaattatgatttgcgatagggtacaatatgtacccagatatcaagtccacgttgtcgtctctcttccccctgcaacaccgcaggtggtgtacttcaaggagatttttggggcagttccccaaattcaagtgccattgccttgccctgaacttgcttcagatcagtatgctggtaacatgtcaggcaagtcctggaggcatcctttagcttggtccttcctaacaggctgtcctgattgagcattcagaaacactttacagtattatttatcagtacatactgttaaggtacatcaagaaatatagagattcattgtttttagattgagcaaatcagttcagttctcttcaggcatctccgtttagcagctgcttgtcatgcttacacatactttgagacccatgctctgcccttttgtatcttgctggaaattattaagggctttcaatggagatttttttgttttggtatagaagtgcttaactatgaaaagaaaaacgtgcaatttggggttgaaaaatagctctctttcaaaaagggagaactgtaaccccaataactatgcctaccaacccattaaaggagaaagtaaattcctcagtaaagttccttttatagactgtgacctgtttctgtaccctaatgttttatataattatttactaaaccattccaggtgacttaattacaattgttgttttacatacatatatatacctatctctttatgtatctgtgaatacttactctattacagttcctagaaaacaaaatgccttaagcattgcatagttacaactcacttggcttgcttacttccttttaaaggagggaatgctttagggagggggaagatgcaggatggtttttaacccctatgtgctattcattcattggacatcttataatgtaattgtgttaaaactgcctggaaattcctaacagttcttagctttttatttgaagaaattttggagtgatgaaaatatagtttatttagggaaattcaaaagaaagggttaacatgaatccagcaaaacaaccttatccatagtgggtaaaaaaaccaaatctgctctgcaacctgaccctacttcagagttttctcctagttccttttccctactgttactttcccagtccttgctcctaccctccttgtctaatgaacgtgattgaattaccatttagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggtaagacattgtggaactatgtctgtacaaggggagccatggacatctgtgttttggggtctcatctttctgcaaaatgaataaaggtctcccgaatagccatgagccagctaaaaagatgtaacccttgctgtatatgccgttggagaggtatatatccttgcatttctacctctcattcagattctacaagcctctacttgtagtatgggcctggtcagaaaaaaagaaacaaacaaaaaccatcttttcctgtggagctaacagaagaagctgtctgctctgtgatgagtgaaatgtcaggagaaattaaacataacactagagtgagccccacaagagacaatacatcttttgattaaatgcattcagcatctatctcttgatgtatactgatgcattaccctagggggaggggtaattacattggtctgtcactactccagttccagacactttctgttactttaagaccgatgatgacagaagtgctcatatcttacatatgaggaaaacaaaacaaacaaaaaagctttagatcattctttctaaaaaagaaaaaatatatatggtttattaaagtttaaacaatccatcctcctaatttctgccacttggtgaaattttgcatgtcacctctagccactggtgattctgttcaattaactattgagcccaggctaagatagattattcttttagactcagctgccaatggcagtgttagtttcatgccacttgagttttcatggtgggtgtttctcttgtattttttaggatctttgatgaagtgatgggctgcttctctgactccccaccccagagtcccacattccctgaggcaggtcacacgtctctttatgatgaggataaggtataatgtcccttttgggagactgctttgttcccctcagacatgggacttctactgtatactatctttctgactttgaactattataggaaagaattcatccttttaccccactttatagtatttaattttgtatgcctcaccaaagtattttctggaaacaagtggaatataaatcctaacttaaaaaaactatattaattttggagtccatagtatagagtgggctcagctatgtccattgcagctgcctctgaatctctgaatgttgttttaaggatttgggctttggttgctggaattcttactcagccatggcttatatttttgcatagtggtgcaatcatagtcctcagagaatggaggactttagattacagaaaaaaagtaggcattttgttgaaaactttgtctttttattaaatcatttctttttatttatcagtaaataaattattctttctctatgatgttattttttcatgatttgatacttccattgtttgataaattgtaaggaaatatattatgtgggaacatgtccagatggcttatatcactcattttccttcacattctgtgaagagatgtggcaaatagtttcacccccattttattggtaaaaaaggtgagacatagtgatcttcagcttcatgccaagtaaagattgggccacctgttactaatgcctctgctgccttatcttttaaaatttatatgctttacctgatttaatctctctgtggctattgggcagtggtttcaatttgctcattcctactgctgggcaaaccaaaatatcctgtggggtgtatctctttttcaggtattctaccaaatattataacttctatctgcatctgtattggccagcctcataatttctttgacttgtgttcttgagttacaggttcccagggatgaaccaattcacattctcaatgtggctatcaagactgactgtgatattgaggatgacaggctggcagctatgttcagagaatttacccagcaaaatgtaagttcttgattgggtggaagctcgtgatgtcccctttctactggctgtgtatcatagctatccttttatcagttgctagtttatggctatgtcttttatcataactctcagaactatggctagttctgcgtttagggataaaatcccaaagtgacttaataatatataatgaatatctttgtgtgtcaacagataatagacctcaaatatttaaaatgtttttaagggaagttatcttcctaaatctctcccagagctccagtcttgaacttcgaatcacctaccaagtattttcctttggtgactttccacatgtctaagcctaaactccccttaggtcccttctgtgtcttcccctcccctcctttgaaactatcagttatacatctatcctcctttcaattttacgtcacttggatatctcctgttgacatcaaacgccatcgtctaaatggacattttccatcattttgcttcacctcttctcgtccctctccaatcccctcataaaacaaaacaaaaaacctcacaactcactataccttttactcccaatcattcaaaagtcattgactttttccttgacattccttcattctacccctctacccacaatctgtacatatttatttgtatctggtcagtcaccaaggtctgttagtttttctttgcagtcttttttaccctttctctttttcttctttccagttttaaaattcccactgccatctctaattcaaacccttactatcttatacctgagacactgcagcaggcttacttgtgatctacttatcttccttcactttctccctccaaagagtttccattctgctcatcaccacaaaattaaatgtcccaaatgtgctcttaccatgttattttcccacttaacagtgattctctctgaccttcagaatacctccttaactttagcttcaacatcatcagcctattgagagactaacatgtagcctttgctattttgtgaaaagacctgtgttcattgtctaatgtgcctcatttattatacttctttgacttcctctttcctagaaagttttctttcacctttctttctaaatcttgtttgtcttaagaactgtctcaaatttcatctcttcagtgaggacttctgagtagccctaactaaaatgtatgttcctcctttgaattcctaattggtcagcatacatttattagcaataataatgccttttatttataaaaaaattctacctaaattttttatttgcatcttaccacgattccatggggttagataagtcaggaattgttccagttgtacacatgggcaaaagctggagctcagagaaattaagacccctaggtcaccagctagaagatgatagagcaaatactagaacttaaggatttgatgccaggtatagggggcacagatctaggtactttagtaaataatacattcttagccctgaagatgcttatagtctagttgaggggacaggataggcatgcttaaaacaataatctacagttatatttcattatgatatgtgatagatagcaaagtgtcctcttaaactgcccttgatggcaagacccatgtgttctcttggagtggacagcacttagcccatggacttcttgcagagaaagaactcagtagatgttttcaaaatttaattcagtggtgtagacagttcgtaccattggcattcacatcatgtaatgccaatggtagatatctaggggaaaaaatggtaaatttgtgatgactatgagtcttagtacttattccatgacggtgttgtagcacttaaactaactatgagattgcagtggtcagtatgaggaaaaggtgcttccagagaagtgaaagtaggggatatgcctagggctttttctgtagacagaaatttaccttccttcttgcccttggccagtgaccacataaaattaacctaaagccagtgatcaaggtaatctttgctggaagagtttttttgttttgttttgttttgttttgtttttttgagatggagtttcactcttgttgcccaggctggagtgcaatggtgcgatctcagctcacagcaacccccgcctcctgggttcaagtgattctcctgcctcagactcctgagtagctgggattacagacatgcgccaccacacccggctaatttttgtattttagtagagatggggtttctgcatgttggtcaggctggtcttaaactcccaacctcaggtgatctgcctgcctcggcctcccaaagtgctgggattacaagcgtgagccactgcgcccggcctggaagagtcttaatattatatgtggctgctgctgctgctgcttcatgaaataatctgtgaaagtttcttcctaggttttgaggcactaattgcccatgtttgagtatttttccataatttgaccacaacttgacacttcttgttgccctcaaatctaagtgtcatacttatcaacgcatgttgatctacaaagacattttcagccaggcgcagtggctcacgcctgtaatcccaacactttgggaggccaaggcgggcagatcacaaggtcaggagttcaagaccagcctggccaatatggtgaaaccccgtctctactgaaaatacaaaaattagccaggtgtggtggcgggcgcctgtagcgccagctactcgggtggctaaggcaagagaatcgcttgaacctgggggcggaggttgctgtgagccgagattgcaccactgcactccagcctggcgacagaacaagactccatctcaattaaaaaaaaaaaaaaaagcattttcttcatattcgctacatatgtttgtaacattaatgagaaataagaaattacccttttccttgactaggtgtggaaactaaggcacagagaaatccaatatctttgcctaaggctatttagaaaggtaagggtagactgtgctgacactctaagcatagagaagctatttactgcatcaggtactgtgcttatccagggacatttggcattttcatctccttgttaaaatatatgtgtatatatatatatatatatatgaaagaaaaggaaagaaaagcaatttaagaaaaaaacaaaagataaagtggcaactagttttgtttttcacttcatgatcatgctcctagcagtttagaaaaagtttttttttttaaggcacacattaaactatcaaataggttgatccaaattgtccaaataatcttctagtcccagcatgtctttttttctctcatagaaattaggatcatatatttgtaaatgacttgtggaggagattgaagcagtcagtgtaaatggagtttctccaggtgctgatgcctaatcgctgggtaatagctgtggacttgctgtgagacctgcattattacaatgtaatcagaatcctgttgctctgctgttattgtcagccacttgtggaattttaaaagcaataacaattttgattttaaatcatggcattattaaagttattttcttcccttgccagaacatagctactgatgcttgtctttgaaggacttgactgtagtggaatctttgttgatgtcagaagaagtatttctgttcctggccacactgagaaacccctcctttccttcgacacatttttttcatattgttgtgtcaatacttggttatttacagcaaggtgtgtgatggcagtacaaataattttttaatgcagttaaaccaaaatttatttatatttggcctgataatttattattttattatttgcttatagaaaattaatttttccagttatcttttgtttatgctgttaataaaattaattttattactcagcaatgccatcgcagaattgaagaaattggaagaaataacccaagaatgtgcttccttataaggggaagacaatttaaattttaaaaaatatataatatcatgaatgttaagaactggcctataaacatatctcttggttggagttatagcaagaaatgtggtcaaactaaagtctggatgtaggctgtgaaagtccacattacttttctatttgtactattcatatgttttctcaggtcattcaactggtggggttgcttttctgcttgctgttataatccttctttgttggggacctctaaacacatgtcttttacttaattcattaatttgtttctttgtccctgccttttgaagcaagtgaacagtatagggaagaggaaggctttaggtccagatgcccaagactcgtataagtggctgtcttgaaactactggtgtctgttgacttctttttttttttttgagacagtctcattctgtcacccaggctggagtacagtgatgcaatctcggcaacctctgcctccttggttcaaacgattttcatgcctcattctctcaagtagctgggattacaggaatgtgccaccacacttggctcatttttttctatttttagtagagacagggttttgccatgttggccaggctggtctcaaactcccggcctcaagtgatctgcccatcttggccccacaaagtgttgggattacaggcgtgagccaccactcccagccttctgttgacttctaatatactagtcgcctatgcctagtggagatatgaatagttcctaaatttaaaggcctattaaatattgcttttaacaattttaaaagagagagtttttaaaaaatgccttcatgtaaggtaaggggggactgttgtatcaaaactgaaaggttacaatttgttagactgaattctagggatgctgtatctgatggtaggtaacatctacaatctaaacagtttaggacctgtgttttatgttttatggaaagtccttcttttctctctacctaatttcatttagcatctttatcaatattaatgtttacatttgaatacatgcccaacagtatgatttctataagcagaaattgtgtcatggcctacctttatgtaaatcagttctgaggtaatttagttgacttcatatcaccctttctcctccacaaagttctctttcagttttgtccaaatcaatataaaatttatttcgtaagacttagtcctaggagccagattgaaatttgttcacttgcaagtttgaaggtactaagctaagataaggatatccaaaaaggatgtttaactccaccaaagccttacaagggccgaatgggataaaatttagaatgaatggaaatctcatctatcttctgttttacatgtttttgctcctagaaagctaccctggttgaccatgggatccggcgccttactttcctggttgcacaaaaggtactgacatgtgaattgtacctctttaatatttcttatgctgctgctacaacttaataaaaatgggattgtaatcttatgcttactaataggatttatgcagagaaataaccacttttctgtaagtttcatttttaaaaaacattagtttaactcatcatcttttactcaatttctttttgattttgttactaattgccaacttctgctgtctttccttcctttctctcttttatttgaaaggatttcagaaagcaggtcaactatgaggtggatcggagatttcatgtaagtaaaatgaacaataatgaaagattacttactgttttatttgtctgccactgattatttaaccagaatatatgttagaagggctggactgatatttgatccttcttcttttagaaattattataataaatattcagttctctgtaatcccagcactttgggaggctgagtcaggaaaattgcttgagcccacaagtttgagatgagcctgggcaacataatgagacccagtcctctattaattaaaaaaaaattttttttaattcttatatcaagtgttccagctaaaggttttcttctttttttttttttaaccctataatgaattctcaatatatctctgagaaatagttaagaatgaacataagcatttatccagataaataaggtagaaacaagctaactagtaatttcttctgtgcttatagtgaatcaataatcaaggacagccagttgcattttgtggtcttggattctttattgagaagtctcaattctaaagaacaatgatttattatttaaaatgccttgatagagccaagttgctattttttgtcttatgttaatcgtaggaacaggaaataagtaaaaattaaacactctgttgcttattctcccatttaactgaattaactgttaatatttatgagattaaaatttttattgaaaagagaattaagttaatagcctggcatccaaactatggtatacccgtatgatcatacccagtacagtgacaacagtaaggccagaaatccagtttggaatcaatatgttgttttcaaaatgactgattataatcaaaatatttcataaaaattgattctaatgtagctaactaagattctagaggatgttaagaagtcttttttttcttttctttcttttttttttttttgagagagtgtcttgcttagtcgcccaggctggagtgcagtggcgcaatctcagctcactgcaacctccgcctcctgggttgcagcaattctcctgcctcagcctcccaagtagctgggattgcaggcatgtgccaccacacccagctgatttttgtatttttagtagagacaggggttcaccatgttagccaggctggtctcgaactcctgacctcaggtgatctgcccgcctcagcctcccaaagtgctgagattacaggcatgagccactgtgcccagcctgtttggtttggttttagcaattaagataatttggttgttaagccttgcttgtttgcaacaatgaagatggcacttgagattctggaaaggactttctaaactcaaggacctatgtgtgattgcttttattacctttttgtttattaggttttcaagacttgacattttgttttccttcatacagttcaccttgttggtctagtctatagagaaacaagagagctaagattttctgaaatgctttaggaaatgttgtggactgcatgactcccctgtgttattgatgtcaggaaatcaagcagagtgtagatatatgtcaatcaataactttagataggaaacggagtcagtggagaagtatgaggagcttaaaaagaaccctagggctttaggaagaaaaatcaggagcttagagaataaaattgatactttgggatagaatatgaaagcccatggataaacactgtggctggtagatgctgatcagaactaaggtagacatgccagagccaggccctggattttagaagagtattgtgctaggttcttaaatgttactgtgctttttatcaccgactttagaataacagcatattctagggaataacactaaatttgtaaaattgttttcctttttgctaatggattagatggaatcttcacatctatagcacactaactggtttctataataaatacactgatcaactaaaactgttcactaaaatttttagcaaaccaaagtgattagttctcactgacattttctcatatatgtaacacataaaaaaaccctttcttatctctgaatctatagtgtatagttataaatatgccctagtattaagagtatacttaacagctttaaaacatttttttctctctgctgtcctgatatttctggatctaggtttaatagggacatgtataggcaaaatcggctagaaaatgaggccagcagggggtcttccgtgacaatcattgtctgattcctatatatagtggcatcaagtgggaaatcacttaaattatcaagtgacttgatttgtcatgagtgtaggaaaagctgctttagagcatagagaacattaaggtttaagtgaggactgcatttgctctgaagaattgaatggcagaggagttggggtgtttttatgttagtccctttaaaaatgataagtgattttgcaaggtgcaagggcaactattaaaccgaactccatccagaatctattatacaatccaggatctacactagccaggaagcgttggcagaaactgtacaaatctgggggtcactgtcgtggtgctgctgtgagttcttttgctgatggtagcttgacattcatgaaggatgcttatttagcctctgtcatgtcatctgattgtgcttgccccatagttagtgtactgtgaaaaagaggaagctttctgggagtgtcagagatgaatcccttgatctctctggcttcttgataatccactgtgatgtatgcagcctcccctgtccaatgctgtggaatccctatattattgaatggaagagagaatttgcacttgagggagcaaggagaggaggaagtttaccaagtttgattcaagcacattggttagtggaataaagcaagctgtgctgttatatagttgttggtctttcaaattgcctcagaaccagaataagacaaatgagggccagagtagaggttgctagagagctgtgtatattgttaggtactgatttggatgacagtgattgctataagcatttacaatacttcgtagtttagccacagttgtcccagatagctgcccacagctttaaaacatttttagggtgtctgttgccaccctagtccgttgacactgcatggagattatttctgtgacagcagtcttcaccagtgttaaggaggctgggagttgactctgtttccataaccatctaattaaatcaagtgcccataatggaatttgaataactgcctaactttgatatttaaacagaaactttgaggaaaaacaagtctctttttgtaaatatattctacttgttaagaaaaaataaagtagatcatgatgttcatctgaaaataaaaaataaaagaaaaaaatggacaagatgttaaaaaaaagaaaaaagatcaaagtcttgaatggaaaagaggcttcttgaatttctgcagctatctaaactgcaactccacagttttctgttagttaaaacttattgactcactctgtcttagtttcactcacattttaggtctggaattccaaaatatttagcagaaagtgctgtctaattgggatataatattatgcttttttttttttaagctttccatatttttttcagcaaagtttggctaaggacatcggaatacaaattttcaggacttcttcttatcccccattaagtcctaaaaccatgataagattctaaatcaaacagttttacatctgttaataaaatgttaccttttgttcttgtaaaatttcatgagatttaaaaaaaagatctacatatctcccgagagagagttgttgttttatgactattgtgtgattcccactttaaaatgaaatgttttggattatttggaccttgaaggaagagctcactatatgagcagttatcataattagtagttctttttttctttttttttttaagatagttctgtttggtagtggaccaactattagttttcagaagggttggtttggatttttgttttaattacagtctatataattagttctcagcatgttgaggtaaaagagaattgtaccagcaagctcccaatttcttcatctcattaggtttttaacacgattattagtatcataatcagctatgatgttttttgttgcaggttttcacattctctgatttgcggggtgtcttgattggctaatttgggcaaattattttgattgtcttgatgatggttggctgattagaacacagcaagggcataatttcttcctgtgaaacgttgcattcttttgttttttggtaccagaatactaagagggtttttctttgtgtacattcaattatgatattcgcccatgacactagtagaatacttggaaagcaaatacattgatgatggaataagcatgaatgctttcagtggaaaaactggcagtatgaggatgagataggataaaagaatttactaaaactgtaggatcagacttttagatttcttcttttctgtgttttctgtgattctgtggtttttgagtgccaaaagagattactttttgtaagagtcttcagacttccatgtcactgaagaattgcttagtagttccacttttccattgcacagaggttcttgccatctcttgttctgaatgtttaatacttaaattgaggattttaccggggagttacaaatttactcagaagtttaaaaaaaaaaagttgtttatatgatctcatgacaacttttcttagctaaccttaatgaaagtggtttttctaattggtagtcattgcccacctctgccaagaattagtcagtttcttcattatttgtattaaaggcatttccattcaaactgctttatatgcctttcagttactacaaattttcttaattggtttagtggaaaagaaagcattttttattactgttttgtttttgaaaggaaatggttttgatcctataaatgtacataattaaataaatggcatcctaaacaaacattttaattaattagctaataatagttaaggcggaatagaaaagtgtgtgcgtaaaatatcatattatcactttccttgacttttctttcagagagttccatggaaagattttgtcattcttccttttttgacatttgttactttttaggtaatgctctgaaagctgtacctcactagaataaaaccaaaactaggttatataaaaccatgagcatgatatttatcgacacctcagctgaatgcatcttacttaaccttgaagtcagtcctatgtgcttcactctcataacgggtgggggcggtgtcagagaattatttagaacaaaacttgaggagaagttcagtcctgtgtaaaatccactttaaaaaggcttttaaaaaaggatttccctgaggttggtaaatgagctcctaggaaccttttaaatgcagtcttacagttaaaataccaaggaaaagataaaaagatttattaactgtgcaagctttagttaaggtgagagtgaggtgtaacacttatggaacgtattcaagaaattttcaggaaattcaagaaccacaggtttacagcatgagttttgctttgtttgctttctgctttttaaatttaaagtcttaatttctgtgtttttgtctcatcaaagagaaatcctctaaatgaggaatttagattataataaaaagagaaaggtaatactctgcccttgagagatcagagggcatgggctctggcactagagagacccaagtttatcttccagctctgtgattctgagcatatacttgagccaaggcttctgcaagatgagggtcacaatatctacccctagaggttgttgagagcatcagataggacaacacatgagagtacctgccaccagaagattttcagtccatgtttccttcacatttcctaaagctcattgaggatgtgtaggcagctagtcccggtctctctgccttgtactgataagtgtttgattatattgcactcataatgaagaagatgcctaatgaaacctcctatagaggcaaatagtaatgatttgattccagcactgccagtagagcttcccatccgagaaacaggggtatttggcattggtaagttaaatttcagaaactaatgaactctgctaattgaattcatctttgttaattaataaggttctagtaaattgggtttttttttgtataatgccctacaaaaaagcaggaagacctaatgattacaagttcactagttctaaccttattctttcctatacatatagtggtagtgaccaaggtagaatcttatatttttcttcatcttcaaatgttatcatttaaacccttgacattattgacttgagaataaatgtgaaaatcatggactgagcactctatactgtctgagtagtttatattttaagagtttcttaaagagtaacttgggaaatcagtccattaactactattgcagtgactgtggcacaagggtatattggttttatttgctgggttgtgccaagagcaatacctagcaaaaaaatttttttcacttgggagatttaaaaaattcatacattttttttcccctgggagagggtagatactaaaattaggtttataatgtggtgattctcaaatttggaaatggggtcaaagtgatggttatgcggaggatcattcatatatatttcctggactaagcttaggtaagaagcatgtttttctagaaaactggcttctaaatgcttaactgtttctatactgtttgttctcaaagagccatgtctatgaactactgacacatttttcccccttctttaatacagagagaattccctaaattttttacattccgagcaagggataaggtaaggattgatttctttcctatttaaaaaaaaaaattactttttcttaaaagcccaagagcggcttatctttgccatacgttcttcttgccattcttttttctcttattgaacttgtgcttcctgttgccttacgtgtgtcttagaactaaagccgattcctttctgaaagggtttggtttgggaaacaaccaaatgtattgagctactcaacgaaggtgatacctttccaaatcatccttgtcctgtagaatgatcctaatgatgtgatattaaaggaccattcttgttatctacaaatagttcactgatactcaactctactttatgtgaatttgtttttcaattttaaaatacaaaacttcagaccatgttgctttcttcctgttaccggcttatatatttgactctctctctccattcactcaattgacatgtattccagaaaaatactttagtttcactgaaacatacagtacatatacagtaaatacagtaaagttatatactaatacaacttttaaaaaacatatataagtaattatatatctatggatatagtgttccaaagccaaatatctctttaattaaaaaattgtatgatgtttctttgttgagtatttattatgtcctttgtacttatcataagtgagaaaatttttagattagttgggtaagctcaaaacattggcatgtgaagtagatattaatgtgaagcagcctgtaattaatataaaaatgaattatataaagacattaaatgttgtaggagttctaaggaaattgaggattttttgtttgtttttcatgtatatcatcaccacttgtaaaatcataaatgatgaaagtttaggaatatcatcctataaagtacctatataataggtactttagtgcctaatcttatgtaagctgtagcattagccttgaatgtagctcatttttgttgctcattagcacatcatagcttatgtttctattttcaggcatctcttttacattcacattcatagtataattttgtaactgcctcttgtgaactgttttttctctgattcttgtactcagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggtgggtgctgtactttaatgggatgttatccctgagggaagggacagaataatagatatgattcaaaattaggtattatgcttctgctgagagagaacataaaaaaaagatcaggttttcattttttgaatcaaggttcttgttctatttcaatgtttacaaaagtaaatatttcatataataaaggcttttttttttttacaaagcagaaagtgcatctgaaaaaaaataaaaaatgaaggctctttttccactttaatttgatttttcttggtagcagaagcataataacactcaagaaaagaaaaagcatacaaacagaaaaatcacaggaagaattgggtgatggtagagcataaggagataagttaggaaagaggtgatcccattgtacacctgtctagaagtatgggtagtgtctgtatatagcaaggcacttcctgatgtgttcattattattatatcccatagccgtaccctttcttcagcttttcctttctaaatagctctgtttggcatatgtgaaatatcatcctattgaacttacagctatggggatgcccagtatttctacctcttggaagggaatgatgcactaaaagtaaggaggaagggctgacatggactctttatctggccctttcctgcccctgctccctgtggttactggactgactctagggagaaagataaacaatctcttcaccaagtgccttatgattcatgatatactgctgcttaagtgattataatagccatttctttattgcctcttttaaactacattaatgttgattattttcttcctgtataggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaaggtacatttctccttagcttctctcccagcactagcaagcataagcacagaagttcattcatatttatctcacttggacttggaaacaggtactccttgttcaggctgttgagcccttaatctgtaaagtttatagaatgtttataagattgagtttctgggacagtgtcaaaaatttgatatagccattgaaaaaacagttctcaaaactgaaggttttggtgttagcttgctggtcacttataagcagtacaaaaacgtgaaaacattttcttttgttggtacctattttatatttgccataatagtggtcctgttttgtattattccctactatttctcatctggaattattaattttactgttactaagcattttggctaaattactgcttctgtgcactaaatgttaatcacctggtggccttagtgagataatgcaccttctcaaagtgtctaacctatctctctttagtgtttttccacagggagagaatttggctgataaggaatttctcatgtattatgtatattttcttccctgaggttctattctgaaatgcattctatataatttaaggaagaaaaacaaggtgattttgtacttgaccttttatcccaagtgtaataaagacaggctgctctctgtttctgctccctctaacgctttctttctttctttttttttttgttgagacagagtcttgctctgttgcccaggctgaagcagtggcaccatctcagctcattgcaacctccacctcccaggttcaagagactgtcatgcttcagcctccccgagtagcagggactataggcatgtgccaccacgcccggctaatttttgtatttttagtagaaacggggtttcaccatgttagtcaggctggtctccaactcctgacctcaagtaatctgcctgcctcagcctcccaaagtgctgggattacaggtgtgagccaccgtgcctggccccttctaactctttctatcatgatactgtggaatttggataggagaaccagtatctccctttttcaagatcagctgtaggcatgaatttttgctgctgctgctgctttttttttttttctttttcttttttttcttacagaaacagggtcttgctatgttgcccaggctagtcttgaactcctggcctcaagcgatcctcctgcctcagactcccaaagtgctgggattacaggcatgagtcatcatgcctggtagacttttgcttcttgaacttagtatctgagatctgagaagtagttttctacctttttcccttaaaaattccaagctaatgatgggttgctttagtttgtaaggaacgccaaggacagggctactcatttgactcaaatctcatcatctagtttaagcaaaacttctcctaagcattctgggactaataagctgggaaacttaaaacatggcatggacactgtacagctgtatttttttttagatttggcttaccttttctctgagtttttcagatcagcctctgctttcattctaaccacccatatacactggctctgcttttctaatgatagatagctgccaattttctgtacataaagattgttggcttttgttccctcaagaaaagaatgggtaaatatctcttggttaacaagcaagtatgataatagagaggttaactccctgaaattcattctaacttaaaattttgtggtgcagaaacaaactgcaagggtggcacatgctactaaagaaccacaagagaaagggaatgtaagatattcttgagattttctaagaagttgaggaagcattttagaaagatacttcatttaaggatacattaagttcgaatagcatgttctagctgcattatgttctgtgcagccatgttggggaaaaaaagttttgctttagcatgtaaataacaagaaatcatgtctaaggccatttagttaaaataactgtcctacccctaaaaactaagagcattaagctgccttggtataaacttagagaaatgtgggaacatctgccccatcttattaaatcctaggtggacttagcagtggccaagcttcagagctctgtttagagagaatgttctagcaccacctacaaattgcctttctttaatttgtgcaatttaccaagagacatatattataaagtttaataaaactgtatgaaaaaaagctcatggtggtaattgctgtgttgatttaaagtcctgtaagtgcagtgaaacatagttaccatgcatataaatgctacttaatagctatttaactagagattttattcttatttggggcttcctcttaaatcccatggcttgtaattttagatactgcagatctttgatatagaatatgaatataattgggaaaggggaaggagttgcagagatttgggtgttattatcgagagaaaaccactcaaatgccaggccagcatgaaattgtccctgacttgttccaagaaagaatagtttggggagaaactatctgaccactttttgtaaggtgtgcatctccacaaaccaacctctttttttttttaccccttctttctcaaatatgagcagacctgaaacaggtcttagttagaagatatttaagttttgtgcttggtgatgtgtctgtgtcagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacaggtacaatactcaaacaggctcctcagagttttgatttggtcctacagataagacactcgtccttgttatagaagacccacactcacaaatcccattggttcacctggtgggattatcctctataagattaaatgattgtatgaatttgaaaaacttcatctgccttataagatttgcctatgttctctatcatggatgttataaaacccttaaccatttgtcatgtattggtaagcactaacagatgccaagtgaacctgactccagaggttattctgcaatttaggctctttttttagagggctcgtgggttatttcagcaatctaatctctggtctgatgcgtcctttccgttttcaccataattaaactactcattggcaagtgaggaaaagagaattgttggatttatgtcaccaacttctatgttaaagaaggaaaatttcaacatagtatagtggcatgagcactaccatcatcagtgtctatcatatttatctattgtgttctgtttctgtttttatcatatttattgtgttatctattatgttgttccctttccttcaaagatttcagggtgtcatatattatacaagagcaaagtggcaaatttaaacccgttttcaggtaggaaaactgagaatgtaaaaatagaaagtgagtcagtacactaattctgtgaaacagagaattcccttttaatcttttttactacgttggtttctaaatatttgggctctttactatgatactgaaattaggttggttcaccattgttcacatttttgaagaactaggatattttatggctttggcctgaattcaagaattgcatttcttctgattaaaggatgaacctgctccagtatacataaacaagggtttcagtctattccgtgctttgggtgccagggagagattatgtgtctcttgtttttatctatatccttttaaatccaggaatagagtcaggaaaatatatttttcagtcttttgaagatgaatttttaaaaatctcagtttggacagtagtcagaatgacctttcattttgtgctttgattcctagtgaggtggctagagaaatctatcctatgagaagtgagcagttaaaaacagagagagagagtgcgcaagagcgtgagtggtgaccaagagaaagagtgttcaatattttttgctgtatttgatgtttttttagtgcaactttaaagacattttcagtcaaagctttcaatgggtagggatgtttttaattaacttctacaatagcttcaaggcaggtctattcttgtgaaaagtaagatggccacttgagattttaatgtttttgataaatatgtttgttcttcataactactttctttctttttttttttttcctttcctttattaggaaactctgagatttccctcatgctagctaatggtgacacaggagtgtgaaaggcacagatgccttcaatcagggtttagtattacacatggtacaaaataagcacacaataagcatctgaaagaatgaacaaaccaccttcagcctgaaggaaaacgctttttacctagggtcctgcatattttaaaagccctgaaggaagaggtcttctacagactcttcacttgagagagttcaagagctactgccatatgggaactaacttttgagcctgtggctagacgtgggaactgacaaaaggagcagcctccaacccagttctggtgctcctaatgcctacatggtgcttattgtcaaactgtttttccctttctttaatgaatcattgtatgaagttaatacagaaccatgtctgttattcgttcatttgttttttaatttaatattgattgactacttatagtatgtcaggcactatgcgtataaagagaaaaagcaaactgtactcaagaaatttacatcacaatggaagaagacaaatgatttgtttctctgtggcaaatatgtgctattataaataaatacagtgttctaagggagcagactatgggtcagaaattattttctaaaataattttgatggcttctggtgaaaggtgtgtgatatataaaatgtgtacatattttcatgaacttctaaaacatactttacagtttttagttactgcgttcattatagtagaaaatggaactaacatagatagttgagtattcaggaactcctattactatcagcctcttgccctagcacatcatttattcattctgccaataaggaacaaggttgattggcttgagttttatttttcattttccttgtacagtctttgtagtataggctgtaatgaacactgatgtcaggcagtcataatggggagaagagatttgggtaatccattgcataagtgaattgatttccaatgtgcagtgtaagagaaaaataacattttaggctgggcgcagtgactcacgcctgtaatcccagcactttgggaggccaaggcagatggatcacctgaggtcaggagttcgagaccagcctgaccaacaaggtgaaagcctgtctctactaaaaatacaaaaattagccgggagtggtggcaggggcctgtagtcccagctactcaggaggctgagacaggagaattgctagaacccgggaggcggaggttgtagtgagctgagatcgtgccactgtgctctaacctgggcaatggagcaagaatccgtctcaaaaaaaagaaaaataacattttaaaatcatctttgggctgggcatggtggctcatacctgtaatcccagcactttgggagaccaaggtgggaggatcacatgagcccaggagtttgacactagccagctcaacaaggcaagaccctgtctctaccaaaaaaaaaaaaaaaaaaaaaaaaaaaaagaaatagccaggcatggtgtcatgcacctgtagtaccaactactcaggaggctgaggcagaagtatcacttgggccccagagtttgaggctgcaatgagctatgattgtgacaccacactccagcctgggcgagagagtgagacactgcctctaaaaataataaataacacctttattgaagtgcaatttacttataataaaatggactcgttttgtgtgtgcagttcaattcattctgtcaaatgtatacaccgtgtaagtactatcacagttgtggtagatacatcactgcagaaagttctcttattcgcctttgcagtcaaaggtagaagcaccaaccccggccttaggcaaccactgatctgctttctgttactatagattagttttgcctatcctagaatttaaatcaaacagtgtgtactattttgtgtctagcttattttactcagcataatgtttttgaggttcagccatgttgcatagattatgtgtatgttccttttcatttttggatagtattccgtttcatggatttttttttttttttttgagacagggtctcactatcttgcccaagctagagtgcaatattgtaatcatagctgaccacagcctcgacctccttggctcaagcagtccttccacctcagcctcctaagtagctgggactaaaggcgtctaccaccatgcccagctagtttttaaatttttttagagacagggtcccacaatgttgcccaggcttgtctcaaactcctggattcatgggaccctcccaccttggcctcccaaagtgctgggattacaggtgtaagctgccatgcccagccccatttaatggatttatcgaaatttttacattcatttatcaaaatgtttatattcacagatatgttttggcaggtaaggtgactaactgggagctctgacatgttccaaggaaacaaggctttccagagtttccatcagatatagctttgactagcaaggggcacccccaaagggcaggcaatatcttgacactgttttcatttctatttcatttggggatgggtgactgccaactcagatattagatggttctttatgaattaatgggaggaatgatgagaatagaagtctctattgagtaggagagagtaaactaagaccacatgcttgtgatgatagtttacaacgatttgtgtgaggagttacatgtatatttcctaagtccatattcaaattatggatattaaaaaagactggctgggcatggtggctcacacctgtaatcccagcactttgggaggccgaggtgggcaaatcagctgaggttaggagtttgagaccagtctgaccaatatggagaaactccatctctactaaaaatacaaaattagctgggcgtggtggcgcatgcctgtaatcccagctactcgggaggctgagacaggagaattacttgaacccaggaggcagaggttgtggtgagccgagatcgcaccattgcactccagcctgggcaacaagagtgaaactccgtctccaaaaaaaaaaaaaaaaaaaaggactgaaactctagttctcattttcttttctttctttcttttttttttttccttttgagatggagtctcactctgacgcccaggctggagtgcagtagcacgatctcggctcactgcaacactgcaagttctacctcctgggttcacaccattctcctgcctcagccttttttttgtatttttagtagagacggggtttcaccgtgttagccaggatggtctcgatctcctgacctcgtgatctgcctgctttggcctcccaaagtgctgggattgcaggcgtgagccactgcgcccggccctctagttctcattgtctaattttccaagataacctgttgatggacatttggggttttatttcctagtttgagctattagtagtaataaagctgctgtgaacattcatttacaaatctttgtgtagatatatttttatttcctttgggtaaatacgtaaaagtgtaattgctgggacacagtaagcatatgcttaactttataagatattgacaaactgccaaaatatttgtaccatttaaatttctgccagcaatatacatatgtagctagattgttttctccaatccccttcctcagtgcacaattatgttgcttaactatgaccagcctgtcttcatcacaaagcttggccaaaccgagtctcaaggtcttgtctctcttaacagacgagaaatgtagttctaggaacctgctgcgtttaccccattttcttattttgattcagcttacttgctctgagtacagttttctcatactgtacccttgccttacttaacactttgaatctcttaaaacattattgcttttactgacacattcctaagacattactaattctgcttccccccgggtgacttttcctattgatcttgtggaagaggactgggagctccaatctctgggtctttaaaacagcctgagacatgttttccccagaacaggacctgattgacaaattagcagaacattcattcctctgagctaaggggctaaggatttacagatgaactgtacccacgatttaggaaggtacttaattctattcctgtgcatatatatcaggtccacaatctattcattaatggtagacttgtgcttattttgtaggtctgaatagatatgtaggtatacacatacccttacatcccaatctccatttgtattcactgcactgggaatttatattttatgtatccatgcatgaagtgcctagtttagtgttatacaacctctgggcactcaataaatattaattgaattgaaataatggcatcctttataaatattcataagcaaataaaactatctaaatatatggagtatgaagcactcctctagaaatatttgagttaaaatgattaaaaaccagtgtagtgatttcattatgtgacaatataggtattgcaggagctattcactagttgtagacagcatcttgaggagaagtaaatacatgtatatatatatatatgttttttaatatacataatttaatataatatggttattttactatatgtaaaatatgaggctgtgtctcatgggctagtgagaattaactatctagatggatggatgaaatccacttctggcagaaatctttgaagcctttgcatagctagtaatacttatgaagtaccatctaatcaagtgggttaaaggactaaagcacagatgatatactagagtcttgatctggccttctgccattgaggaaagaagagaattatctttactgcatagctgttcttcaacttcaataccagggctgctcagactggttagttgatgtacttcatttctgagtatatgagattcaactcactttagatggctagcatggtcagtctgtctttgagatgcgaaatgtgcaccgtgctttcttgtttatttcctttttttttttttttttttttttttttttggatacagagtcttgctctgtcgcccaggctggagtgcagtggcgcaatcttggctcactgcaagctccacctcctgggttcacgccattctcctgcctcagcctcccgagtagctgggactacaggtgcccaccaccacgcccagctaatgtttttgtattttcagtagagacaaggtttcaccatgttagccaggatggtctcgatctcctgacctcatgatcctcccgccttggcctcccaaagtgctgggattacaggcgtgagccactgcgcctggccttctttcttgttgatttcaactaatctaaaagtgagagcagttatggtatatggctggttatatatatatattttttggagttggttaatctgtggagaggtgagagcaccaagtacccagtgttaagaggcatatctcagctactcaacctaccaaaaatgttttcaaagagataatatttgtgcaaaaaaagcccctctaggcagctctctgatttttttctgtctcttaactccccatgccatttttttttcctgcagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcaggtaagatgcctaactggagggtctgacatgttctaaggaggcaaggtttccctgaatttccatcagatgcggttttggctagaagggggcactccaaagggcaagaaatatcttgacactgttttcatttctatttcatttgaggattggtgactgccaactcagatattggatggttctttatgaattaatgagaggaatggtgagaatagaagtctctattgagtaggagacaggagagagtaaactaaggttatgttcttgtggtgatagtttacagtgacttgtgtgaagagttacctgtgtatttcccaagtctatattcaaattatggatattaaaaaggagatctgatactttagttctcattttccaatataaacctggttcctagttgataccctagattaatatgatgagaatcaatatagatagcatagacaaatggatatagagttcatggtacacagtttagagtataagttcttttgtgggagatttgttatagctgaataaaaactagcatgagaaaatatgacattatgaatctcagcctctatatgaaaacaaattctttcaatctgtatggtgaatcatctctatgctgcagatttttcttctatcaatagaaggcaagaaaagtgtatcaccagtagaaaatgcaaccagtaaagaataaggtatcaaaagaatactgaatttgtcctttttaaaaaaatctatgaatataggatttttccaagtctcctagtcaatactaccagtattaccacatttgaattttagtaaagtaatatatgtagtcgtagtaaatagtctgtgtagaattcctgtgttattcacaaatacaagagattacctttatgcaaccatttgtttacaagttctgtctcctgaaagataccttcattcggtatttcccttttatagcattgctagcctaaaagctgagtgttacttctgtttcccaatgccagtgctataaatataatataaatcacattctatataaatataatataaatcacattctaagtaattcttcctatataataggcataaacacagtgattaggacacataggtatgtatgagtcacttgggattcaaatgttgctttgaggcaagcaaagaaagagctgaattagctcccacttcacaaaggatttacttacaggaagttggaaatggaaatcataatattttttaaatgaattggtatgtctgtgtcaaaattgagcagaattgatctgcacatttacaaatagtcacacacatctagtgagctaattcctgtgtatggtcctatagctatgaaaaatattagaaagaggtttcttccctggaatttctagtagaagcttcattctggccttcttggattttctttttattagctgagcgtcatgtcattttcctggatattcctttgttgtcaagtttctttaggattttccttttctttgttttaaggagtcgatgctacttatttagttttttaattttaatattcctaggatagtgttaggtctttcctgtttgttaatgctctggtgctgatttggaatcactcagtagtttgactttttggaaaagtgcctgacttttggcatgtaaaaagtaattacaaatctattttaactgagaatgggagctggagaatttagtctaatgtttacactctgcagaacacttggaaaagaaggcaaaaccagattgactgaatcttaataattatttttgtctatattgaaattattgtgactgattagtcaaacttcttttctccactagtccctgatcaaactctgggagtctatgtccactcaagcatttcttccatctccccctctgccttctgacatgctgacttacactgaactggtactggatgatcaaggtcagctggtccacatgaacaggcttccaggaggaaatgaggcaagtagttgaaaccccccttccctttcttatctctgtgcccactagtaccagctttctgtgaggtggtcattaaatagcactggagcatggtagtcttgttgggagagttctttagagagagcattgactgagtatcaagaaattattaattttttaggtgtgataatggtattatgattttgctttttaaaatagtattgttttaacacaaaggactcagttttaaaaaaataaaaaggaatattgttttcttttagagatacagactaagacatttacagatgcaatgatttgcttctaaataaagaggtgtgagggtgggtgtgtagatgaaacagggttggtcgtgagttgatcattgaagctaggtgataggtacatgaaaatagattattttccctgtttttgtctatgtgtgaaatttggggattttctttttttcttttttctttttttgagatggtgtctcgctctgtcacacaggctggagtgcagtggctcaatctcagctcactgcagccttgacctccatgtctcaagtgatcctctcacctcagcctcctgagtagctggtactacaggtgtgcaccactacacttggctaatttttgtatttttttcttgagatggggtttcaccatgttggtctcaagctcctgagctcaagcaatctgcctgcctcagccccgaaaagtgctgggattttaggtgtgcaccattgtgcccagccaggattttctataatgaaaacatttaaagtattgttttgcttaatgttttttcttatttggattcatattaataaatgcatttttcagtgtcttttccatgctcaattcatttgatctggtgctgttgtgagcatgataaatgtgttcttgaaggggctcaatcagaattaggggttcaaacataaaaaatgtagcaaagaacccattttttgataattatcccaagaatgcattttctagccttggcatcctttctctcagagtaacctatgaatagtgatataaagtcctattttgccctatactcttatactcttgtccatgcattatgattctttctgattttaactgtgctcctaatgtacagttataacaatgataataccagtaacaaacctaaaaagagagatatttttatttcaaccttaaatataatccctagaaagatttcattccattgaaggagtaatctttacctgtgttttcaccacaaataggctgggtagacctttggaaataataagcagtttgtttctattttgctcaatctttttcaaaaaatttcactatatatacaaggtgtgtggctatttcagtaatatgccagtggatgccaacagtagatgatttggtatcaagatggatgcaagcattggaccagatggagagtatcagacttgtaggagtctcaacaaatagcaaagtcaagaggactggggtggaaggatgcaaaacattttgacaagcatagatatatactcatcagcacacgaagttgaaacagaggtttctgccactgtatgtagcatctgcctagtgagcccctcagcagcaaagaaaagcttcattgtgctagacttaaattctgattcattgaacagtgtagtcttcaggaatggaaggcacccttgtgaacatggggctgagagcaaaatggttttaactaatgtaattaaaacacaaaatgagatttttggccacgtgaaagctagctgcagtgctgtgtgaaaccccttgccatgatctttctttcctgctttctttctgccctcattctgtgtttgagcgaatggagactcagggaatagtgaagtcccagagggacagagctctgttcttgctgaaattacaagcacagagctgcctgggcatgaacatgtagtgtttactctgccagtatgaatacaaatagtcttattatacgggcctctgtacccaaagaccacacacacacacacacacacacacacacgaattttttaaaaattaaaggttttttttaacccctttaagacctaacaaaccttagtggaaaagatatgtcttaaacagttgcataggactatagctatgactagtagtagatctagtataggagccacatgttttcctttgtccagtgctttaatagttttgaaaccagaaagtgaatagtatttcttcaaaagattttgagtttttgtcagttctcactttcttcttgttctacagttttccctccttagttgcctattttctttgttctgtttttcttttcaaatgattgactaggattgaggctgagtgttagcttgctgtttctgagcctttgagcttgggaggagttagactgatgttcttttgtgagcagttagtgactaatgcccaggatggctggtgaagtcagtcattggccttagctagattatagggcactgcacaacaggaatgaggttggggtgttagtatcaaactctgctaccaatagcttgaacatacaatggagcatgtccactgagagactgaccaatctaaggatggagtttcagcagtcagaactctgagggacagctgtgcctaagagatgacaaagtgtcagtaggatgtatttcctcgtgctgagcccagttttatcagggcaagttgactttcagctattgcggtttaattttctttggccaaagagcaagtttgtcatgagcctggcactctacatattaccccaagaatgatgtgaagggaatgaacagagctcatgctgatgagatttggagtaaatctgtcctgtcccaaagagaatgggcatctggacagagccttgagaaatagttttattacaaaagaataaaaaattgacctgttaatgttctgaaagccaaggctcaatgtaaatgcattggtgctatgtagacattaaatcatcataatgtggtgttctccaaaagtgacggctctaccaggtcatcattgtgggtggtattgcattaccttcaaggattggagtttctgagtttgaaaactagcacatggatgtaaggagtaagggtaaaatgagagattccttcagagttttcccatgaattgaggtgcttttctccatgatcgaaggcagaaaacctgcacttatcagaccattggctgtatgggtggccagtctttctaatttttttttccaggacagtaaataggtaaaaaggtgatgggaccaggacttggaccaattcagttccatttagttttaggtaacttctttgccatttgaggaggaatattggctgtttcagtagagatgtgacctgcattttgaacatttatgcctgtgtttagagcaggagacagagcttttctgatgctgtattagctactgtctcctttctattttcctagttgtcccttccccataaagaaagatgtaactaaaggagtaccacctaatgcatgatgaaaggtataggagaacacatttttctcattgtcatatttgaatggcattacatttagtatgactttagagtaggaataaaaaagatgtagactaaatctgtgaactacgttacttgcagatagctccaaagatgagttgtccaagatttttcttaatagtttcaagtaaagatgaaaattgaggaaaatgtgattgcagcatagactaaacggatctcatttctagctgctgtgttggtacagtgatgggcactgtatgtaaatacacagctagatgaatgtgtgctgttgagcctggatacagaagaaatgcagctatccaacagttctactttaccacttctcaattttggaggaattgttttcattttcctgccagtttactaacctgttttgatcttttggtggaagctataattgcaggtggggacattttgagtaacagttcgcaatccagtacagctgcttttcgcactaaatcctgttattaaaaagctcaggctaagatcaagccaagggctgtaacggacttgacagagaacaacttaactttgcctggtaggacaaagaaaatcctagccttcttgagactatgctcttgtttattctgaaataagttactagcattcttttattttatttctttttatcagctctgcgaactagaccagtaatctctaaagtgggcaatgctgaaagatatgttagagagtcaactaccatagtaactttagtgctagtagaaattaggaccctgtttttcttactatatcagaacatgggcagctttttaacattctgtctcatcatgcctgtcataatgagaaactgagatgagaagacgatgttgcgatgttgtatttggaagcagttataataattaggtacaagatgtatatccaaaaaaggggttggtattcagagactggaattcttggtataaaagtttttctgggaggaaagtatattgaaaattgaatgcaactggggccaggcgtggtggctcatacctgtagtcccagcactttgggaggctgaggcgggcagatcatgaggtcaagagatcgagaccatcctggcccacatggtgaaaccctgtctctactaaaaatacaaaaattagccaggcgtggtggcgggtgcctgtagtcccagctacttggcaggctgaggcaggagaatcgcttgaacccgggaggcagaggttgcagtgagccgagatcgcgccactgcactcaagcctggttacagagtgagactccgtctcaaaaaaaaagaaaaagaaaaagaaaaaaaaattgaatgcaatttgatggtcacctctacacacactaccactcttaagaattgtggtagctctgagccttcattttttcagatgggcgctaggtgtcagggtttttccttctcagcagcttagcattcacatgagccttgtgagtggccttgtttgttgaggcagattcactggtgtccttcttttttcagttggtatagtagcctttacctagtgttcctgcaataagcaattgcaattttaactctttggttgaagatcctttgaaccttgcattagggatctattttttttttttaaagaagaggatgattgaagaggaaataaagtagtgtaaattaaagtttaaagactagctgacagccaggcgcggtggcgcatgcctgtaatcccaacactttgggagaccaaggtcggcggatcacttgacgccaggagtttgagaccagcctggccaacatggcaaaaccctatctctacaaaaaaaaaaaaaaaaaaaaaaaaaaaaaaaaatatatatatatatatatatatatatatatatatatatatataaattagccaggcgtgttggcaggcgcctgtaatcccagctactcaggagactgaggcacaggaatctcttgagcccaggaggtggaggatgcagcgagccaagatcgcacgactgcactccagcctgggcgacagagtgagactctggctgaaaaaaaaaaagactagctgccatcatgactggtattttggttttagtcctgctttatgttctcaggggtgaaatggtagggacagtggggattaggggttcagttttagaactgctagcccaactaatacccatatttaattattgttttaattgttggcaatgtactgatatcctatgtctcccaaagtatagcatctcattaatttttttattttaaacatataaaaaaatacacagtgatatgacaaatacccctgcatctactgaccagcttaaacaaatcttaccattttgactgggctcctcacttacatgttactataatcctttgaatctctaatttgagtatcaaaaaaacaatttaggagttggtagggaaaggaagttggtaagcttatataagcctaaaagattagaagaaattaattagtagatccattttgacagttcttaggctggacctcttaacccaaaggacctcttattttagaaaaaccaccataaccctctgtcttaattcacttggttgacattttccataccctcaaaggaattgcttgggttatcctggactcagattctagtggaaagcattatgttctaaaactctgcctgtagagagtgtgtatatgcttacgggttttggtggtgagaaaagggtaggccatttctcatgaacacaggacccaaatatttaacattagattttttaaattgttttactcaatttaacctcaaaatagctccatgaatgtgatgctaatttggatgtactttaccttgcttttgtttcattcttttgaaatcagtttgccttttcatgctgtgtatagaaattgagtcagtgtcagtcttttagatatgtgttagaaaagaggcatatttaaattgtactatgctgaaggtgagttctgaaatagacctaagcgaagcgggtctgtaaaacaggaccatggtctatgcattgattgttcaacttataaaaagggtctttgccattaatctgtccctaaagataggagaatgtttataagtgctttgggatcctcagcagaaaagggtcaaatacatatgattatgtataattatgattatccataaatgattatgattatacataagtattcataatttgtgcttgccttatttttcatcaaggctttgaaaaatcaattttgaatccttgagattaagtatagagaaagatatattatggcatatatggtaagataattttatgttaattctatgtttttgttcttttattcccattctaagtaagtatatttggctgcaagtctttgtctaaaatgatcttccaaaccaaacttggatccctcattagaaaaatatggaggctaattttgaaaaataagtcttcctaccatggaattacttctaatgaatttctgacactgttcttttgggatgtatatacttttctcagaattccttctgaatgactattattggtgttggagatttctcatcaggttgagtagtttttactcatttttttgatagcaaaatgaggctcagtaaccttgattgactttgaaaatcctaatgcatccactggctcactaaagtagtacttgtggagggctcctcagtttctttcaaaaataagtctagagatagccttcaaacaaaagaatgtacttgccagcatatttatacctgtcttaagttgtaagattttactgaaaaagaatgtgacatagtaccctatgtcaagaaactttacagctccaaccagaggcaataatgaacatcaggacagcaacagatgacaccagagaatgaggagtagcggggggcaccagagttcagcactcattcgtatgattaatggacaaggcttctgggactatagtaggccaacttggttaatttccataccaaccaattaatcctgggccccatttctcaaataccgctggcttctatgtgctccactgcatgtttgttaaaaaataattcctatgcttattaaattactgtgtgtacatgtgtaaaattactgtggtttcatgtatataaatgttacagggagaaataatttccctgttcaaaattgttatttctaatctttgataacattttcaaagaattacctctgggatgaaaattttttgctctaaaagttatatttttcttacccttttatcgctgtttagagaggttgaggtgagtttgttcagccatttttgaagtaagccataaggcttaaaatacaatatttgacttaatttgtgccatttggaaaagccatgctgaaaaatatgtcaatgcctttccatattgtattatttgccagatatcaatgttctattatttagtgttctgtgatcatgtgaaggagctcaaaataattttcttaagagctgaaaaactctttttttcatgcttggatacaagatacaaaagggggaaagaggtaacattttgttatatatctgagaagggactcaagttcagattcctgctctctggatcttagttttctcatctttatgatgcagatgatgcccaagtctgggttagcgctaacatgcttggattctttgtattgctgctcaagggccttgcagggtagtcatcttcctggcattagcagaattagaacaataggttttacagactcttccaaaaaaaactcaagatcattttagcatgaatatagcaaggcttttagcatgaatataacgaatacagcttcaacatctcagccacagcctaacctgtatttaaatctgtatggaaaggtattgttagagctcaagtcaaagtgtggagatgtaagaaaggcagctgtggcaaagatattctctttctgcttcccacagcatagctagagttgatggatatgtctttcacccttaaaaaacaaaatcctggcatgttttgcccttagcttttcctgcaaatttctttgttgagcttaatattgttgttttattttgtagtaacaacagcagctttgggaagtgcctgtgtgtgcttgcacattctattcacattgatagtacaattaatgttgatgtcaattttggtgttaattttgggtcatgattagtgttgacactttgtgtcagactaatggcatttatgggcaccatcagaataaatgttaatattatcatgttttcactatctgttatagtaacattaaaccaaggtcctcccagcagaaaaaatacatatatggatagatagataatgcctttctgtatcgctggtgttactcagcgagaaaatgacatctcagggcagaatcctaatcactgtttggagcatcagaaataatgatcacctctgatcggaggttgtgaataattcatttggtttgattttcacgtcctgtccagtgatacttttcaaaccaaatgtgtttctacaggaaaataatggtcccacttcttatggaaatactgtggcacaaatcattttacccacataaaaacagttaaataagactgttctcttctgcttgctttctccttcccatcccctcctccctcacttgagctgttcattccagaatcagaatgtagccaaagaaatatgttctgccttagaacttgtataagggaaacaaatatttatttctgcttatccttagcttattcactgtggctcttttcatcctcttccctttttcactttaagataatcagcttaggttgataaccctaaacctaataaacctgctcgttggaatgttctgttatgaaaaatgatctgaaattaaatattttaaaacttattcatggctatagtaatgacaaaataatttgtagtaagtacctaggaccacttgtttagtcagtgcatgagagaggcagtgatcagagaagacgacactggcactgcccgtttgagtctaaaactcattagaccataaacccacccacttacatgcgggctacagggtacctttttgttaatttcttagctcttccatcttccttcagctcttagtcctggcatgtcattttcactgggtttcacctggataaaaatgttggagagaaagagaagacccccaaaaagagggatttaatgatggggtctccgttagtcattattcttcaattaatatacatgcagattgggcttaggtgaaatcaatgaatgtcacattgctaatcacattgtcacactgtgtatacttttatagtgattgtagaattttcgatatgaaatctccattatgtatataatatagatagacccatctatagaaagtaatttgactgaaaaacttaacagtgtactaattagagagtgaaatatgactctcttccaaagcaatgatctaatcctttgagatgaagctattcttaggtagaatattttgaaccatttctcctgaatgttgtaacccttttttatttttcctaaatctaacaagggcagagggaagcatttttcaatctagttttcatcatcagacagaaagtattttgcattcagaaaccatttccagtatcaaattcaattttgtcaggtgattagttgagttgggtagagaataatttaaaaacacaaagctggaaatggctatggtgcttctacactggaggagagctgttgctattctcaagttgcaagcttcctctcagtgactgtgcatcacaactggattattgtgttgtatgtctttgcagctgttacagacctgcatctgttgacaccatgtgttcctacccaggactggtagaagaaataggggagtgggtgaatgagtaccttccctgcctatcagtgcaaacgtccttttatgtacatatgtttgtaaagttctttagccctcttcaagatgaaaggttctgtataaataaaagctttcgattttagtacatgtttgtaatacatgtggtacagtcctaaatatgtatttagctgataggcactgttcttgtctattgtacaaatattgactttaaaaatataaatatgtatttaaccatcagaccagaaaaacactgaagcagttacttctgaggtagagacattaatattgtataaacctatatatacatatgtttacactctaccacatcattgcagagcatttctttttagaaaatgaaatgataacccaacaaactaacgtagttcttgatatttctttctctttaaagtgagtcttgatttttaattttcatacatttatctctttcaaattttatataaataagatcggttgtagtatgactaaaatctagaattagttcctctaaaatatgggaaatcaattaggctggtgagatttttttccccccttaaatttttttttttgttatggaaatgctcaaacgtacactaaagtaggcataaataatataaactcccatgtacctatcacccagtgaagagtatttggtagttttcttttctcagttattttttattttataaaaagttaaagttatcaatgcaatataaacacaaaaaagaaaatttggagaatggaaaaaaaatacaatttcatcatcccaataattatcacctcattttgctgtttcttatttatttttgtttttaccccgcaaagtgcttttcaattgatgaagttgtcattcatactatgcacttactatataccaggcactatcctaggacttaacatgtatttaatccttacaacaaacttatgccgtagatttttattacccttgttttaccagtgaaggaactgaggtacagggaggttgataacttaccttagcgtatatggctagaaagctgagtctcagttctgtcaaattatcttagattcagattcagagtctcagaatgtggctcctgagtctgaacccttttctaatttagtattacatcatgggtatttttaaatgctattcatagtcttcatagtcatcatcttataaggctgtacagaacactaacagtgatcttactatccaatttacttccctccaaaataattttagattttcaggaaagttacaaagatcatattagagagttctggtataccctttcccagcttctcttaatgttaaaacactttatgtaaccatgatatgattaccaaactaagaaataaatattgatacaattgtattaaataaaccacagacctcttttttttttttttttttgccagtttttgtactaatatctttttaattaaggaacatacttccttaatttctctagtaaagaaaatgccatttcttggctgggcgcggtggctcgtgcctgctatcccagcactttgggaggccgaggcaggtggatcacctgaggtcaggggttcgagaccagcctggccaacatggtgaaatcccgtctctactaaaaatacaaaaattagccgggcgtggtgttacgtgcctgtaatcctagttacttgggaggctgaggcaggataatcacttgaacctgagaggcggaggttgcagcaagccaagattgcatcactgcactccaacctaggcacaggttgcagcaagccaagatcacgccactgtactccagcctgggcaatggcctgagactctgtctcaaaaaaaaaaaaaaaaaagaaaataccatttttgtgtatgtgaaactccttttaaaaaataagcactttgggaggccaaggcgggcggatcacaaggtcaggagttcgagaccaacctggccaacatggtgaaaccccatctgtaccaaaaaaaaaaaaaaaaaaaaaaatgcaaaaattagccaggcctggtggcatgcacctgtaatcccagctactcaggaaactgaggcaggagaattgcttgaactcgggaggtggaggttgtagtgacccgagatcacgctactgcactccagcctgggtgacggagcaagactccatctcaaaaaaaaaataagtaaacaattcacattagctataaggacaggttacttaattcctctgtgccttaatttcctcatggcaataattacagctacctttgaattaatactgactaccatttgagggcttttgtgtgccaggctctgtactagtttaacatggtgttgctcacaacaatacctccagaaaggtgctgtcatccccattttataattggaaaagtgaaactgtaaaaggttaagtgtccaaggttatacagctagcataaaactgagatttgaaccaagacagcttgactttgcagcttaagctcttaaccactatcagtagttgtcaacttttagaacagtacagcagatagtaaatgttcaattaatggtagttattatgatagctattgttatttttaaaataaaatagtttaagaatattcaggactcttattctatgattcctaaaatataagtggcaatgttctaagcccttggtgttaagtatttttcaagtgttatttttaaaagtgaggcagggtgcagtggctcacacctgtaatcccagcattttgggaggccgagacaggaggatcacttgagtccaggagttcaagaccagcctgggcaagatggtgagaccccatctctacaaaaaataaaaaaaattagctgggcatggtggtaacacacacgcctgtggtcccagctacacaggaggctgaatgggagaatcacttaagcccaggaggccaaggcttcagtgagctgtatttgtgccactgcactccagcctaggtgacatagcaagaccctgtcttaaaaaaaaaaattaaattgaaaaaataaaaagactctggaactagcaaacatttattactcccagactatgtttaatgttcctgggaagcactagaggagatgctataatcgttcaagatggtaagccaaaagcaatcctaggcagcatataattagttatcagaagaattctcaggctgggcaaggtggctcacgcctataatcccagtaatttgggaggcctaggcaggaggatggcttgaggccaggagtttgagaccagcctgggcaacatggtaaaatcctgtctctacaaaaaaatgcaaaaattggccgagtatggtggcacatgcctgtagtcccagttatttgggaggctgagatgggaggattgccttgagcccaggagttgaaggttgcagtgagccaagattgtgccactacactccagcctgggtgacagagcgagactctgtctcaaaaaaaaaaaaaaaaaattctctacacagaggtcttagtaggagatcagaaaagataggaattactttaggctgggagaagctttactgaggaaatggaatttggatgaaccttttggaatgggtaagatttggacagagtgagaggagaggagagagaaagacaaagttttttacgtagaagttaatatagtagatttctgcttctaatagtgtgtttatcaaacccatgggtattattttcttaatttcgcatgtggggacattgaagctcagtaaaattaaataattttcttaagatcacacagttagttaatataagtgatagcgcctggatttggatctaagtttgttggactccaaagcccatgttcacctttatatgccctatcctttgattagcagtgaaatctaaattattttaatgtaaattgaataatagtgctttcttagatgtttgtccatcatgctacctcaaaactgaatgtcttctgatcaggaatcttgctgcactgagactgggataacactctccattctgtaatggtactttttaagatggggggcggggcggggtggggaggcggtcgatgagcaacatactttggaaagacattgataaagaatagtgtgttcttggtgctgctgtgctgacacctaattagaagtcaatattgcaagcataatgacctagccaattgctgaacttgctgcccaagtgacacagttagagtccccaggtagtaatgaaagataagagtattatttgcctgcccagtgccacatggtcgcaatgtttacattagcacacaaatgctgaagtagattcttcagggcttgtatctaagctgcttctggcctatgtgcctagggttaatatatcataaaatttggtgtaaaacgcaatctttctaactacaaatgcatttagaggaaaattgacagaaaatagcttttcattcctgaaaaacaaaaggtttggggttagaggggcatgtgtgaaggcagataaagcatttctcctcatgcagggattatattaactagcttcttagaaaccacaaccaaaattatcctgatatttgagtgttcactgtgttattttttgaatgatctatttttccttcctttctctgtctttaatgagtagatagagtaataccttatcttagaaagtgattggatttttttctgtgtatcatatccattttgacttgtatttggccaatggtatgatatattaaatagcttatatttatctgagggtgtttcatatatatatttcctaatgctgagaatcacaaatagctgtgtagaatgcttcaaccagcctgattacagtggatgtgcaattggattgaggaatgtgtactcagagcttatgatcactggcctggttgagtctgggtgatgcatgtggctttccagggatgccgctatttacatctgttaatggcccttcttgatggccagctccccaatgaggtgatatgcagcagcctggggatgagggaccaaggctgcagatgtggctggggctccattaggcaggaccagggaagctcatctggtaggtaggctttgtgtttggtggcgagtggtgggggcaaggaggggggtgagagacagaaagaaagggggaaaaaaagaatggaaaacattacttatccaggtataggggaaacaggcaggcagacatgaaaaactacagctgtaactagcgtatgaatgaatagcatagaaaagaaatggaactagcaaatatacaagtagaaggattgactagttctcatatagaaggggattaaaacaggagagggctgtgagagtttgggaagagacatgtcacctctgccttttaagtcaatatcatttatttgtgtagctggccagatgctgctgaacagagagcagagatttacatatagtgcagcaagagattagttatttccatcctttggtttttctggtgctagaagaaagcaagagatgctcacaaggatgcaatgttgagcattggtaaattctagcagaaatggaacatacctgaaacaaatcagtaaagagtgtttctgttattcctatcaaatgctagaggacagtacaaggagcctggatcatgaaaagtgtacagtccgtgagacgtcatcctttttctgcttccttgtgtgttaaaggtttcttggaacaaatgtcacaaaagatggaaatagtgtctgtgatagtccatttgtgttgctataaaggaatacctgaggctggataatttataaagaaaagatgtttatttttggatcatggttctgcaggctctataagcatggcaactgcatctgttgggcttctgctaagggtctcaggaagcttatgatcttggaggaaggtgaagggggacccagcacatgacatggtgagagagggagcaagagagaggtgagagggagcaagagagaggtggggggcaaagtgctacactcttttttttttttttttttttttttttttttttagcaccgtgacatttttgagttaatttaagccacacctgggtgagagggccctgcacctagaagaaggtgttgggactcttggtggtgaagtatggcttatgctaaccatgcaggaccccatggggcagtgggaacttgatctcggagtcatggaactgtttgaccgccagctggcagcacttgctggccgcagtctccaccttcatgatctgggtggagtgggcctgtgtgtgatgccaggtgcccatgtctcactagcactggatgacagcacccatggtggtcaagtcctgatatccagtacatgttgtaggtgctgctacgggagtcgtagtgcagctagatgccagatttcttcacctgcaggggggatttctcaaacacctacctacagtagacaattttccctgaagactccttatcttctttagctgagataccaagtaccagagacgggacttgacaatgacatgattaggtgcaagattcgcataccatagaagggcagcatgtggcatttgggggtgggcaggcagcaacccaccaccttgtactcttgtagtgtgcccaaggcgttcatagcactctcttcatgcttgctttcacccacaagaggccacactctttcaaacaaccagatctagcataaactcagatcaaaggggagcaccaagccattcatgagggatccaccccatgacccaaacacctcacaccaggccccacctctaatgttaggaatcatatctcaacatgagatttagagaggacagacatccaaaccatatcagtgtcttagtatatatggcagtaaaatgagatatctagatttaatcaacagtgccatggcattcttccacatgtatcctgagtgcatttagattttggcttttctgtcttctttgagcaggcccaaagaaggaattgagacagttttgaaatacacagtagaccagctgttctcagcataatctagcagtatactagaatgtcttttgtagtttcccacagggagtttggctctttagcaatgtgtatctttacataatggctgtgcctaggtatactctgataccttcaatgaacctgaaaaaaattctgcctgtaagaaacttctgttcatttgtttgtttatgcctttccagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaaggtacacactaagagcatatactacttcaaggtgctatatggttatgctacatgtgtggagaggtgggggaagggtagaggtttaagttcaaaaatcaccacttatggtaaaaattaaatataaacaaaattatttgtgaaaattccttaagacaccatattaaagacaaattatttctcaatatgttcacttggtttttcttccatctataaaacaggttgctgtttctttggttgagcactagatgaaatagtaggtatgcatttagtgcgagacatgctaaatcaaaaatatatatctttatttaattgtggcttccaggacttacggtcaattatcaacaaaatcccttacctcctcatcttctgctccaacctccttgttcaccttgagatctgtctctcctctaaagatattgcttcccccgtagccctctgaagtactgactgatttctgtctttcttttgaaccactgagcctggaaggggaatattgtcctccttgatcctcattgctgcttccagacacctctcccttctctctgaaaaaatcccatctttgaatctcatgtcatcagactgtgccatacccatactgctccttgtgtttcctgatcctttggtcactccctctcattctttgcatcttttagttcctggcacattgccactctgtccattactaatagtcatgtgataattcttggtgattgctatatccacatagatgattcttcccataatctggcctcttggatccttgacttcttttcttctagtggttctgtcctataccctagctcagcctctcattccccataatctcaatttcaagtatctctttctttgctaccccctccatcctctctttccagcttcctctctctagtccaacaatcctttgaaatcatcagtaccattgagttgaactcacctgtttatcctcccacctttcttctgttcttcactccctccttacacctcatttcattcctatctggcttaaactccaaggtcagtccttgattaatcattataatcaccatcttttctgcaccttcaactttctctctcaacttgcttcaacttgcttctctcttcactctgcttactctgtgcttttacagagtgtttaaatccaactctctccattctgctcccatgcctgcacctgcccagctgaactttgatggagaaaaaaacagttctgttgactgatcttactttaaattcaagcttagcaacctcctggatgacggtttcacatctctcccctcaaacctgtaacacgcacttccctctccccactcttagctgatatcatcagaccttgcttcccaattttcaagaaaagagaaacaatgagaagagagcttctacaagcttccatgtacctgcatccgttgtgcccttactcttcaccttctcttccacactttgaatgaatagttcctacttctgtctaaagacaatccctcctcttgtacatttgatctcctttcttgctaacttaagtgtacgatcaacacttcctcctgctcttttgtgcatcagcactttttccctctgtactgtatcagcccttttagcatacaaacacccctccagtcactgtccctcccctccttccctttacaggaaaattgttttaaaggagttgttcttgctgtctccagatgttcttctcccattccctcttgaacccacttcacttgagcttgcacccttaccattccactgaagctgcttttgtcagggtcaccagtgattccatattactgaattctatggtgaattctcagtcttcaccttagttatttgacaatagcattagcatttgacacagttggtcattccttcatccttgaaatactttcttctgttggcttccaagagcccaaagtctcctttttatcttcctgcattcctggctcctctttctcagtttcctttgctgcctttcacatctttaaatgtaagagtatttcaggagatgatggaaatattctatattttgattgtggtggtggctacctaagtacatacatttgtcataactcatcaagttataacacttaaaactgatgaattttattgcatgtaaattatatttcaataaagttcatagaaaaactttattaaagtatgggaattgatccagtacaggggtttttctggggctgatgaaaatattctggaattagtggtaatggttgcaaaacatctgaatatactaaagtctactgagttatacatttcaaaatggtgaattttggctggttgcagtaacccagcacttcgggaggccgaggcaggcagatcacttgaggccaggagttcgagatcagcctggctaacatagcgaaataccatctctactaaaatataaaaaattagctggtcatggtagcacacgtctgtaatcccagctattcgggaggtagagaggcatgagaattgcttgaatgcgggaggtggaggttgcagtgagccaggatcgtgccattgtactcagcctgggtgacagagtgagactaaaaaaaaactttaaaaaccaaaatgtttaattttatgttatattaattttatctcttttttttttaagagacagggtctagctctgtcacccaggctggagtacagtggcacattcatagcctactgtatctgccaactcctgggctcaagtgatcctcccacctccacctctcaagtagctgggactacaggcgcacaccactacacccagctaattttattatttttcataaagacaaggttttgctgtgttgcccagacttctctcaaactcctggcctcaagtgatcctcccaccttggcctccccaagtgctgagattataggcattagccactgtgcctggccagtttttttaattataaaaaaaagtgaatggagacatgtcaggagcacagaggctgcagcaggaccaagaagttctggactccccattctcaaccccactaggacccaatgccctctcacctggtggtttggcaagacagccaatatagaaagtagggtagaaggaaaaaagtgattcaagggcttggtccctggactactcctcttttcctattcaccttcccttggtgatctcatcctgtttttttgttttgttttgtttttttgagacagggtctcactgtgttgcccaggctggtgtgcagtggtgcgattatggctcaatgcaacctctgcctcctgggttgaagcaattttccagcctcaccctcctgagtaactgggactacaaccatgcaccagcatgcctggctaattattttggtttttgtagagatggggtttccccacgttgcccaggctggtctcgaattcctgagctcaaagtgatccgcccatcttggcctcccaaagtgcaggaattagaggtgtgaaccaccgcacccagcctcatccagtcttttaaagctttaagtttcatgtacaagctgataaacttccaaatttatatcttacccctgaacacaagattcatatatccagactcaacatctctacttacatctgcctaaatgtctgcctaaattgtagcttctaatcttcctttaatgtgttcttcccacagtcttctgtctcaacagatggtacctctattgtttcatttgttcaagtaaaagaccttggagttattcttgacttctgtctttcttgcacaccccacattcacttccacaccccattcatccatctaaacagtaaatcatgtttacatccctaccttaaaatatatccagaatctgagtacttctaacaaattccacagctacttactagcagtagcagtagtctaactcttcttacctgcatattgcagtaccctcctaattggtcttcctgcctctggccttgctcccagccccacccaaggtctgttctcaacagaatgtagaatgaggccatgtgtggtggctcatgctcatgcctgtaatcccagcactttgggaggctgaggcagatggatcaacttgaggtcaggagttcgagaacagcctggccaacatggtgaaaccctctgtctactaaaaatataaaaattagctgggcattgtgacagatgcctgtaatcccagctacttgggaggctgaggtgggagaattactttagcccaggaggcagaggttgcagtgagtcaagatcgcaccactgcactcctgcctgggtgacagaaggagactctgctcaaaaaaaaaaaaaaaaaaaaaaaagatagaatgatctagttaaaatataaatcagatcacaaaatttttctccacttaaaaccctttaatagcttcccaattcattcaagtaaaagccaaagatcatatagttgcctacaaggccttacatagattggctttccagtaccactctgccctcatttcttgctacagcctcccctgaccattccacacattggctctacccgactctgctttcttaaacctgcgaagcacatcatgcctcagtgcatttgtacttgctgctccttctacctagaatgctttttcctcagatatcctcatgtctcatagcctcagctcctttaggtctttactcaaatgacacttttcaatgaggctttccttggttattttttctaaaagttcgactgtctaccttctctttcattttgttttccttaaacgttattcccatttacattatacattttacttattttgtgtatttcctgactttccgagtaggaggtatgtttcataagggtaggaattcttgtctatttttgttaattcctgtttttccagtgcctggaatagtaccttgtacataataggcactcagtaaatgtgtactgactgacatactaatgacactcagtgctgtcaggcattctcaacacaaatcatgcaagaccaatcgcagatttatgtcttttccatgttgtgctcactgtgggacatacatttattgagttaaatggtgggcataatttctcatagtatttaaaatgcttccctgtgtttacttatttttttgactgagtgactaattcacttaagttaaacacatataccatgtaactctactttgtatgtggctgtgtgtatagatacatataaatcaattatgaaatgttagtataattgtttacatgtaaatgggcattaggagttgtttattgaaaaaacaaaagatctgagttcagtgttcactattagcactgtgtagacttctgattttaatattgaatctcctagatttgcggttttctgttatcccttgcttatatttattttgatgatcctgtggatttgagagagtgaaaaatagtaattcacacaattctttaattacatgttgatatctttaagagatgtcactaaagatcagaaaatgaccctttaaccctgttgaaaatgaaatgaggccgggagcagtggctcacgcctttaatcccagcactttgggaggccgaggcgggcggatcacgaggtcaggagattgagaccatcctggctaacacggtgaaaccctgtcgctactaaaaatacaaaaaattagccaggcgaggtggtgggtgcctgtagtcccagctacttgggaggctgaggcaggagaatggtgtgaacccaggaggcggaacttgcagtgagctgagatcgcgccactgcactccagcctgggcaacagagtgagactccatctcaacaaaaaaaaaaaaaaaaaagaaagaaagaaagaaaatgaaatgaagggaatatacttggaattgcagctataaggtgtcttgtttcaaggacagttagtgagtgaaaaaataggcacttcatctttcaaaggaggactgtctgtgctagtattctgttagacagtaaacctaagaagtgatgtggcaatttaaagctagctgtggaacaagcttcattatgtatgctttgctgtatcttctgattatatgacaatggcaaataatgagttaaaaactatttgtgcttcacagggatacaggtatttatatctgactcctcaagattataagagagtcagtgctctcaactctgtccattgtgaacacgtggaagatgaaggagaatccaggtaggtatatatgtattggaataatttggtcatgactaaagaaaggagaatatggtatttttttccatattgtacagctgttcataaccttgaagaacattgaagatgacataatctagatgttttaggtttacatccagctctaccacttattagctgaagaaccttgggttattgattgaagtttttaaatttataatacttaattcattttagaaaaactgaaacatgtaaacaattataaagaaaaaaaaattagccacaatcccaccttcaggccacgattatgaatttatgttatacacttgctgtcttttctatagacatatcttttttctatgtgattgagatgataacaagaatttcttttataatttatccttttcactaaaaactatttttggggaaatttcgtgtattcttaaaacattatttaagaatatgatgcttaatgtctacatagtattttattataataaatatatttgaacattcagactatttctaatttttcacatcccttggctgaacccacttaagggacatttatataagtttcatataaacttttaggaattaaaagctctgatcatccctttttggttaatttctagaagagaaattgcaggtcgaaaagtcaatttttaaggattttaaaaaataattttaaattgccttcccaagatttgcatttctgtcagcagtgtagaataggatttgtttccctctttaatttttcttcacccctgccaacattgattatcaattaataaaatggaataaaaatggcaattgttattttaacttgtatttttgactcccagtgaagttgaatgtttttatataatctatctgcaagtatttttaagaatgttaattgcttggctgggcgcagtgtttcacgcctgtaatcccagcactttgggaggctgaggcaggcagatcacttcaggtcaggagtgcaagaccagcctggccaacatggagaaaccccatccctactaaaaatatacaaattagccgggcctggtggcacatgcctgtaatcccagctacttgggaggctgaggcaggacaatcgcttgaacccaggaggtagaggttgcagtgagccgagatgacaccactgcactccagcctgggtgacagaacaagactccatctcaaaaaaaagaaaaaaaaaagttaattgtcctaatactatttactgaaaatttactcttttgtgtttttttgttctgtctgtctgctcttgggctaataccacactatttaaactattctagtgaggcaaattttctcacatttttaatttttcctcaagtattattggctacttttgctttttttaatgtagagggtttttgtttttagagacagggttttactctgttgcctaggctgggatgcagtggtgtgatcataggtcactaaaccctcaaactcctgagcttcagagattgtcccatgtcagcctcccaagtagctgggactatagacaggtgccatcatgcccagctaattatttttttaattttagagatagagtcttgctaggttccccaggctggtctcgaactcctgacctcaaataatcctcccacctcaacctctgaagtagctgcaatgacaggtgcaagccactgtgtttggctagagtctcatgtttttctaattccaaaaaagttccataatgattttgattcagattgtattgagtttacacattaatttaagaagtgacatcttcataatactaactttccccaaaaagaaacagggtatgtttttccatttatatgagtggggttttttttgttttgtttttacgttttgtagttttcttcatataggttttgccagaggttcccaaactttcttggttcatggcatccttagtgtctcagtaattttttcatagcacccctgggctataagatatacttaatatttctgcttattaggtagttaaacaataagtatttgcgtcctaagaacttaataatcatttgaaaaaattatatacataaatcgaaaaaatttattcttaaataattacagtttcttactaatgagatatttgtgtctgcataacctctcaaaccttggaatcagcttggatatagccacccacatttcttgttcttcattgagttttcacagaaacttcaaaaatctagcttgcaaagacaggacattttcaaaaggaatgtagcaccattctaacgttaaactgtgaactactatgaactatctaaagctagtagttcacatagggtcacagataccacatataatagtgcttctctcaaaaatttaaaatatcttgtagtgcttctgggagttcatcatggtgccctgagacacaatatagttacggtgagattctgccaatttcttcatgcttatttctaaatattttgcattttttcttgctactctgaatgggattttcccctatgatattttttaactcttcatttctggaatctatgaatattgagtttgttacaggcaagtctggctgggtccttgaatatttatgactatatggaccttatacaaacaggcacacaaacacatatacaattaatgtagttaattaacccccttaagggacagtagcctcatttctgacataactttaggatagagtctagatacagaacaaaaggaagaactgggaaattattggatattaggagaggctaaaaatagaaaggcagcagaatctgggaagcagagatgcaaagtcacagaccaacagcaagggcaaagaaaaagaattgatggagggctggaaatgaagaagggagcaggaaaatatgggggcaggaggaagtattttaagagccactatggggtacttatttattatttcaatttataaaactgtgcccactgccaagccttctgggtacacgtggaacaataaataatatatgcccatctctacttccaactttgtatttttcctttcttttattagttgcattccccatctcccatttcccattatcagctatcactcctaatcccctgccaggaagacagatgagtgactcccactagatccacaggatgctttctggacaacttggtcagcatttcacttctacacacattccaccttcccctccagaggacatatccagggacccttgtgtatatacttgatatttatgaaggagtatgaatgggagttcagtattttgacctttgcttcatcctaccttagaagaggatttttgacttgagaaactaagctgagcattctcactaccgctctgtttggatattcttttcctacgtaaaattgtctaaaattgttgatatgatgccttttgctcattatagagatatacattgaccttgcttttaagaaacttgttctagaaaataagagagggcatctaaaatccgagggccatctataacatcaaaccttttccttgtttgctttagtttaactttcttgtcaacccttagaggtagatattattattcccattttgtagaagttattattatttctagagtcacactcctgtgtgtatcagagcaaggatttaaatctatctgcttggccgggcgcggtggctcacacctgtaatcccagcactttgggaggccgaggcgggtggatcacaaggtcaagagatcgagaccatcctggccaacatggtgaaaccccgtctctactaaaaaaaacaaaaattaggccgggcgcggtggctcacgcctgtaatcccagcactttgggaggctgaggtgggcggatcacgtgctcaggagatcgagaccatcctggctaacacggtgaaaccccgtccctactgaaaatacaaaaattagccgggcgtggtggcgggcgcctgtagtcccagctacttgggaggctgaggcaggagaatggcgtgaacccgggaggcagagcttgcagtgagccttgattgcaccacttcactccagcctgccaatagagcgagactccgcctcaaaaaaaaagaaaaaaggctatctgcttaattccagatttcgctctttctattaaaccatgttgcttccaggtaaaataggcaccaagctaagaaggaaagacatatgaatgaagagtataaaaggaagcacataaagccctggcattaaatataagctttcaatacacttttagccgccttttattggtgattattcttttaatggcttgttgttactgtgtttaacattcataatttgacatggccatatccaataggtacaagataacagatattattgggaaagaagagggaattggacccgagaaccttcgaggttctggaatgattgctggagaatcctcattggcctataatgagatcattaccatcagcctggtaaatctttccagaatgtgaaatttttgaagaactggctgtgtggctaggtttatttttttctcttatcactgctattcagtcccaaatgagagcatttcttgaagattgtatgtctataattatattttaatcacacatgataataggaagataggataatataaataactgaatttttcaaacaaacccagcactttgttttagcttttagtgtaacttctttttattttctttcttttttttttttgagatggagtctcgccctgtcaccaggctggagtgcagtggcacgatctcagctcactgcaacctccgcctcccgtgttcaagcaattttcctgcctcagcctcctgagtagctgggactacaggcgagtgccaccatgcccagctaattttcatatttttaatagagccggggtttcaccatgttggccaggatggtctcaatctcttgacctcgtgatccacccgcctcagcctccaaaagtgctgggattaccggcatgagctaccacacctggcccctctttccttttttttaagagacagagtcttactctatcacccaggctagagtacagtggtgcaatcatagctcactgcagcctttaccccctgggctcaagtgatcctcctacctcagcttccaggtagctaggactacaggcatgtgccaccacctccaactaatttttaacttttttgtagtgatgggggtctcactatgttgcccaagtaggtcttttttttttttgagacagagtctcactctgttgcccaggatggaatgcagtggcgtgatctcagctcactgcaacctctgcctcctgggttcaagtggttttcctgccttggcctcccgagtagctgggattacaggcacgtgccatgacgcccggataatttttgtatttttgctagagacagggtttcaccatgttggccaggctggtctcaaactcctgacctcaagtaattcaccagcctcagccttccaaagtgccgggattacaggtgtgagctgcctcgcccggccccaaggtagtcttgaactcctgggctcaagtgatccgcccacctcagactcccaaagtgctaggatgataggcatgagccattgcacccagcctgaattttgcatcattgtattttcttttctttgaccatgaaatttgtgtgtgtgtgttgttgtcaatcaaatagacttcataaaaagcaatgtttatttctgttaatttggattttacttatctatgccttagttcttatagcttcagagaggacataaatatgtgacatgtagaatttattcttttctaaggtgacgtgccgggccattgggattggggcttaccttgtccggctgggacagagaaccatccaggttgagaattctcacttaattctaacaggagctggagccctcaacaaagtaagtttctagggttttgaagaagtatgcatagctgattgaagattattgtgtgaattcttaattcaagatcctgattggaaggaagcagttcaatccgtgccttcctcagtctatctcttcccctctccctccatcttttctgcccattgacttgcttgcctttttattcattcattcattcattcatttcatttatcaactattttgagtacttactgttttctaggcactgttccaagccctgtgtatatgttagtgaacaaaccatataaaaccgctgctctaaagtgcttatgttttagtgtcgttgtagaaagacagaattaattgaacgcttctgttctgtcccacttctctctttttcttaatctattagtaaaagatgtgaggagatctatacacagacattgagctgtctctgattccagctgtgctggttcccatttcaggcctacatcatgaattaggtaccggcctaggtgttgagactatcaagttttaatgattttgtgaaatctgtaaatacacctctcgaaaagggcaccgatggtggtctcttgtatatagaagaaatatttggcaaatattgagtgggaagatgggtggatggatgcatggatgggttactgggaaagagtatgcataaagatttatcttcccttccaaagaaagatttgtgcctttttagtccaacttcacaagggtttttccaaaggggaaaaaaatggatggcaaggtcactgctcgaaagagtgaaaactatccaagaatacctgaatgtataaaggacagtgcagttctgacatctttgcaagcataggaaaattattttctcttcagggccagaaaagtataatggaatattctgaggctgactgcccttgtgcaacttatataacctctcagctcctcagctttcttatctgtcaaagggggataataatttaaacctttaaataatgtggagctcaaatgagaaaacataagtaaaagtacctagttctactgggcatgcctagattcccagctactcaggaggccgaaacaggaggatagcttgaacccagaagtttgaatccagcctgacaacatagtaagaccccatctcttaaaaaaaaaaagagtacctagttcttggcaaaaagtgttggcccacattcaaatttcagtttcccgttcctctctctaacatgatttggtgattgagcttatggagttaatacacatactaaattgtatcagatattatgtttactccacttgcaggaactttttatcaagtcttgactttcaagtttaagggtaagaattaagtgttctgtcattcccatttaggaaaaagttgataattccattggtttaattagattttgtggatgtcagaaattagaggaatcatttgatgcgatcagcttgctctgtgcattcatatgaactctgtatcctcctctgggcttgcttttctcatcaaggaaaggcacagcagtgctaacagtggcgaacttggctgtcttcctccctttttggagagtagcctggaaataaaggttgtgaaccactactactgaagattattattgcagtgggagaaactgctgagagtcttaaggttgttgttttttttttttttaagttgctcttttggataccttcttaggatgagatattgatgaatgccaaagataattttaggtaccattatctatgagaacagaatttttgaaagattttaaaaattctgttctcatagataatggtactttaaaaacctatatttccatgatgttcccatacccagtcagagagctaatttctgaaatatatcttcttatattgagtttctttctcccccctgccccgatactatattatatacaaagaatattacaaaaagcagatgttgggtttttggttttgttttgcttgaaaacttgctagttgaatttcatttgtgccatgaagaaacattagagattgatttcttaaaatctgattgaattgttctaatcaaattcattatattcactgtcatagcttacagggctgcttgttaaaacaaaagcttagttacagggtgaaagataaataaagctatagctttaacttaccaaacaatgctcacttccaaaagggcatatttgtttttagctgaagggagtgatcagatacagaggttacctaatgttgctctgcctgcttcactatcttcatgtcagctcctcttaagtatagagctgtgctgctgaagacacccgattttatgcaaattcgttcagaatatcctattagcccctttgcctataaggtatgaaaaaaggaaactaccatgctcagatggcttcctctgactcactccttctgtgtgttgtctttgtgtgtgctggtgtttttcttcatctctgtttgcctttctttctgtaggtatctctctgtattgtgtactttgggtgtgtgcaagtcaccctgagtgcatgtctctttctgtgtgggtgctgatctttctgtctctttgtgtctgtgtcttgcgtatagatccccctctttctctgtctgtgtgccgccctgtgtgttcatgtgtgagaaagtctttgtgtttttgaaacattatagagcctcctttcttaagccttggccattttgctcatagtatgtacctgtgtaaggtggaaatgtaggagacatgcaagcttatatacagtcttagactgtaaatatttgacccccacatttttgagtcttcatcctttatgttaaacattggggtgaagaataaggagtgggggtgttcagaggttgtaggggaaaaaaatcttgtgtgtgcaagtgccgatcctgttgacccctttgaaaattgaaataatgataatgcacgtctcctgactgcatcaaagtatcagcacatcaaaagccaggaggcatgaaatgcaaatgataaagtgaaagcagatggattgtgcatgatcgcctgatgcccaatgaattttaaaaggtgctggtttgcaggaaggggggttggggggttttgggggggactgaaataaacacgttatccctgcaatttttttttgttcttgatgctcactcctgacaatattttttcacacttgagtgaacaccctctctctctctctcccccctccttcttctctccctttctctctcctctccaaatcccctcctctgccccccccttcccccccacctcttacacatctcaggtcatgtcgctgcagctccggtggaaataataagatataaaccacgaggttgttatttgcatagaaatagcatggagccccaggcagcaagggagaaggacacagggatgatttgtctaaaattttaatgaaaacttttgctgaggcagagatttttaaaaactttctttctccctgcttttccccttccttcccctaccccccaaaccccatcattgattttacttaacatggttcagtttgaagagaaaaggttgacactccacatatcatactcccataatgcagcaacctgtaaattgtttcttcctttaatagatatgaagctgaagagacatgcattttcaacttaatacattgcatgtgtgcgcctggcttttatggctatactccatcttggcatacacatgatgttgcctgtcattagcctgtttttaattagtttacaccttcctatcttttgcttccaaagactcttactttttaaaggatttctttttatagccaacagtagtaaccttcatataaaataaatattttctggtgttttcctgtttttttacttttggtggtttttctgtatacttacatgttttattcatggacgccatcctttgtcactgtgtcttttattccaaaaccaggaagtgcttcccaccttcgtatttttatccttttccccctgtgaactcaccatttgtgtatcttctttccatgtctgtcttgctttgttgcctgcagttatttgtaaaatattcaaaatattacccaaattgagatgagttgtagtatctggattttattgagtgttactaagcacatttgacattagaactaaaggcagtaggctggtgattagaagcagcccaagtgggtttgcttgaaattcagtcaagaatatctgtctggttccttgctatcttctggaatgggctaatggtatcagggctatatttcgtagacaggaaggcaaaaacagaagggaaagtgacttagtttcattgagagagactagatcagggtcagaacatgaactttcatgtccctaagtttcactgaagaaagctcaggcctctttgcttagtggtctgtaaagcctaagagaaggtggtccggtcgttttcctgtttgtccaaatgtcgtgagaatgatgacattaataagagaagtttctaggggcttgctatttcatgtcactcaaggtagtagatcctaactctaggaactgtaggctgtgggtgacagattccttaaaatgcctcactgcgtggcagacctgatgtgtgtggcaaattaccctgcttgaagggagtcatgctggcctggcaaaggcagtaacctgtgtacttggggaactgttaagatgcacccttaaggagctgagatgattgcagagtcataaactcttaagtctatttgccactggacatttgcagagatgatcatatttacttccctcctcccaccactcttcctctcagtttcctttttactttatttttttctccctttcctggtaaaagtattagtatgtttaacatagtgttaggtggcagataggctgggaagagctagtattgtaaaggaacactgatgtgtactggagcctactagctctcaatccattgccccagacttggggagagagagcacattctctatccagagaaataagaatatgcagtttatggttgtcctgtggacattaactgactgtgaaggtaaggtatatgccaaaggcagtgatatgcaggtgatagattcaccgggagatgatatgtgacttttcttgtattttaaagctctgcttcttttttagaaaaaaaaaaatcctatactctcatcccccttagcgagatcaggcccctatttccactgaatctgccaggaaaaaagaagttatgtgatgggtatgactagggccattagtttggtagggggctaattctgctaatcttgcttttgagacttggtgcaagtaagttacatttctctctggttctcatatatgtatttttctgcagctatgcagtatgaaatgtgaagttgtcatagctgactctgttaggcacagtaccagagttcctctcaggagtgggaattgtctgttacaccagggacctgcactgtgtagtctccatgctcacccacccatgactctgtgaaacacagcatgaaagtcatggaggctcaagaagggaaggagagattacttagctctcactgtggggcgggcagcattgtaactttcacataacttaaagaggttacgatagagacagcgccggggcaagcgagagccagacaggcactgggtgactctgtgcctcgctgtggaaaaacaactaaacatgggcaaaggagatcctaagaagcctagaggcaagatgttgtcatacgcattttttgtgcaaacttgttgggaggagcataagaagcatccagatgcttcagtcaacttctcagttttctaagaagtgctcagagaggtggaagaccatgtctgctaaacagaagggaaaatttgaagatatggcaaagacagacaagacccattatgaaagagaaatgaaaacctacgtccctcctgaaggggagacaaaaaagaagttcagggatcccaatgcacccaagaggcttccttcagcgttcttcctgttgtattctgagtatcgcccaaaaatcaaaggagaacatcctggcttgtccattggtgatgttgcaaagaaactgggagagatgtggaataacactgctgcagatgacaagcagccttatgaaaagaaggctgcgaagctgaaggaaaaatacgaaaaggatactgctgcatattgagctaaaggaaagcctgatgcagcaaaaaagggagttgccaaggccgaaaaagcaagaaaaacaaggaagatgaggaagatgaagaggatgaggaggaggaagatgaagaagatgatgatgatgaataagttggttctagcacagatttttttcttgtctataaagcatttaacccccctgtatacaactcactccttttaaagaaaaaaattgaaatgtaaggctgtgtaagaatttttttaaactgtatggtgtcttcttttgtatagttaacacactaccaaaagtgtctttagatagccctgtcctggtggtattttcatagccactaaccttgcctggtacaggatgggggttgtaaattggcataaaaattttaagcaggttcttattggtgcacagcacatgtaagttatatatggggttggtagttttttcattttcaattgtctctgatgcagcttatatgaaacaattgttctgttaactgaataccactctgtaattgcaaaaaaaaaaaaaaagttgcagctgttttgttggcattctgaatgcttctaagtaaattacaatttttttattagttaaaaaaaaaaaaaagatgttatgagcatggagaggctagagccaggctgcccaggtttaattcttggctctaccacctacttagttgtgtgacctcgggcaatttatttaacctctctgggctacagttttattaactgtaaaagatgagtaataatagtatctgtgtaccagagtcgctgtgagaattaaatgagccaaaataggtaaaacattggcactgccatagtcttctctaaggttcatttagggttccttctcattgcaatttcttatcctggttctggaaaggaaatacgaacacattattctctatactttctgattctttgaaggcaaaaatttcttccagaaaatgttagatgacagtcctcactgtggcagtacattcatgtattgactttcccaatagatgtatctagcaacaatcaacgcactttggaaagccattaatgtgagaggcacgatgttcagtcgtgacagggtagtatatatgtcagtcatctgtctacaagagtccccaaggactcgttgatacaatagctcataatcactctaaggatcagtctagcaatttgcatttttaaaagtccctaactacctattttcacaatagacagtccctgtactcccatagctccagatgggatcactctcctttctaaagagggcattttagcttcctttctgagtaatccttgctttagcattatgaatgaattctcagaaattattgcacaatggacagatctccctaattttcaagcgctccctccccacacataaaatattggtaaatctggccccatttggggggattattttgtttgtttttcattcaatattcctcaagtttggtagaaaactataccaggttatgttttgactctattagtctgccttagtgacctgccaacaatcctgagtgctctggtttggagatcttgcagggtggaatcgccacacagagctccactgcagaagttgtctctgactctaagagagcccatgcatatatggtggcttagagtctaagaatttgggagaccctacagcaagtaccagtccagagcttctagataaagtgaaagctctgagactctatttggggcattgaatacagactcggaaattatcatgtttgacaacctattatgaatgtgctcaaattttttggagttacagaacctttagattaaaaaaaaaaaaacaaaaaaaacaaaaaaaacttggccaggcatggtggctcatgcctgtaatcccagcactttgggaggcagaggcaggcggatcacctgaggtcagtggtttgagaccagcctggccaacatggtaaagccctgtctctactaaaaatacaaaattagccaggcgtggtggcacacacctgtaatcccagctactcaggaggctgaggcaggagaatcacttgaacctgggaggcagaggtggcagcgagccaagattgcaccattgcactccagcctgggcaaaaacagcaaaactccatctcagaaaaaaaaaaacaaaaaacttttgattgttcttctccctgacatttactaggtaagcaactttgggctttaatctatttagatgttagtttcctctttgtgaaatggaaggcataatacatttcccattttaaagtagaaaatcaggttggcgtggtaatcctataatccaagcactttgggaggccaaggaaggaggatggcttgaggccaggagttcaagaccaggctggccaatatagcaagaagcaagaccccctctacaaaataattaaaaaattagccaggtgtgggggtgcctgagatggggaaccgtggaacctttggcagtggcatccagggctgggaccatggccgtgaacagggcctgggccccacagagctcatggaggcaaggctgagggcaaggaatggatgaccaagttgggccacctggtcaaggacatgaagatcaagtccctggaggagatctatctcttctccctgcccatcaaggaatctgagatcactaactttttcgtggggacctctctcaaggatgaggttttgaagattatgccagtgcagaagcagacgcgtgcttgccagcacatcaggttcaagatgtttgttgccatcagggactacaatggccatgttggtctgggtgttaagtacttcagggaggtggccactgccatccatggggccatcatcctggccaagctcttcattgtccccatgcacagaggctactgggagaagaaggcccacaccattccttgcaaggtgacaggtggctgtggctctgtgctggtgcgcctcatccctgcacccggggcactggcatcatctcggccctggtgcccaagaagctgctgatgatggccagtattgatgactgctacacctcagccaggggctgcactgccaccctagggaactttctcaaggccatctttgatgccatctctaaaacctacagctacctgacccccgacctctggaaggagactgtattcatcaagtcttcctgtcaggaattcactgaccacctcatcaagacccacaccagagtctccatgcaggggacccaggctccaactgtggctacaacacagagtttttacataagaaaaataaagtgaattaagcctgtttttggtttgcttgttttttttaagtagaagaccagaggatctcttaatcttaaattctgttcaatatctagtattctgtgatgctataaagatgcatattgatctgtagccagggaactgttttaggctggggagtgaatagataggaggtggggaatttttaaagttattgcgtattagggtattatatataaaattacatattagtgatatataaaattattacatactcgtgagaccaggaatggaagttgaagagcatgatgatttaaaattttttttaattttgtttcttatccagattacagaaaagtaaacactatatgttgttcacaatcacaagtggctgtagaattataaatcttgagagtgggaggatcctcaaaagttcaaccacacaattgttgtgtgaatctcctctgtgacaccattgctaaatattcacccaattatgtgtgaaaaattcaactgaatgggagctgagtacttttggagccaatcccattcatctatgtattcatctgtgaattcttttttatatttggctaaagtctgtttccctgtacagagactgatcactctttaaagacagtgttcaaatttaacaaagaaactcccagttttgtgatatgaccaattggaaattgaatggaaccaaaatctttctcatgtacttttgtgttcagagtctggtcttgtctcaagaacaaatgtagtgaagatgaaaatgctattccaagatagaaaagaaattggattcataaataactttgccagttaaaaatgtgaaataagtagaagaaacaagagaaacagttaaaacttaattccacttggaagtactccttggaaccttaggggtctcctgcagtgccatgcagtaccttcggagcccgattatctcctgctttctcctcctctgccttgttgaaagtccagatcctgaaataaggttggaggatatttctttttgactgctatatttgtagataccagctaaaactcattgggcctaagatttggtggaatcagtaaaggtgatgtagacttaggtactcaaaccccaagggtacacaaacacaagctaaactgctagaatgtattaccctcttgcctcagtgaacagtctctggctcacttcatccatgtggaccttcattatatctctaccctatatccattgtccatttccacctccagggttctgatgtgtcctgagtattagaatgaagaaatgcctctacctcacactttgggtggcatgtagggtctctacactgtctgtttctaataaaacattgtctctgaactcaagctaagggcccacttagctctgtacacacggttccttaggaagattggtttcttcgtcttcttcattttatattcagttgtgtgttacaccttcatatgttgaattttcttcacctgtctctctttctacatatattcatagctctgtctttgcagatcagtgctcacttgaagctttgctactctgtcaacccctctcctctcttcagcctttcttctcccccaaccccagcctgaagcccaagtaaattagcttatcacccctgccccctagttgtaaaaaaattcccgtactcctccaacagtgtctattcttggatttgcagtcagcaaccatctccaataaccatcaggctgtcagctttgcagctccctaccacctcccacctcccccattactcaccagaagaaaaagagagccagagcaagagcttgaaatatatcatgcaatagtgtatcatgaatttgttgtgaatcacagtggtgaagcaggtttatttatttctgagaccttaaatcaatacaaagtaggtctcttagttctgaagctgggatggagtgtgaaaaaatgagcccattgtactcttacaactttggggaaaggagatgacagctatataattccatttaccaggcactaggggctttaatgtgaaggtgacagggagctctttgtgcatttagagcaccatatcttctaaataaaagatctgtagacttgatagtggagcatagctccaagtttaataatctccaagcattagaccgagccaatatgttcccaagtcagaaaggtcccccttaacactcataaattaaaagtgcaagaaccacacgttagtagattagaaatgcaaggactccagtcttttctagaaggaagacagagctgggccctggctgtgcacagactggtctatgaatatgataaagaagcggaaatgagactgtttagaaacctgactcctagctgttcatcattctagggaatgttccctgtgcatggatccaaatctagctatgtcccttctcattcagattggccatcatcacacagtctaatcagctaatgtacacagtcaggaatattgaattatgaaaggagaagcttaaagagctttttagattgaactacagattaccatgcctgggcttcaagattttctggctgatttttgaccggttcctaattttaataatgtctcagtgtctgggatttaagccttctaaaatagtatgcgcgtctaagaaattgagaaatcagtgttggtaaggaaaagaacccacccaaatttaaccaacagcataagatgcaaatatgagaagtcaagaccattggaacatgtaatcaacttttgagtaacttcattttctacctgacccattggtaaaatatgcctttctcaatagataaagcaggtttatgcagctcagaagagcattcctaacataatatgactttatagtacttagaattactagtttaattttagcccatgtaaagaattttgacagggagggagggagaggggcatctacattggggaaaactaaaaaggtaggaaaattgaaccactccttttgcttcagaaagccactacacattataacactaatatgaaagacttattttgcttatagtggtttaacttgctgaacatactaatcagttgaggttttatagaatacatagaaatgtggtagatcacatgcatttattgcatgcctgttaggtataaagctgttcttatgctgtggcaatacaaagatgattcctgctttcatggagctgaaatttagctaaaagacaataataggcctttcatgtgttctaaaggaaaaaataaaattgctgcccatcagacgtcaatgagaaaacacaaaccaaaaggccacagagatagtaagtcagtgctactcccctaagagcgaggccctgcaaacaccatactcttggggcctggacactggtgagcaatgcagtcagtcacagcctattcagtaaaaccagtaggaggcgactgacaaacagggatttttttaaaagttttccatctttagaaaatacataatctgataaaagattggtatccaaaagaattctcaaactcagtaagaaaacaacccagtaattaaaaacatgggcaagaaatttgaacagacattacaccaaagaaaatataaggatggtaaataagcacatgaaaagatgcttatcattagtcattagggaaatgaagattaaaccacagcttgacaccactaaatggtgttttttgttttgttttttgttttttgctttttttttttttgagacggagtctcgctctgtcgctcaggctggagtacagtggtgcaatcttggctcactgcaacctccacctcccgggttcaagcgattctcctgcctcagcctcccaagtagctagggactacaggcatgtgccaccacgccccggctaatttttatatttttagtagagatgaggtttcaccgtgttatccaggatggtctcaatctccttacctcatgatctgcctgcctaggcctcccaaagtgctgggattacaggtgtgagccactgtgcctggcctaaatggtttttttttaatgtttgacaaataccaagtgttgatgaggatgcaggacagctggaactctcatagattgttggtgggaatgcaaaatggcacagccactttgaaaaaggttgggcttttcttaaaacctgtacacaaatgtctatagcagtgttatttataatcctccaaaagtgaaaacaacccaaatgtacaccaacaggcaaacgggttaccaagttgtggtacttccataaaatggaatattactcaggaataaaaataaactactgatacctgcatcagcatgaatgaggcttagatgcaatatgctaactgaaagaagctagattcaaaaggctatgtactgtatgactccatttatgtaacattctagaaaaggcaaaactactggaacaaaaagatcaatggttgttaggggtggagggagggaagggaacatgaggagactttgggatgatgaaaatgctctctatcttgattgttgtggtggttatatgactatgtgtattaaaattcacagacttgtataccttatgatggacagttttgctgtatgtaaattatacttcaataaaccagactttatttaaaatttttaaaaattggctgggcatggtggctcatgtctgtaatcccagcactttgggaaactgaggcgagaggattgcttgaggccaggtcttcgataccagcctagacaacgtgcaagaccttgtctctacaaaaaaaaaaaaaaaagaattcctgtttggaattaacttatcagaaatctcaagtccctacctacatgagcagttggtgggtccccctagggtgagtgattacttttggcagctttctttccagaagcctgtgcttcttctcatacatttagcaaactattgtgtggctcctctctatcttttacattacaaatgagtctctgttccttacccactccaccttcaaatccttattgtctttctgctgtctaattcattcctctgttctccactgagccctgtacctcagtaaagagatgtcttccagtgttatttctggcctatattcagcctctttttggctgtttcttttccttccactgacagtaccacccctttgccccagtttatccttcagcatacctgatcacttcatgatttgctgcttatagagagatttttggtcttatagcaaatggtcttgaatccagctgtggctcatgtcagaggcttttctctcttctgcccacagtatgtcaccgagccccttctctaccccaaccctagcctagcacctgccagccagcactccagtttgccagtgacagtagtggcaataaagtggggaaaaaattataaccctttgcctatgcattaagaaactgtattttggaacccccaaataatcttgttggtcacataggtcctggttccatctccctagagatttaattccattcacccttggatatattcctgaagaaacattgacacagtgatatgtgcagcaccacttaaaattgttaattggagattgaattacttgtcagatttttaaaatgtagtcctctcaggtcagggaggaggatattagctgcactgagtagatgagctattgcatttttttcttctccttcctcctttctctccccctcccttttcctctctctcatccttccttctttcttttgtccctattttaccacttttcctctactcctgcttattctttctcatatctgttctctttcagctttagccaacctttatcaataacctgacagatcccagagtgactttaatatctagaatcatggatgaagtccagtgatgacaattactcagtaaatttacaaaacccctcctcaaatcctcttgagaatggaaatgtcctaataagaaggaggattgcagcgaggactcagcttgtgtagcctaattcttagatgcaggaggaattttgtattccctgcttccttaaatagatgtcctgacccaccgagcattgtttaaagagggggaaaagactgaataaagaggaggagaaggaatagatttcattttttattccatcattgatatgcatgataatttttcacatcttcagcacatgattgcaaatatttgcctataagtctaagggtccccaacataatgtgtatgtcaggacaaaggcaatttttaaaaaattgagctaagttgcatctgtgaaacttggaaatctcaatgcctgtgctgacaaatatcctgacaagtaaatactgcactcattcagtattacatagtgatttcatttgcacaaaacatcacaatgctctgccacttcagtcaaacgtctggagcatgggggaaaggaagtacgtgtttatcttgatctccaaaaagggctttaagggagagagcaggcggtatattaggctgttttcattgcctgtcagctgtggtaaacctgagctgtctgcagtgtctctagataagcagcagcagcagcagaggcctgagcatggacgtatgactgcattcatttgtacttcttatgtatctcaacatttctaaaggctacgtagcatctttggtggagcctttaacaattgtgtctctgctaatcaccggcttttatgtggtgcccttaattcttaggtccgccggctgcaatgaatgaagtactggatgaggcttaagtttatattgagaatgagtcaagatcctctttcctctcagattcagcccttattcaattctgtcagcatggcactcttcagcagaggaccccaaggtggagcccattcctaatattgcatggtactgcttctccacttagatctggagggcaagaaagtgaggcctcaggagaatcacctctgtttgactcactcctgtgtttaaatgattattgatgcttgctggacagataaattaaaagtttgtatcatacagtaagtagaatgtaagaggaatatatttgggaactgaaacacggcaagaaatgcgtaggtcaaagtttaaaagagtgttgaatgcagctcacctacttcatgaaaatatgttgatgagagttgttgaccccaggtttttctgtagaaggtcagcagggcaaccttgaggaagaaaacaatggttctgtctatgtggactccattcgtcttcctagatactgatgagggtttgtgtaactgttatagcatgatcatttcacagttaggcagaatggattttatcctaacccagattctgcttccttggttggagcttttgttgtgaagtattctaaaatcattaaaaccacttgagtcagcaacgacccctataaatcaggagctattgtgtgcgccctcattctactggcgcatactccaaacatgtggtcattgaagatgaactggagggtactgctttctcttcaccgattgttaagtagttatgattgttagcatttgtttgtgattagtggagcagtttcatttctgtgcccatccccaccctaccccccatctcccaagataaggctggtcagagagtgatattgggatactcttagtctattctgtaatttttctccttaatttctgaattaagtgaattttctcacatgacaaacacttctttagctcagaaataatgttcttggtatgttaagccctggttaggtttcttctaaacataggaaaggagagatgtagaaatactgctgccttttcagaacaatgccaaagcatcagaacccgagttttagcttgtaaagagaagagtactcagttattgagcctaccaagtttgcctcccattattttgtaaaaatatggggtagaatagataagtggcagaggatcacttttaaatgaggaggcaaagacatcagaagaaagtatgtttaaacagctgagcggtccctttttctgagtgtagttctttattggtccattattagttttggagatgtgtaagattctaagtggttggacattatcaggtattagagataggaagaaaatagtgtttctgagtagaaaatggcccagctctctcttctgggcaacaaggagtacttggctcctgacctagattgtgaatatcagattttcagggtcagcacagtgtctccttttgtattccttttccccctttccaattttattttaataattaaaaatactgctgatcacactgaatgccttctaacagagaggcagtctgtcccagaaggaccagttgtgggccatcgggtttatgacgaccataaaaccagagccagatcagagcgtggcctctgtaagtgacagggtttctgcctctaccaggctcccgcatcaacagactgctttggatatttgctttggtttggattttttgttctgttttgtttcctgatgcatgtgtgagtgtgcatgtgtgtgcacatttaaagatataaatgaaacaggtatgtaatgccctctgcctgttagaaagactaaagccataaaaataacaaacggcgtgtatttgctagaatgtcaaagttatgagtttattttgtaatgatgtgctcctgccttcatgaggtaaactggccgtggcggaggtgttattagtaatatggactcagcagagcagaaagctgagtgaccgagagatcagtgtatcagtcagagagagggcaaatggaaagagacagcaggagaatgagaaaagagccgcagtgcctgggctgagattaaagacggactgagaggcggatgggagctcagtggtcagataccgtcttccctcttcacgaggctccttcaaaggagctgccagcatgttgctcagcttggggctgcctgtaaaggcttgttctctgcgcttccttatcaaggaaaacagtaatctgagagcaattttgctttccatattcctttcagaaaagtatcttatgcccttcctagctgaagttaaatggaatcaaggccaattgggtcacactgaggttattactttggtcaccaacttcctccatctttggaaggtcccgatgggggtgctgacccagcatgcaggggaacctctcaaagctcctaacaagaaggggcaaaatgggaatatacaggcagactttgctggcccttagttagttagattctccccagagactgaaaatgaatacacgtacggaagaaattttgtattgtcgttattttttaaaggaggaggggaaaggaaaaagaaaaggtaaaatacagtaagcgctctacaactgtttagagctctccggggctaccttagatgactgacaattactatacactcagcagtttgcaatagtcagtgatcaggctgcccggcttccatctgctgggtcagaaaacctccttccctgaaagaaattattaaccagtcttcaagggaaaaagaaaccctgcaatttccaagtccaggaatatcttttcttcctctttttttcttctttaaaggaaactttgtggtttccaattgcaggtgccctttgaccttacaaggattaaattcctccagggatataccagggattgaggccctgaactccctggagcctgggaagggaaggaggaggggaagcatgcttgggtataaatcacagccctgcacccagcacacaaagaagacttgagactcaggggttcatgtatgtatcatgagttgcttcaggtttttgctagctttagggcttgtgcgtggaggccagtgttaggctggtgcaaaagtaattgtggttttgccattaaatgacaaaaaccacaattacttttgcaccaatctaataaaaatcaaatataaggaaaaaaataatcctttttaaaaatgaggaacctaagcccccagagtttctttaactgagacttgtcactaaatattgttgaaagacaggcatgttacctttttgtgtctgtgtgcaaagagacttgcacacaatgaggtagcctatgcctctgggtctcagcctcacccaccactgcagtttcagctgagggtggaagtatgctttgcctatctgtggcagctggtggagagaaaggggcttgctggttttaaaattgcaaccatgaatgtgattgttaaaagtattttttgtttttttttaattttttattttatttttattatacttcaagttttagggtacatgtgcacaacgtgcaggtttgttacatatgtatacatgtgccgcgttggtgtgctgcacccattaactcgtcatttagcattaggtatatctcctaatgctatagtaagccctcttagcgcagctggcagcgcgtcaatctcatattttttgttttctaagttttctttttaggaagaagattcagatagtccctcagaacaaccaacccatggagactgaaatctctgttttgtggagaaaagaacccattttagtgcgacttgtgaaatcgaccatgcctttatttctatagagacaaatgtcttttctcttgctcttttctctaggtcctcgggcgggaagtgtacacctccaataaccagctggggggcatccagattatgcacaacaatggggtgacccactgcactgtgtgtgatgactttgaaggggttttcactgtcctgcactggctgtcttacatgcccaaggtgagcccttcctacccagcactgacatggcctgcagagcctgtcatttccaccacagctcactgcctctgtgtttaaggtcttgtctttatggtggaggaatttttttataaaatatttctctgaaagctattgatttctcttttccttacagccatattttgccttctacctttaagatgtctctggatttcatttgttgggcccctttctaatgtcttccagccacggaagccctcatggcctacctaaggctcagatcccagtatattaaggttcctcctcattgtgggttttctcctctgtaatagccattcattcctcagaggagcatcccagaaagcatgggcacactgaaatcaagagtcaaaacacaccactttgtgccagcctcctaaatgagactattgacctatacatgttccttggggcctggcacatacgtaggattcttccagctgaagattgggactattgggtgcaattccatacgtgggccctgctgtctttgtctgtaactattgttgctgagttggagtctagggctgtcgttcactgattgctgtgctctcttccaatctccttttagagcgtgcacagttcagttcctcttctgaactcaaaggatcctatagacagaatcatcgagtttgttcccacaaagaccccatacgatcctcgatggatgctagcaggccgtcctcacccaagtatgtatatgtttgaggaccccatggtacctggctcttaagcttttagcgttcttttcaatcactatccaattcctgaacaatcacatgtgactaagaaaacagaggtaagtacctagaaatgagaaagacctgaaaaccagccctctgaagaaaaaggtgggaaatccttcatgaaaaaatgaaaaataaataaaatgacatttcccaatcacccattaagtcaagcagtgcagtcacgaatacatttcttctgtttattctgttattaaagcacttattacttaatgggttcaaagactttaacacagttcaatataagccataaaatcataaaattataggactagaatcttcagtcatctaatccctacaaccaaaagagattaatcagtttcgttttagcacacgtctttgagacccttcagtgtagaatatgacttcactcttctcagcaagctctgagcacccacgctgcatgtgcccttcttatgatattggtaatggtattggtacttgctttagtaagtaatagaaggctactttgtaagttcatttattcatgaagagattgtccagaacttttaattatatagatacatggagtgagaataagctctccctccagatatatctaatctactgctttgtcttttacctaacttagaaacaaaacaggaaaaagaagtaactctgtgtacattctcatttgtcagtccatttggctgttctagcaaaccttacttatcaggaggttcttttgtggagcaccaaatccctctgctgtattttgaatccattttttcaaactatgtgaggaagcatttgttcttttttgcatatttattgcaactatttcaaagaaaggctatatataaaagtagaagagattgcagaaggtattttattaagtgtaaaagtcattgtgatcttgctgaaagagaggtcttcataaggaagacctaataaacttttgtgggtacccactgtaagccaggtgggactgtaaagcacttccacatcttttttgcacttacgacctctcttagataaagagagataactattttacaaaaatcagagaagttgagtgattcgtacaaggtcacatagctattatatagctattacattgtttttctacaatatttacattagactttctattatataaaaacatgagagaagtgtttattttaatttataactttacctgttgtcttcagtgcctcttcttgttaattttaataaaacgaaatagtttttctttacatgcctggaaagtcaccatactaatcttcttcctactgttttttttttttttttttttttttttttttttttttagatggagtttcactcttgtcctccaggctggagtacaatggcatgatctcggctcactgcaacctccgcctccacttaccccttctttccccttttttttgtgccatgattatgataagaactatgagcctaagattacctgtcagtctttttttttttctttttcttttttttttttttgaggcggagtctcactctgtcgccaggctggagtgcagtggcgcgatctcggctcactgcaacctccgcctcccaggttcaagtggttctcctgcttcagcctcctaagcagctgggactaaaggtgcatgccaccacacccagctaatttttgtaattttagtagagacggggtttcaccatgttggccaggatggtctttatctcttgaccttgtgatctcaaagtgctgggattataggcgtgagccaccgcgcccggccacctgtcagtcttaaaatgcaggacttttctgggaatgaagtgagcctctttacttctagaatttggaacaagacttagtgagttttttcctgggaaatacgggaagccatcttagccggcttctaaggttctgcatcggaactgggtaggatctactctctggggactgtgaagcacaactacaatagtcagtgactcctcctacccctagcaggagagtttttaaagaagaaaacatttccatcttgaagttaattctgtagttccaaatccctgttattgaagtaagaattagaaaatgatccaaagatataaagttaaaattcagtgttctgatgaacctagaaatttggtttagaaacttcaccaaaatttgagtccttctttcatgggtgaacagaagtatgtgtgtgtaggtgggcattatcctggccattattaatgaaatccacagaataaaatgaaatttttgataaactaagttttctgttttttggataatattttttcattgactccctagtaattcatcctgctgtctatgtgcagctaacactcgctcccaaatcgagtgacttcagattttaatttagtggaagcgttaaagaaagcagatgattccctgtgataagttaaagcagatatcttctaggtgaaaagttaaagtcatttattagaggagatagtgctgtgatattcttcaaactgacgcccaacacaagaccagaatctaaacgatcggctttgggctcacggatggagagataattttgaaatggatgatcacattttacactggggccatagaggcaaggaatgtagaacacagtaattacaagtttagtctagataaaacactctccatcctgtttaagtcagcagaggttagcttgctcagatctccacttttaattggttttggacttgggtttttagggggtggagggccatgttcaaattagaagaatcactgaaaaccgtgagctgagagggcaaactaggaaacggttatttgcagaagcttttatggggctttggtcaaacatttatacctgtggaacaaaagttttttttttaaactaacatgttgaaaattttgggtcttgccagtgaaggaaattctatgtgcaaggaagattaatggcattaagtatgtgcatcttaaccattgtatttttactatctgtcaagaatatgtggcccttttttgtagaaaggttatactttatcagctgtttaataaagtagatatatcttgttgcttttgtagcggagaaactgagttcctatttttccctccaaatttggatccttatctgatcattaatacttattgtttggttgtttttagccttcagttaaaagaaagtcagtggaatcaaacaaaattgtaaggcaagttttaaaatagaaatagacattttgaaaatatctttaatgacttggcagccttttgacaaatgtttgtagtgtcttgaagaaagtcaagttatttatttaaaagcatgcaaactctctctgctagctaaaccttgtcatttaacaataaatgatgcttttgctgataaatgattctttttatgcagactagcaaatgaaataggagatgatgtctgaaggcagatgaacattcagctgcctaatgcttccatctattataatttggttaaaaacaacaaactccccaaaataatcccccaaaccaccttaaattcgtcagttccagcacattgtcaatggattcactgtccttattctctgttttctttctttcccttctgtagcccaaaaaggtcagtggttgagtggcttttttgactatggatctttctcagagattatgcagccctgggcacagactgtggtggttggtagagccaggtaagagctcttttgttttggcagctctttttcctcccaactaaaaataagaaagaaagagccatggctctatagatatataccaataatgttctctttgtctgaactgtctgagaatattggattatagccatgcccaaggcaaaataattggagtgctggttctcagttgccattttgtgtgtcactccaatgatgcgtttaatctgaaggctaattttgacaacacttcctttttataatgtttcaggaaaaacactttgggagctgtaaagcccaactacaatagccagagcccaccaatgactttccctctcccaaagacaattttctttcaggaataggtgacaagtgattcagagactcatctgcttttctatgtaactggaaagaggttcttcgtggcaccgagattatttaagtgacaaatgtactatattggattataatcagatgtgaattgccaaaaaaaaaagtttacctgaaacaggagtaaaataagctgaaataggttgccaagatacctatatttttgaagtgggaaattgaagtttctattaaattttaatacctactctaagaagtgcttcactcaacagcaagctctgtgcaaaataatctgtagtgcttgctataacgagctataacgagcacctgccacgactgatcttaatctacttctgcactgcagagacatgctgctgagggaccgcatctggagctcaccttcctctgggggcaatcagttttccttatcttggtgaaaagtggcacctgctcaagattctcaaacatgccacattgggttgagatttagattctagccttgaaaataattctaggctctgtggttctctcagtacagcaggtcagcacgcctccatgctgcctgtgacaagaagccatcagagggcaaatcccacagacagggtcttcctctgtgactctgaataggattctggcctggagtcagctcagactgaatgtcccagagcctacctgtctgttttctttaaagtctcaggtcttttatctcaccccaggcttctcagtcccagtgagaagtattctctgtgcctggtaaaattcccagtggggagcttggaagtaggagatacactggagcgagaaccctgatactcgactcctgtatcagcttgttagattcctcacggcacactaagaccaacttttttgagatttgtctcatctattctgcttcaattttcctgtctgtgaaaaaacatgacagattttaagtctcagaaagccaaacctttgttaagttctttaagatcctcccatgggaaataagagaaaaatactttacacttatgattagaagaatagggattgctttgcgaccaagatcagtcaagcttggctttggttagctctgtcattgtttattgcaacactcactctgacttcctcctttctttctatctgacgagttctgggcttcttactccaaacgtatacacatactcacaagtatataaaacacaaatggagctctagcttctttcaaaagcaatggcatttcaagaaataaatataaatgtattcgtctgggattgttactgtaagtgctgccaaaactcatctttggtatgtatgtttggaatatgtgtgctattggctgtaaattgtcttttattattccatggcaccttgtccagggacacactataaaacaagatgtagcatcttcatgtgctagcctgataaaatttatatgaagtataatagaaaacagaagttgttctgagctgttttcaagttcaataaataactgtaatacttggataaagatgttctttattaggtcacatgggccctaatatataagttataagttaccgatttagggtggcttttgcaattacaagtttccagttggattgttaatcattgtgaacagaaatatttctaaaccctcctgtgtatctcctgctcgttgtctggttgtctagagggcttttgattctgattcagtgcaggcaagtgacaagggggtgggtggtctccactcaggcccttgtcagccctcttgtgatgacaggaatccattttcactagccaatttaacaaccaaaggccatctgtcatggaaaagtttgttatggagatgctgtgagaaatgagagactataacccatcccagccccaaccccaaggaatgcaacagtgagaatgaagactgcatcacattttccagagtaaagactcaccctgtactttgtcttgctctctgatttttcctagaaaatctttatgaggaccaaattgggaagtcatagtggagtataaggtgcagaggctttgagctcctaaacagttttttaaataaacatagctttgagattaaatatataattctaatatagacttcaccagcattactactaaaaattatccttgtcccatttgtcttttccaaggaaggagaaaattaagggcttgttgatccacttccctattcttggcatgtgtttctcatcatcctcataacatgcctacatactccctatccacacacctaatagtaagacctattgtaccctcaaatcttatctggaaccacattattaatattccatagaaaactacagctccatttcagcaaggtcagtcctcattaaaagttactgaaagtctcagattcctactgcctttcagaccatttcctaccatcttcaccaaggagatgctctagagtgaactgagaaatttcgtttagcagccacaggggtagggatgtgtatatgtgctaggctgttgagtctaaatgtagaggctcccctagaacagcccttggtttgaatttatcttgtgttgggacatttccgaatagaagtgattctgagggtggtttcccaccatatttagagagtaaatatcaaatccgtagagtctcacatttaactcatagaagaatcagatttcccctgctctctgtgtttgtttctagttttttccccaatgtcttgatttgggattggaaaacaaatggctagctataatgttgacatacattgggttcttatgtgactcatgttttatcaggctaggaggaatacctgtgggagttgttgctgtagaaacccgaacagtagaactaagtatcccagctgatccagcaaacctggattctgaagccaaggtaggccacctcaagtacactgggggctgtgcttggagggtttttctcttcgcagtgcctgtgaatacatcaggaacattgcaaaccatcagttttagagggaagggcatcagcagccttgaatgattttagaacatcatgtgctcacttttaaggtgagtctaaacggactagaagctaaattctgcctcaaaaattaaataagtctttacagtagtcttcttgatgctagaaaacgtatacttttgttggggagatggtcttacagaaaggtagctgagataatactgaaggctctttggtcccctattctctgagtatacacatggaagagctacagctagagttaacggtgaagtctgccctaatgccaagcgtgaacaccacagcccttttttttgagacatggttcatggcccaggctggagtgcagtggtgtgattttgactcactgcagccttgacctcctgggctcaagggatcctcccgcctcagcctcccaaagtgttgggatgagccactgtgcctggtgccattatttttttaaaggatggattatattttcacatcctgacaccattcagaaagtgaggggtcagggaggccagggaggaggctattcagcagtgtgacgtcaattgtctatttgttagccacagtacaggaaaatgctatactaagcacaaaggtgaaaggactgggagactatgtacaattgacttgctttaaagagtagcacaatggagccattttaagtagcttttgagaaacctagaacaagggttcttaggactgcattcttcccttttgactacagagttattataatcaggacttaaaaagaatagtatttgacaaggtcaaagatcgaggatcctttcttcttttttactccaaacatgatgatcttgatgaacaatagtttttgttgatctgatttttagttttcagttttaaataagtaaaatcttgttcaccttggagagatttccccctggagctgtgttgttaattgtgtcttctttgacttttcctaatagataatccagcaggctggccaggtttggttcccagattctgcgtttaagacatatcaggccatcaaggacttcaaccgggaagggctgcctctgatggtctttgccaactggagaggcttctctggtggaatgaaaggtgactgggctgcctgtgggctggaggggcatcactgattactgggcactctgcggcagagggagggtatagattcagcagaatctgtgggtgtcctaatagcctaggctttttggggattctgccctctctgagacatcttttgagttgcaacttgaatggaaaaaagtacattttataattccatacagaatttcagaataatctactactagtgttattgaggtgacctactgttgtggatctcgctctcacagatggatgctggaccattctgatggtgctggggaaatatgattgtgactctgtccctcttttctgggcatatactttgttggtgttactcctaatgttctacagtgaccaagacagatactgaaattagcatttactggaagaaaatgaacaaattcagtaccagaggctgttcagtaccagtggcaatttgtgctatgttatattattatctaacaacagccctgggcctgtggctccagcatattagaccattattacaaaggctctactccatgctatgggaattgctaagtaattaggcagccagtatcaccatttacggagaaaccttgatgtgtagagcgactgtggacactacagggagagccaaaggaaacactacctcttacagtagtgaagccctctgtcccatggccagataattcatggccatgctaagccagagactgcatacctggagggtatgagagtatgctaagtataaattccatctgtcttggggagaatttggggttctaaagcaataggatagggccaggcggggtggctcacgcctgtaatcccagcactttgggaggctgaggcaggtggatcacttgaggtccaggagtttgagaccatcctggtcaacatggtgaaaccttgtctctgctaaaatacaaaacttagctggcgtggtggtgggcgcttgtagtcccagctacccgggaggctgaggcaggagaatcacttgaacctgggaggcagagattgcagtgagccaagattgtgccactgcactttagcctgggcaaaagggtaagactctgtctcaaaaaaaaggaaaaaacagtaggataggttaggggaaggagggaggagtagaaacttttggagtaaatagtgattagaaaatgcttaggatggccaggcgcggtggctcacgcctgtaatcccagcactttgggaggccgaggtgggtggatcacctgaggtcaggagtttgagaccagcctgtccaacatagtgaaaccctgtctctacaaaaaatacaaaattagccagatggggtggtgcatgcctataatccctagctacttgggaggctgaggcaggagaatcacttgaacccaggaggcagaggttgcagtgagccgagattgcaccactgcactccagcctgggcgacagagcaagactccatctcaaaaaaaaaaaaaaagaaagaaagaaaaagaaaagaaaatacttaagacatacaaaatgtgaaacaatgaactctcaatagggcacttaaaaatagcttagggcagaagcacccccagcctatgagggaggaaatgcctggggaaactaccagatggtcagttatgtggcaagagggatttgaaatttttgccgacaatttttccttactcgtctaggaagagccctgtatggccaggcctccttggcaaaatgttgactaggttgattgtgtgtgtgtgtgtgtgtgtgtgtgtgtgtgtgtgtgtgtttggttgaaaagtttacctttgcctgtatttgctggagaactaccacattttatacttttcttgggggagacttggactatatatccaaattaatgattgtatatattttttagattatcaaggtgaattattttttgaccgagataataaattagtggaaataccatgagaaattgagagtatacggttaagtcaatcctacacatttttattgagttctgtgtgttaggaactatgctagccacttcagagaacaaaaataagtcaaaataagtcagaaacaatacattgcttcacagagacaagaaaaatgtcttgagcaaaatgataaagccataatgtataaacaaaataccaggatattcaaaagaagatggtagtagtatatcaaagggaaggggggcctgaaaacccctcattcatatatatgaggttcattcagcattagatttcacttgatcccaaattccttggctctaatatttttgttgagacctgggagagaatgctatgctattactccttacttatctctttgtggggggcccactgagaatgtactcttcctgacattacttcagagtgtcaccctggatattttatcctaacgggagttcagagttcaaaagtttccaatgtgccacttctaggaaaagcttcaattctgctacatattttggctcaggcccagattggctgccgcgctgtaacagtaagaacaacaacaattaagattcattgagctcttttcaccagaaacttgtgctaacaattttacatgtattatcttacataatcatcacaacaagcacctctaaggggtaggttatattgttatgaacattttacataaattaagatttatgtaaattaggttaagtaaatttcccaagctcattcagctacaaaatggcagagttgggaaaggaaggtggatctgtctgacttcctgtaacacagttggctgatgtgatgtagctccctgtaacacagttagagcctaaaaccagaactagatctactagaatatccctataacagaatgtcaaggttcctgaaaaagttattatccacctacttcccctctactttggggatgtccttggttattgtgaaaagaaatttcaagagctcagaaatgagttcattttttattgtggtaaaatatacataatatttatcactttaattatttgtaagtgtacaattcagtggcactaaatacattcacagtgttgtgtaactatcactggtatctacacccaaaacttcatcatcctcaacataaactctataccccttaaacaataagtacccattcctttctccctgctgcccttggtctgaaatgagtttttggcctgatatatagaccagggcaagttctgtcttaattttggtgctgatgcatccttttacacctcacgtaagacaaataagacttagggaagatagagatccctgtgaaggtaggagggggaggaacagtgcctttcatatttacatacaggtcagggtgttgtattatctcatgtaaagggacctaaactgagggcctcttgtcattcttcacatcccttggggagatgtttgcagttttggtttcaatactggctggggattatgcagggagggaaaataaacaattatgccatccctcagtgcacacaaacacacagccaggagccgactgcactgtgggtaaaatgactccaaaattgtgtgtaatgagtaggaaaagattagagacagctcttgctatgctgaaaattgacattagtgaagggaaaaaaaaaaaactctactagtcggcctaggaggtctaattcgagcagtaaagatataaataaataaataaaagcatgtcaagatggtattggtgctttttttcaatgagctctatctggccggaaggctattcagcataatgcaaaattaaattataaaaactggctgaatatttagatggaagagccatttggaagcagtttatttagacgaaccggcaatgacccacaacagggagacatcaagcgtgaaatttactagaaattagcaccagggtcccagcctcagcatgaatagcttgataggatgcaaatcccagtgatattaagctgcctcactgctggtgctacagggtcactctcagttggcttttcatgttatacttattattttttcctgggacaggttataaataacaataaaaaaaatttattgaaaactttaactggaatgaaagtctattttaaagtctctgattactaggatgttgaaatacagtgtcagccgatcataatgaactaaggagagacattatgtatatgtagcttgtgtatggctaatgtttaccttcagtttctaacagataatcttgcccaagccaataagatctgtttcattttcaagagtgtgggacactgtggaaacactctgccaccctgttcccttgtttgatacacatggctgccacggtttatccatgtttataacaataaaagccctaggcagggttggtgcctaggtgctgagagcacactgcaaaggttgtgtgtggtcaccattcatgcagatgtgctttgcccagcatgctagaaaactccaagctcccgcctctccagtgaggaacctatcagtattttccattcccagttgcgtttctcagggcctgagaattgacagcacgtgcatagctttaaaattctgtagactgatttctaacctaaacccttggggatcgcccctcccctgctgctattggctgtgcttttgctctgtctcttaaatacgaagggatttcagacaattgtgtgtcagattgttgccaagtgtttcaacctgcctttcaaaataagtggtttggggcagctgcagttcagtctgagcatgtcgattacagagtttatttgtgtgtttgtttatattttaatagcctgctttttgggtgttttgatggttgggctgtgggtctataggtgttccaagttagatggaggcaatatattagtcccaaacatgtcagctttaacaaaccctgatgctcctttcctactcacagtcttggggccgaaaaatacttgtttggcagtcagatccaagcctcacacaggctggtagtgttatcagtatagttttgaacatttctgaacacagaggaaatccagcagcagttgggaatattcagtcatgtattcaagtctctttttctggttttattttactcatcatattagatgttggaaagcagagtaccccagtctcatgctgtctctcctagcagtaagaatgaagtagtagaggctgggcacagaggcttacacctgtaatcccaacattttggaaggccgaggtgggcggatggcttgagctcagcgagaccagtctgggcaacgtggtgaaaccccgtctctacaaaaaatacaaaaattagctgcgcatggtggcacgcacctgtagtctcagttacttggggtgttgatggaggaggatcgtctgaacccaggaggcagaggttgcagtcagctgaggtcgtgccactgcactccagcttgggagacagagtgagaacctggcgcgccccgctccccacctcaaaaaaaaaaaagaatgaagtagtagaatgtggacattagggccaacaagatctagatttgagtcttatctccaccactcactcttatttaagcctcagtttactcacctgcaacttggatatataaataagataatgttctgatgattaaatgatttatatgtgtgtatatataatcatgttccctggtacacaataagctagccatgatgatgacaaaaaggagcccacgtccatttcataaaattaaaaatcacacacacacactcatcttcatttgaaactgtttgcatatactatgaaatctagtatttttttaatagatgaatgaaaatacattttaaataaaatctccccttctttttgagatgtcaatctgttaattataatacagagatagattttgttgtagctaagtctttaacaagaagaagtgagtaaaagagctggaaactttgtcttcacttacctctaactttttttttctttttcaggtagaatgactttttgtgctgtcttttattgctttattttctccttttatctatacctttcatttcctctctttgtatgatatcattgagggacacttttctgttacttgttcggagactgtactcttggcagcactgaaaaatgtactgctaattacacaattattttattatgtagcactggttgaaatatccactaaagaattaatttagttaaaataatttgaactgagcaattattttcataactacagaattagcgtaaagcacttaaagtcctttattccctgctcttcatacagcagttgttaattagcagtaaatttttttggtcttagcttttctcccaaaggaataaatgtcttcactctgatcatatacatggagtacatatcatacacattccacatagagtagggggtgttttctggggtaacttggaatttctgaagtcttcacagacacaccaggttggggcagtggagcatgtgccttgcagtgaactgtgctcactgatagtttgtatattaagccatttttactttggagaaggtggcagtttaatttgccagtaactacaatgaaagcaatttctatttggtttgctcttaacttcctgaaaaatgcttctttgccttggattcccagaattgatttattccaaattgagatcctctctttgataagaaagtttgatctcagttgaacctgttatttggtatttagaaaggatccattgtggctccactgaagtactcattaaacatctggactcataaacctaaagctttagcaatggacttcagtgagctgggaaatgggaagtccataaaaagttgggaaataaataactgatccagttttccagggactcactttatgtgtacatcatgggtccttttcttcaggctgctcctggctttggagggattacaaaatgtactcttttttttttttttttttttttaaaggcagggccttgctgtgttacccacactggagtacagcagcatgatcacagctcactgcaggtctcagcctcctaggctcagatcctcccacctcaccctcctgggttgctgggactatgggaatgtgccaccatgttttgctaatttttttggtttttgtagagatagggtctctctctgttggtcttgaactcctgggctcaagcggtcctcccacctcagcctcccaaggagctgtgattataggtgtgagctaccattcccagtctacaaagtgtagtctttagcagaatgaagaggtggttcctctcttgttttttgtttattttgttttatgttgtttttgagacagggtcttgttctgtcacccaggctagagtgcagtggcaagatcatggctcactgcagcctcgacctcttgggctcaagtgatcctcccacctcagccaagtgactgggactgcaggcatgcaccaccatgcccagctaattttttattatttgtagagacaggttctcactatgctgccctggttgggtctgttcttctcatgtggctgtgtggtatttcctaagtatttttaaaatttttctctcattgataccctataaaaatgcaactgttaaagaatttgtctttctttctcattatattctttccagagtatataactaatttattcagcattcattcattcagcagatatttgttgagcactaactatgttcaggcactgggcagggatatcgggataccaagatgaaaaatagtttttgaagataaaatttttaaaggatcaatttccattaggtgcacatttgaagagctcatcctatgctaagcatcatgagaataactgaaaagaggtagaatagttccttcctttagtaaacttactgtagtgggagagcacatattgacatgaaaaatactcaacgtttgtagagcaaatgtgaattaatgtggtgaaacgtgagtacagaaattcagagaggatataaaatggaaaggcaatctggaagacttacacactgtatcttgtgaaagacagtgcatctctctgttgctgtcttgtgcttttgaagatcctctggagtcttgaatgggatacaggtcgatactccctttagtctatagggtggccaaacaggaggcatagtataaggaggctcttcgtggccagaggtcctgaacagtgtttaaaagtactgctttgaggaagagaaatttcttgatttctaatttgtctcattctccatagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggtagcgtgccttccacatttccattcactgcctttagggaccctgtagctgttggtttcctcctggagaatgttacagccatggcactacagcacccacatcctgtgattccaaaccaaagctttttccttccattacagtccaggtcctcactctagcatttcaggaagctgaagaccatggtgtttgtagcacccaaaaaaactgtaagggagaacctcaggcttattgggaggtggtacctgaaactacctaaataaaacagatctaatctggcatcctttcatagtctgttctcacctctttcctaagtaaacttcaaaacgtgtttctttgacattttccaaggaaattcttacctccagtcgttttagtggaccgcccgcttctctcttgtccccccagattcagccttctatgtcaaaggctgcttaggagagtccagtagtttcactgtcaaacctctaggctgagaggcttattatttacattctgtacttaggggtttattattttttaagtcctaaactcatctgatatcagatcagagacaattcctctatagactttggaatcagactgtctggtttcaaatccagttctgcctcttgttatatttggacgagtctcataacttactaaactgtagtttcctcacctgtaaaatgggaataatcacagaaccttactacatagtagatggagactgggcataggattgttgtaaggatttatatgtaagttattagaacagtgccatgtacatagtaaacattatctataatttttttaaactagaaagctgtgggtttttttttaaacatgtttggggtaaagtttctggggactgaacatcattagtatgcactaaaagtaaccctgagacctttgactctgctcatttccatagcgctgggcagaatgttttacctcctacttggcctggcttagtgtgtctgatcagtgtcctacaagcagactgacagctgtggtataggtgaggtagatagatagatagatagatagatagatagatagtattgatgaagtattgcccttcattattgtacatcctacgtgatggaggtggttcccctgtcactgtgcctacagcatttttttcccctggaaaataatgtgattcctgttactcttatcagctgtaggtggtggaatctgtattcttctccctttgaaatggaagtcgactggtgtggtaatgagaattattttaattgctttttgccaggcctttctcatacctcacttagacacttctctggtgcctactgttctccccggggagatgtctgttaaccataggtgggcaaaatgataatgaagctatttcctggtctacaaattgtaactggcctcattctgttgtctccttcctttaaagtgcctctatttctgttttgttttttctttctttctgatccaggggatctgttctggagccagaagggacagtagaaatcaaattccgcagaaaggatctggtgaaaaccatgcgtcgggtggacccagtctacatccacttggctgagcgattgggtatgtctgcttgtccttctggcaaatcaatgagccattcagctgatttgtaatgagtgcattcataggccaggggaggaggcactgaagcatttgatcaaattcatgataatctttatttactgtcctctatatggtaagaaccctggtagaatgaaatagtgtgtataatagggaaagtgagccctaaaaaagcaaaagtcacctgattttttttcctgatatttccttagagtacaaaaagcccgtctttctaagatgtccttgtagagaatgattagctagagttgctgctgggggcaggcctcaccagagaatatgctagatttaaatatgtcctgtttctgcttgtttctttggacagctcacttcatttctgagagatgggatagaaaagcaggagtctttacccaggtggtgttccggggtcttcctgagctagagaaatagaagtaaagattgcgcactgtgtgcttccaaacagtagctgcagccagaatagccctgagagcaggcgtgcttaatgcttccagccattgctctgttgctcatttgttttcagagcttttggaagccacttggcaatttgaacataggactaaaccatgggagtcctgtgttgagtccagagtctaaatgagtttcagattcttttaaaacactgattttctgcccaggtctcccattgagccccttgctatgttagtaaagataattgctcgaggttcttttgtcagttggtttgtcttgtttttgtttttttctaaaggaacagagattgcctttaaaaggtagtgaaactcagtgaatggagaagagagatgctagctcatttatgttccaagtggtaatttaattaataaagtaccatttgtggactgtatatccccaccatccagagacagaaaaatcccgtttgcctacactgtggagactgtacatccaggcatttggagccctgagccaggttgcctgccaaacacggtgacttgggttacaagaaaccctgtttgtgtcccattgtttgccactgggtaacagccaccaataactctaactcaccacagtctgatccttttatggggaatgcacacatacaagaaatgagagttgtttctaaaatctattgccacccagaattgaggtgggttttttctctttcttttccaaacagaataattacttctgaccaaccctgtacactttaattaaagtaactgcagctcaagagcaagttacttacaactgttcatagagagagctctaaaagcttcagccactgataagcatctcacttagatggctcataattgctcccagcatcccccaattgttgccgctgtgtttaccactaattccatacaaaggcagcaatgccgcaattgcaggacacagcaaattgcatcattttcctttttcctttttttcttcctttttcttttcccttttttttttctttttgctggttttctttctggccaatttaaaatttgtcaaagtcggtcttcttctggatcactgccctttgatatttcgcgcactccatttgccacaaacaagccgcagggccgcagttcatgctgactctagcagaagcagagagagctccatttatcttacactgcctgctgaattcctactcattaactgggggttcactgcctctttttaaccccccaatggctgttatcatcccttcagagtaactgggtggtagggagagggatcctttctccttttgcagaaggactggatggtgaggggtgtggagataaagcttctttctcttcaaggaaagtgatgtcgctcccaccttcaaccagcaccttttaacttttgaagcacatgaaggggagagggaggagactcccaagtgatagccgtttaatcatttgttacaaatcatctcattatcaatttcctatccgcattggagaaaaccatatttatttaaccttgaccaaaatggcacttgaaaaaggacccttagtctgctaaatgtgaagcaggctctggcctagggcagcttgggaacatgagcagtggacttggaataagaataacgaactacgagtcttgtaaattatttaacttctccgaacatcagtttttttccaaccataaagtggagatcacacctctgcctagctaatatgaggagcagatgagcatgcatttacttcattgcatcattatctttctgtcttaatcattagaaaaagcagatggccatgtttggtatccagtattctctgtggctcagtcccacatgtgaaaatatgaaagaaacagaagtatagtcctgtctctcagggatatcctatacgggcagctgtctctgcgacaaagcaggtcagcctagatataacaggacatattatgaacccagttcctttggggttcacaatgattctggctcttttagtttgcctagaaccaaactaccaaaattctttttcacaaagtgggtgaaaatggtctcatttttcagactgggaaattgaggccaaaaaagtgaatcatctaagatacaaaataaataaatgtacatcagagtccagaatggaattctcattctctgtgttctccttttctcaggatttcttcagatttttcctcaactgaatactgagcccgaactaaattaaacaaggattctttccttttgtaatctaaagccatttccacagagaaaatctgatttaggagaaagcctgtaggagtggatgttatcttgtgttgccgttctctccccaaatctgcctctttactggggagcgtgctcacagatcacttagacaaaccagcgcacaactgattgactgtgttcaaaaacataattactccgggcacggtggctcacgcctgtaatcccagcactttaggaggaggaggcaggcagatcacctgaggttgggagttcaagaccagcctgaccaacatggagaaaccccgtctctactaaaaatacaaaattagccgggcatggtggtgcatgcctgtagtcccagctactcaggaggctgaggcaggagaatcgcttgaacctgggaggtggaggttgcagtgagccgagatcgcgccattgcactccagcctgggcaagaagagcaaatccctgtctttaaaaaaaaaaaaaatcataattgctatgtattttataagaatgagtaatatttgacttctgagcagctaacttcatctcttctagaatttttatttttttaaatggccttttgtcatcttacatggttagtttgggtggaaagatggtgaattactagtttgcaggtctgtgattataacagaaaatatgtaaatagtgcctacactgattcctaatagaagtaaagggaagaattacctcagaaagaaaagtgagcaaagcccaggccccagagtcttgcattgctgaatcagttctgaccctgattcacagaaccagggcttggtagagtcattgcaaggaggagaattacttcctaccatttggttgccttaaggaaattaaatttcttctctggaaatggagccgcagccctccaagtcctttttgtctctctctgacatccttctactgcctcacaaggccaggagcagggagagtggctgtggagcgggacggccttgctagcctggcctcttgagtgctgtgacctgaggtcctctcctggatccttcccctcctcttgtgttcagagagaaatgacaaatcaatttagatggagagagaactgtccagcccaagtgtgaagcaattgtaagttccccactgtccctctctctcaaaatgaagagcacctgggcaaaggagccgcttaggggaacttgttcttagttgtggccctgttcccaggcagctgggcagcctgccatgcagcaccgcactgcgcccacacagaacatgccctgactgcctgccacagggagcagcagcatggactgagtgagcactgctgctggcccttgcctggtccttctaggcctgcccacacccaccatgccttcagggtcaaggttgccccaggtgcagatatggagcattgtggtggcaggtgaggatacgcttctctgtaaaaatcttcaggaatgccttcctcccaagccttctctagcagccagaatgacaggaaaaggactgttccctgggctaaggggacttaagggttaagctgcttttctggcagaggtgatcaaagtatctgagctgtgtttttccaactcttatgtccatcttcgagaggctgaaagctgaaaagagccagagttgcttgtttgaggcagaaagtatgtctttgcctggaaagttaagactaggaaagaaagaagttccgatacgcatgccttagtgagtggtctttcacctctcacctgttgaacttggagtgtcctcactgacactatggccactgtgtcctttgcggtaaggaggctgatgagaaataacacgaggctttctatcacgaaggtagatatgggatcttgcctcctctcttttgttagcagtagctgaaaacctacccctcacactgattcagaagctatttggctcggtgaagtttagtgcaatagtgacaaaattttctgagaagagaaaggggtcattttagtttgatcctttaatctgattgtatttataaaagcacctgggcttgcctcccccaaggaagcagtgtttcacaattctgtatggccagagggacctggcaggcatttagttagagggaacccaagagaaagctgtcatcagaatgtgtcttggtcccaaatgaccagatccccgtatcctgacctgccagacatagggagagcaaattagggaaggaaaataatgaagactacagaggcatatttctaccagaagaattcagagaattctgtgctgttccctgaccttttttatatggatatgtctgcgtggaaacacagggacgggactgatgggggagcagtatttttttttattcctgtttggaaatctctgggttttctattaatataatgatttttaaaaatatgaacagtagagcactaacactgttgcagggaactttagggttaaacatcccctgagaggattgctgttaaaatcaatatgcaaatgtgagtgtatttagataggtatggccccctttgaagaaaagcagatatatgaaaatggggttttaaaaaaagctagatacattgggagaaattattcccattacaaaaggattatttgccttaccaaaggattcactgcagggttcctcataaaatagctcccttaaggcatttaaaacaggatctgatttacgcagtttttcaagaatgcttttgtgtaaagaaaggcacacctgttatggatatagaaatagttttgcaggattttttttttttacctatcttactatgtttatagaaaaatttctttcaacatagaaaatgtgattacatagatcttttaaacaactgcttgtgtttgtacttctgaatcttaataagattccagtcttttttatgctgatttttcagtctcaaggttgagggatgggagtatgttttaacatctgagatattcaggagctttctggggagggtggtcttgttcttatctctagcatcataagtattgaaccattcaaagcaaattgctttctttctttctttcttttttttttttttttgagacagagtttcgctcttgttgcccaggctggagtgcaatggcacgatcacggctcactgcaacctctgcctcccgggttcaagcagttctcctacctcagcctcctgagtagctaggattataggcatgcaccaccatgcccgactaattttgtatttttagcagagatggggtttctttatgttggccaggatggtcttgaactcccgacctcaggtgatccgcccgcctcggcctcctaaagtgttgggattacaggcatgagccaccgtgcctggcgcaaattgctttcttaagtaaaggaagaagggcccatcaaagttaaaattggatttaaatttacataggcttcttagtataactgttttggttttgtttttgtttttgagatggagcctcgcactgtcgcctgggctggagtgcagtggcgtgattttggctcactgcaacctctgcctcccgagttcaagcgattctcctgcctcagcctcccaagtagctgagattacaggtgcctgccaccaagtataacttttttaaaagttgagaatgtttttaaaaacactttaatatcacattcttttataaaacattttccctgtttgccagactgggattgttgttacataaatgaggaactcaactcagaaaaggaaaaagatttctacaaggtcgcctagagcctttggctgagcagagaatttttagtctaccagtctgatttttattccaagctttgaagatgtcacctcccccaaatcctacttttaggatgtagtttgttcatacacagactagggctgaccttctcctggcctatttaagtgatatggctgggcaaaaaattgcctcctgctgcagaaatcagccgtttcctctgggagtttctctttagcttttttttttttttttttttttcggtcagagacagattctcactctgtctgccagcctggagtgcagtgtcatgatcacagctcaccacacctcgacctgtcaggctcaagcaattctcccacctcagtcccaagtagctaggactacaaggcatgcgccaccacattccgctaattttaaaatatttgtagagacagaatttccctgtgttgcctgggctggtctcaaactcctggcctccgcagtccttcccaccttggcctctcaaagtgctgatattacaggcatgacccaccgtgtccagcctctcttcacctttgataccatggaggagaaatgtggcttttctttgtatcctggctccagggaacacctgataggccactgtgctgcggatactttcaagtcaatttgaactgctttgtttaaggagcatgggctcttaaaccagattacctagtccaaaatcacaactccactgttgcctagctttgtggccttgggtgagttacttttttgtgcctcagtttcctcatcttttaggattgttgtaaggattaaatgagataaaaagtactttaacagtaccagcacacagtaacatctcaatagtgttagctcttcttatttgaccagtgatatttcgtctctgtttaactctttaaattttttaattaaaagtgtgcatttttaggatttcatggggacttattttttaagagacaaggtcaccctctttcacctaagccaaacttgtccaaccgtggcctgcaggccacatgtggcccaacacaaatttgtaaactttcttaaaacattacgagattttttttacaatttcttttccagctcattggctatcgttagtgtattttatgtgtggcccaagataattcttcttcttccaatgtggcccaaggaagccaaaagattggacactcctgacctaggctggagtgcagcagcacaatcatagttcaccgcagcttgaactcctgggctccagcgatcctcctgcctcagccaccagagtatctctgggactacaggcacgcttcaccatgcctggctaattttggggggcatgcaggaggaaagacagggtctcgctctgttgcccaggctggtattgaacccctgggctcaagccatcctcccaccttggcttcccaaagttctgagattacaggtgtgagctaccacacttggcattttgtgtgtgtgtgtgtgtgtgtgtgtgtgtttgtgtgtttgtagagacagggtcttgctttgttgtccaggctgatcttgaaatcctggcttcaggcagtcctcccaacttgcatagggactttttattttggataggaaaggatgggagcacctacctttttactcccactcagccatttcctaatgtagaattctagaaaagaatgacttttctctctgtagcatattcttaaacacactcacacacgtgtacacaccaacttgctttcctaaaatccctgaggccctgcaatctggctagaaaagaaagaaaaccatttcaagatatttaattgtacagggagcttacagcattgatcgagagcttagctttttacaatagtccagtgaataagaaatgctcctgacaaacgatcaatgataggataatcactctttatccccctcctcattcttaccttctttctttcaggagaacagggttcagaagtcaaaaatctttatagacgccacttttaaattaagcagaaaatagacattgacatatttgttaatctcccctaaatcattaccggggctggctgctttgctgtacaaggagagaggggccctcggtgtgcaacacatgatataactggcttaatagcagccttttatttttagaaaataaaattttaaaaatcttttttcccctaaaacaaagcacacaaatccttgaccttcacatgggcatttaaaaacacatatattctccacttcagtcttttccttgttttgatgcttttttgaggtgggtcttgaaccataatcagaggcattactgaaggaatcaaacaaggtaggctttggaggaatgccctgcaatcttcctagtctcaggagggccagagcattacaggcatttattttgttattctttcaaagctctagaatagcttgattgagagggcaagacctttgttagcccagaagccagcatcctccgtccttccaacttggcgaagccaaagcctggtttctgaaacactgtcctcagcccgtagctgctccctcttctgcagccagtgctgagccttgctcttaactccttgcgaacaacaaaccaactctccagctggtttccctatagtggccactgcaggatatctgcttgccagccttcaataccatttaatgtggaagaacacaggctttggagagagccagacccaagtgtaaatcctgactttgccacttaagagctggatgcagccaggtgcggtggctcacacctgtaatcccagcacttttggaggccgaggcaggcagatcacctgaggtcagtttgagaccagtctggccaacatggtaaaaccaaatctctatgaaaaattcaaaaatcagtcaggcttggtgacgggcacctgtaatcccagctacttgggagtctgaggcagaagaattgcttgaactcagggggcagaggttgcagtgagccgagatcgtgccactgcactccagcctgggcgacagagcaagactccgtctcaaaaaaaaaaaaaaaaaaaaaaagagctggatgccattggggaagtccctttacatttcagagctgtggttttcttacctgtaaaatagacaccctggcataaagttgagttgtcctaaggattggagatcatgtacctgaagcaactgggaaagcacgcagtaacgttgaagtattcagcttggcagcagtgttaacagctgaccagatgtaggtgtgtagatctgtattgtgcttggtgattatgatatgtgatcctgaaagatttgagtgcagtgagtggtaaatgctcaataaatggtgtgttagatatggtccatgtatatgtgcgtttagccatgtcagtggtcttgccatccctttgctccctgcagggctgtgactttacctattattgtattagttcttgaactcacagtaacaagagacacaactcttaaatcttaggcctgcctaggaaattgcatctgaatgggaactattggagacattgtcctggtcttagttatggaattgggactaagatagaacctttatcagccaggagcccaccatcatcacttagcctctcagaaattaaagggacactactactgaagcacgtgtcttctgcccaagtaagcgagaagagacagctaacagtgttcaaaagctttgggacccaaactgctgcatttgagtcttggctctgtcacttgctagctttgtgaccttggtaagtccataaattctcagtgcctcagtctcctcacctgtaaaatgggaataataagaataccagactcctaaggttgttgtgataataaattaatagatataaagcacttagaatggtgcccagtaccctataaatattagctttgattattgattgtatgcattggatagccaggaataagttttcttttccagcttgcctaatttttaaaactttccaatttcacaaaaaagttacaagaataatacaatgcttttttctcaaattcacctattgttaatatcccaatgctttattatttctgcatattcacatgtgtacatgtatttattctctcttgctccacacacatatgcattttctttgagccatttgaaagtaatctgtggacctcttgcctttttttttttttttttttctgagacagtcactcaggctggagtgcagtggcgccatcttaactcactgcaaactccagttcccgggttcaagcaattctcacgcctcagcctcctgagtagctgggatggcaagcatgtgccaccatgcctggctaatttttgtatttttagtagagacaaggtcttgccatgttggccaggctggtctcaaactcctggcctcaagtaacccacctacctcagcctcccaaagtgctgggattacaggtgtgagccaccccgcctggccctaatgcttctttattcataaatattagtgtgtatttctaagaacacagactttctcctacataaccacaatacatttatcaaaatcaagaactgtaaacattgatactactgtctaatccatgattcatattaaaattttaccaattgtctcaatgtcctttttagtttttttttttttttttgaggggcggtctgagatctgatctaatgagcatacattgaaattcattgtcaagtatttttggtctcttttaatctggactgattctttgacctttgtttttcatgtttttcacatttttgaagagtgagccactttttttgtagcatgtttcctcagtttgggtttgtggttagatttcgattctgctttttgggcaggaatgttgcggaagtcatgttctgtccttctcagtacatcatcaggagtcatggtatcagtctgtcctcttggtgataatttaattacttgcttaaggtgttgttcactaggttaatccacgataaagttaccattttcccctttgtaattaataagtgatttgtaaggaatattttaagaccttgtgaatattctgtttcttatcaaactttcacccactggctttgacatccattgatgattcttggaagagtaatttacagtgatgcttgtaaaacggtgatttttctaattccatcatttccgctacacttattgttcttctgctggaagagagagtgttccctttcccttctccctcatttaattacttatatgagggtgaattggtagattctagtttcattccacaaatattctgtctgttaataaatatcattatttattttagtgttcattgtcccagaattgggcagtgggaacacattcaaaactggctcctgcatttttctaacatgtctcaatcgttttttgagggcttccttgtttttttgtcacaatataccccaggttcatctgatgttttccctacctcatccctagaatcagctatttctccagggaatcttggtttctttctgtggagaagggaaaatatttgcttccctaacaagggtgttctgagaatgtctcatctccgaagacaccagccagccctccatccctcagccctcctcccatcagccctcttgccatcagccctccctccatcagccctcctcccatcagccctccctccatcagccctcctgccatcagccctcccgccatcagccctcctgccatcagccctcccgccatcagccctcctgccatcagccctcccgccatcagccctcctcccatcagccctcctgctatcagccctcctcccatcagccctcctcccatcagccctccatccctcagccctcccgccatcagccctccaggcagatctacactagaatgcaatgggcctttgtgtcatcccttagtgtggggcccggtgcgttcatgctgttcaggtgttttggaaggaacactactgaggcgccggggcctaaagcagcagatcagtggcaccttcatcacagttttaaaatggtgatgagcttaaaaaaagaggtagagttgggcatccaaaaaactaataaaaatgaaacttaagtactatagttacatccctcctctgttaacctgtgtttatgtataatacggctcagtcagcagcccaaggctgtttttatggcatatgattcattgtggtgtaaaaaacaaggcctgttcccagacaggcatgcttgaaatagaccttcctcttctgcatcctatcacctgtgctcatgtatttatttgtcagctttggtgacaaagcacttcagggtgtccctaacaccaggggctgtcacctattgctccttcagctaggcttactcctccttactaggcaggcagctaaattttcagtattgattgcagatcccattctgagagtaattaggaagaaaggcacaccatagcaacacctctactgggacactattgattgggggaggggtccctccttggtataaggggttccaaagtctcctgtctgttgagtcagggtaccgtgcgcagtgatccaaatgaggtttgccaactgcctttctctttttacatcctccttctcctttagcctaagaagtagaatgtctttgtctggtcagggactggctctggcagtagcagcccaggcgggagagcacaggctaacccactgagctgacacaagatgtgaggatctagctctaattagattgagttctactaattagaggttaagagtatataaacctgagattagaagccatgaagtactatggcttgtaactttaggagttattcaggtccttgccaagtttggcagataactcgcatgtacacggaaacaggagctactagtttgtgctcggagtttaggggtgctctcaccacatcccacgtgtggaatagcccagctgctttgatgctggtcagcagggatgggcatggtgtcagtgtacaagtactggcctcaggggaaggaggagcctgggtggtgtcagcaatatgcagcaggcctctaggtcgctacttgcaccttctcagggagaggcatgggagaggggctgccatctgccttcacacttgtgactgccacagggaaaagagggcatgtgggcttcttgtggcaaggtaaagactggtgtggcatcttgtagggccctgttaatcagcaaagagcagagaagacaacggagagccaggccacagagggaagagggggcaggctgatgttgagcttcccgtgattgtggctgcttttgtgcagagagattcctggtcattacagagtgtgacgggcatgtttatctaattgcagggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgtaagtacaatggttgccacttcttgtcagaggcccacatgtgggcaagtgtgtgtgtgtgttgcacacaggctcataagcagggagctatgagggccaaattaaaacaacttctgcagatcaaaacattttcaatattttttagattttcactgtttctgtaactgttatcatcttaaaacaatgtataatttaggtttccattaattcctcaggaggcaagctgcattttactggtgggaaactgagtcacatgtgacttcattggtgacgggtcctcaggatgtgggttactatagggtcaaggctcccgcagcagctaattaataattgatctgcaagttgtttgatccatcttctcaaaacgaatttatccttgtctggttatctgggaactcacagcctcttccccagaacatctcagccatgtgtgggatcagcattagccaggcccatggctgtgcacagtgctgcagacagcagggcatgtgggctgcatttctgccctgggggacatctggaagtgctaggagtttacagccagctcttgggtctgtgaagggcttgcctggagaatcagtttttatgcctgtgggtttccctccagactgagcattaagcaggaattaggactgggctaagtttattcttctctgcatgtaggatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggtaggtgggacactcaaagagaagcctttttgctgagttcctcacaccacctgagggctgcaagtctcgccagcaaagagtccacaggcctctaagggcaggagtagaagggaaacatagagatccaagctgtttcctcccccagctactccccctaacatgtcatgtcacgacatcttgttagaagaggtggtagggcatatgttgcagcttatgcaatcattcagcagacctttttgaacacttactgggtactagacactgcatttgcttctgggggcatggcagtgaaagaggcaaatgttgttcctatccacatagagctcaccatctagagggggagacaaataaagaggttatgcacaatagtgaggcccatgttaaacacagcaaagggcacagagcacagcgagaagatacctgaccctctctgggaaggatggaggagagtctaagaagccttgtgcagtaagtgatgtctcaggagaggctggaaaacaaagcagaaatgaaccagaagaaaaggctggatttgggggcagtcagggcttaggaggaatgttcctgcagaaggaacagcatcatcctaagccatgagagtaagagtaacatgcatcaaaggaacatcctgcaactgtttcagggcagctcagagactgggtgcctggtaggaagaaggggcaggggcatgatcacacagggccatgtaagctgtcaaggagtttggactttgtcctgaggcctgtcggaaaccactcaggtattttaagcagtggagtgacatgctctgatttctattttagaaagaccactaagggggctgtgtggaggagggaattggaggggctaagagcagaagcctaacaggttgtgatcggcaggagatgccatgactacaactaaagagctgcctacttccaatcagagatggaaggaagtatccacccttatgcagggaaagggacctatgaagctggcattttcttggggtgatctcacagagagggctcgtgacctagagcagtaaccccactgagatggtgtccttggtgctctagcctcagtgttggggatggggcgggtctcaagccaggatgacctagcaagggcaccagcatttgctcctggaatagtgggctgcataagtcactccatggatgggaagaaaaagctggaacttttatttctgtttatttttactaacaaaaagaaattaacctttattagtaattaatatatggattaatcatttacatcaaaaatgcattttatcagaatattggtagtatgtgctcaaaatatatttgtctgtctttctcattgctatgtgatcacaaacatttggtgactaccaggttagagtattgatggagggctgggtggctggtggtggcttgaagggtcctggcccacaaagaggggcactctggcctctgcctagaaagtgttgcctgaagcctctgctaatcgttctcaaggaggagctcccagatttgctgtcagttttaaagccagtgaattggggtgcttctaggattcacctttgtattaagtctgcccattttttttatgactgaaaagcttctttggataaatatttcaaatgtgcagttggggagcacagccttctccgacatttggttcaggttaaggtcagtctgtggcatcataattgagtgagacaattttgtcagtggctactggcagcttctagtggaagttggcattgaaagtcacgcaagtgtaaaataagagtttgtcctccagttaagagtggccggctaggtaaatggagtgtgtgtgtatgtgtgtggccaggagaggcctgcactgcctccctaccacattagtcactaatggacgtgtccagcctcagtaggcacaaggatgagaaggaagtttccccccaggcatgaagcaagtagataggcccttcagcttttccctagcatcctgctcccaagcggacagagcgtctgaagaaataggtcactgccgtctcttatcaatggagagaacagttgaccacgtgtgtacaagctcctggctggaattgaagcacagaagagaacctccaccccgtagctcagtaggaggctgcctaggcactgggggcagccatgctgagcactgaggccatttcccttgtgcccatctacaaaaggcagcattctcctgagttctctgagaggaatgccaaggactgaacgtgaggacgggtaatcctatgatgtcagggcatgtggctttgaaacctccttccatattcggcaggctcagcaggacctagtttagtgtgaggtgggtgataaaatctgcagtgcccttgagagaagaaagggttgcagtgttcaaaagccatctgtgtgcctcagaaggagtgatgtacaatctgcttgctgtttggtgtgggggggggggggtggttcttcaaagaatgatagatactgtgtgttgtgtttctcaagtgcaaagactggctgagtctagaccctggctttgcaccaggaagtgaccctctaatccttattgtggttggttactggtaagaaaagacatttcgagataggcatctattagctatgccttgtgttctttttgttcccagagaatttgttttcttaatcttaatcctgaaaacagaaattctgggacagaaaattgaagacacggtgatattatataactgagcactataattcttttgtttcccttagagatatctgttaccatgagttatgggagtctgtttgaatccactgggacgatcctactgtaggaaatagtaggatttatggttcatagtttcactgcaggcagaagcaaagcatcactacagctccttaacgaaaataacaagaacagtagtttaaattgggtcataagaacatggcacacatttgtatcctgggcatggtttctcacttgattcttagatccaaaatttgaagcctggtttttcaaacaggctgatttattttttcccagaccccaatagtagaaattgaaattaggactctgcatggaacaatgagaatgtgggttttgaaatctcataaacttcgggatcccagctttgtcatttactggcatgggcatattatttaagcctccattccctcatctgtaaaatgggggtggtgtttatgtcatggggttcagtgagttttaaataacatgagtaaagtatggagcataagtcagatgtggtggctcacgcctgtaatcccagtgctttgggaagctgaagtgggaggatcgcttgaggccaggagtttgagaccagcctggataacaaagcaagaccctgtcttcacaaaaaattttaaaatttgctcggtgtcgtggcacacacatgtagtcctagctcctcagggggctgaggcaggagcatcgcttgggccaaggaatttgaggttatagtgagctatgatggcgccactgcaccccagcctgggcaacagagtgagaccctgtctccaaaaagaaaaagtatggaacacaatgtctggctcagtagacattcaaaatatgctagtttcccctgctccatgttagaaggtaaaaaaataatagcaacatagaccaagtcaaaaatgtacagctgattgacctcggcggaaagggggctgactcctgagcacagtgggtgctcagacgctctttggtttggcatgctctcatgttcccacaacccgatgccatggtgcattcttattgttcacacagctacccactcgctcttattctggatttccaagtgaaatgaatgctcaacagaggcccctgtgaggaccataggaaaaagcactattgacagggtcacttatttccactgacctcaaaacctggcctcaggctactgatgaataagtctcatacaccaaacttctcacacagggccaggcagggaggaggtaaggtagaacctggaaagtgttgcttggccctgctatgggcctggagctgagatgggattggctcacaggagcttggttcacaggggtctgatggccaccctagcccacatgtcctttggctattgtactctaaagcccttggaaaaaaaaatcacatcctttcttgggcttctgttggatagggcttagccttgtaagtgtaggtgtattgaaaatgtctttccaaaatatgagtgtaccttaggatttgtatgccatccctacacccatcaggctgtgtgtttcccagaagtctagaaggtcagaaatgggaggagcctccctagctggaggtgtctcccagcagctcccaaggtgagttattagtagggtatagtaatcagggctcacatccatcaggttgtgccctggtcactccttggccctgctgaaccattgtctaaggaggacttaacagctatccagtatgttagaaatgaaactttccaaacaggtcatttagatgttgtgagatagactaattactacataaaattagtgaggctgactagtgcctgagatacttatccactgatgcagacagaaagtgtctgttgaacattcattttaggacaggccactgttgtgatgtagaattattgatattttattgataaaatgttctgatacagatggatatgctgacaggtggcatacgggcccaggcctgtcatgatgttagcagcctagcatatcacacctgtttaaagtccacgctggaatactaggaatgactggccacattttctttttttttttttttgtctcactctattgcccaggctgctggagtaggtatgatgactcactttcagcctcaacctcctgggctcatgtgatcctcccctcccacctcagcctcccaagtagctgggactataggcatacactaccccacctggctgatttttttgtagaggtggggttttgccatgttgcccaggctggtctgaaactcctggactccagcaattccctgcctcagcctcccaaattgctgggataacaggcgtgagccactgtgccaggcccattttcataattttaaggagggaaataataatggcttcttcctgggaataaggttggcctatccttctggatgactggaattgagtcttacaactgttctaagggagcaaacaagaaactgtaggctctggctgggcacagtggcacacgcctataatcccagcactttgggaggccaaggcaggggaactgcttgagcccaggagttcaagaccagcctgggcaacataacgagaccctgtttctaccaaaaaaagttttgccaggcatggtggggcatgcctgtaatcctagctattcaggatgccgatgcaggagaatcacgtgagcccaggagtttcgggctgcaatgagctgtgatcatgccactgtactccagcctgggcaacaggaggagaccctgtctgggggaagaaaaaaaaacctgtaaactccataacccagtggaagggagcttgcttttcccaggtggagcaaattatcccacaacagtatggtaactctcccaggtctgttgagaaaaaccagtggcactatgcttacataagtttgtttatttttgctaaacatgcagttgattagaacttgagacccctttccttcatgtactctaggctgtaatccactggggtttggcggtcattgtcatccagttgtactttgcgtaaacagcagatctttttataggacccatattttcaagcaactgtaaaacttggaatgcgttgccctaatcctgtctgggaacttttcaaaatgtttaaacacctagcatactctgtggctgcaggaggggaaggcagaagagttttctctagagggtagctggctttccagtgtagtgtctgagcattgttggaagcaggcatctcgttagctaatacattacaccaatcaaggagagttatcttaagccacaattaatctgctccctggcatatgttgataggaaagcatcatgctgtttcttaattaaaagcaaacggattaaaaatgattaataagagtattaaatattctcctaaactaaaggctttgggattcttgggtaaatctaaaaatcttggggttttttttttttccattctgaaatccaagaagcatttattgttttatttttcctcccctccaccccaatcttcataagtaggggtatgtgtagaagtcctgaaaccacggagcagaagagtaaattgccaatgatggaaatggaaatgttgaaatttaggtggcgacgtttaggagtccagggggacccatccatatgtggggcgtgcagcaagctgggtcacaagagtgagttaaaaccatgttatgggaaaagcagtgctaccttctccctcgtggataggggctgatgtgacacttcctttccttaggcgcaaaacactttctcaaggcagtttggccttgagagatgctgggagtcctaacccaggcacagagaggagagggtcactcaggtttgcactgacggggccacacaccccagctgaagaattgctgatctgcttatcagtgattagatacagaactgggcacatttgagtcagaaaaagaaatggacaaagaactaaaagagacatactgctgatccttagtccccggaagccttcatctttccaatgtaaaggagttaatttttagaaacagagacgtcgatgaaatgacatacattaaataaccagtcacaactaagtcggcagctaagttagagacaggaagtgacagtctgaaaagaaaccattatatttgaaggcacgagatagttagaaaatagcctagtgctcagttttgtactgcttgaggcctcttgtgatgaagacatttcctctgcagcccagtagtcacagctgtggctttggtgaccttgcttgcatacaggcttcctgtagccacgtctcaaacctcaaagcctcagagtccctaacaaacacacccacctattaaattatagcaccaaactcattgtcattctgactttgacttcgttagtgataacagagaaggatagcgcacctttaaatgacaagctttgtgtttaattacccaaacaaaatgacataaatatgaatgagccctaattgtggtacttggttttccggaaaccattaacaaaacgattcctaaatgatttgtaaagaaaatgagaggagaagagagcaaggagaaggctattaggcttctaacacactcctgaattattatgtagtcaaccacctaggaaatactcagctaaatgatcttgaaaaggaggtgagaggtggtttgttgagactttcagggttatggacgtcttgatcctttcgaatactctcataggtaataaaatggggcttaggtttctgacctggtggctgtaccctggcaacaagacttccctcccatcagttccccgtccgtgcctcatcaaaagacagtgggctctatttcaggagacttcatccatccagtgactgccaggcctcactgaggctagagacttatactttaggcattgtgtctcagctcctctgagagcaaaacaccaaataaacagccttgccttctcaatcacaattttactaagtaatttgggcttttaactggttctctcaaacctgtcaggttattgaattctcttagcctttgtcaaataggtgggtccctagagtctgacaggacagagtcagggtatgagcaccagagtgctcgggagagccccatggagacttcaggtgtacacctgtgtccataaaggaagagaaggagaaggggcacagctcctgcctcgaggcctacttcctcctcctgcacgatgctgacagtgaaggagaatcgtggacacggagcacacttttggagtaagcaagcactccagatcctgaatagtcagggtgtcccggcctggcctgacccctggtgtttgaccaagagtcatctgtttgcaggcttatgtttgggacaataataaggatctggcggagtggctagagaaacagctgacagaggaggatggtgttcactcggtaatagaggaaaacatcaaatgcatcagcagagactacgtcctcaagcaaatccgcaggtgagaccaacgtggggaactccactagagaaggagggctaatttctttggaataaaaagtttccaaacaaatcatgagatgatcgcagaaatcttatgatctctgcagtctcttgctgtttgagacagctgtagttgacccacaggtacagatatggcctgaagcccaattctttttcagctactgctccccaggggcacttagtaatctcagctagatgaaggcttaattcactgtgcccacctcttagctctgaatgctgatactcaaaccggatgaacaactctgggaggaaagctgattgtgtgtgtggtggtttcctgggaaaccacctcctcacctcctgaagccaagagttagctgtattcttctagaggcttcagtctgctccataggatcggtggtagagactgcaggggcatttttgtaaaagtttatttggaaacatttcacttacagaaaagttataaaattaaaaacagtacaaagaacacccctatatataatatctgtactcagatttacctgttacattttctccccgttgctatatcacttatgagtgtgcctgccctcccatatgtgtatacatttttcctctttctgaactacttaagggtgttacatatatcatggcctttacccccaaatatttcagtgtgcatttgctgagaatagggatacttttacataaccatcataaaatgatccacttttgtaaatttaacattgattaaaaacttttatctgatatctaccatctgtagaacattgctcattttgagtttgtctgatgtctccccatgatgagatgcaggtgaggcactctggccagaaccttcacagggcaccacatctgggggcacatgctgtttatctgctcctcctcgtgttaatttcatccgctggtcaagatgttgctccatttctctaccgtataattactgattttccccccttgcacctaataagtagtctgcaggaagacattttaaggccatgcaagtatcttgctttcatcaaaatttccctctggtgcagtctttacgatgagcttgcaaaatgataactttccaactccagcacaccctccacaattaccagtcaccactcagtcctcactcctgccgattcttttatatatacattattggtacagactcatgaagttctattttttactgatttataattcattgctgggctgcttttgatgccccaattgctgtctttgtgacatgcccccattggcatgttttgggttttttttgggttttgttttgggtttaattcctttttcaacatagcaaaatgttttgggtttgtcttgcactaccttggctggatatttgtaatatagggaaacaaataaggtgaggcgtgactaaaatgtctgcagtggacggtgcacacatgtttattgggcagttctttagctgtcctcatctagacacttctgcttctcttttcttcaccattctcaatcttcctttccagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaaga

SEQ ID NO: 60 - DNA, 29829 bp, Homo sapiens
ctcactttaccactactcgctatagagccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctggtaagtaaactttatttatttatttatttatttttttgagatggactctcgctttatcgctgcccagactggagcgcagtggcgcgatctcggctcactgcaaacctcacctccttgactcaagcaattctcctgcctcagccccactgagtagctgggattacaggcacacaccgtcacgcctggctaatttttgtatttttagtacagacggggttgcaccatgttggccaggctggtctggaactccacacctcaaatgatccacccacctccgccttccaaagtgctgagattacaggtgtgagccaccgtgtctggccacatcttgtagataaactttaaaaatcttttttctttgttatgaacaattttaagtacatacaaaagtagagtataataaacctgacacccaatttcaacagttatcagctcatggatggtaaccccctttcccaggcctttgtattattttgaagcaaatcccagacatgacaccatttcatctgtagtactataataggtagctctaaaaaaaaataaaaataataaccaaaattccacatcacacctaaaaacaatgaaaaatgattccttaattagataaatggttggtctgctggaagccacaagaagaaaggaagaagagaatcaaatctgttcaagacaggggcttaagcaagttctctccagagtcaacacgatgatggaaatacccgttgtcaccgtcaaggtggactctccctgctgcggagtggggccgaggtcgggggagggcagggaatgaagccagcatttcatgcctgaaaggaggcagagcggagatcccctagtgactaaaactttcttacttcccaaacaaaacagcatttcatttgaaacaattctgtacaaattcttctgcttccagattgatgggaaattagaatttaattttatcttttcatctaccttgaggccttgttgacagtgttggcttttatgcaggttctattacacaactagagctaattgaacagtgacagaactggtctggtttgtgaaatttaatagagcaccaaagctcacgttttggggagaattcagttcttaaatatgttttgcttatcccactccgcctaatttcccctcatttgtttgacaaagtcagcaacccagtggaaacctcaatttcgttctctgctgctctcatcataaaacctcgaatttaaatattttccttttattcttagctggaacttggagcaatttggtggcttcaaaatgagatctattggtattgaagccattgaacatcaatagtgcaaacccacattatcatcccccatttaaataccaaagtaaatgtgaagtggtaaacattagcagggaagtgaataacaatgctgagaaggttgcaagctaaggagcatgaagaggtgaaaagggaacataaaacgtgctgcatgtttcttctttcaaagcagaagctaccttataagcaccaaaaacttcagctggaggagatacaagcctggattcagaagactgccgtagaacagaggcactgggaaacctgatgttatccacacaaacctttccacatagggctggcctcagaaagcatgcagcgcaactgccctccaataactgaaatttgttaaatgaaaattgatagtggcctggtccactgggatctggtttctgaggaaatttctgataagctctcttctaagaccctttgctcaggaataaggttttccctgcgtggccccagctccacccaaggcctcacagtctcaggcacccgagtgtctagaaatgttcacaggtgctgggtcatggggttgggatggagggtctacacttgagaacaactcctctgctcctgtctgtatgcagaaggccattcttccctttctctttgaagactctgcctcctccacatcagcagcacccaaccctctccttttagcactttcattttacctgcttcccctcctacattctagtcttggttaatggttgtgatggagggtgggaggcaaagtggctttgcaagccggcttctgaaacttttcatctcccatttaagaaggagaagaaaaagacagagaaggttagatgaatagaagttgtaaccctgctgtagctccttattctctacttttcccttgagaagcaagcttaaggaaggcaggggcaatgtctctcttatctgctgctgcatccttgctgctgagactaattcctagtttatggtaggacagcaaatatttgtgaaatgttattggatagctgcatggatggatactgcttagcagccatcattattccttactaaaggagctattctaccaagaacttgaaagagactatacaagagaaaatagaaaccagtatacatttccccttttgatctaaagagcctctctttttaacaacaacaaaaaaacctttatgacttgcggaggctgaagcaacttcatttttagatgctaatctgccatgttgacttctgattaatcctttttcaggaaggcttctaagatttctagtttatcgattgttccttgtatgagaacacatacttgtcataagtcctgcctgtacgtcaaaaccaccttgatgttatgatacttcaattgtcatatacatcccttctgaatcacgcaggccctttcccggtggtatgtaagccctgggtctgttgcgggatgatcaaagactgaagagaccgaaagttcaggaaagtttattaaattaaggtgatcaccggctcagctagtctgagccccaaacaaagggcttttcctacttttaaatatcttaaggtgggaactacgtgaggcgggaatcgagttacagaagcaagaaacaaaggcagtattacaacgtttgttacattttgagaaagacatgtcttgcagcctaaacttatcagtcttgtgaccctgcagtcatgcaggaactcactgggcctgtaataaactttgaggaatgtggagttggggagtatagataaggtccactgtccacagagagaagacaggctgttaatattcccttttaacgtgaatgtaaggcaggggtcacattttgcaggaactttaaaaggattttaaaatttgtattactactactcttaggttatagttgatttcattaattccttcttcatttcccccttttggtgctcgacacaaatgtagattaataaagagcaccacagttagctatttcttcttgagtgggtacatactcatcttgggataccagttggtacttttgcagagcctttattcggatggtggtatgtctgtctaccattgagtctatggtggattggatgcttccgattagaaatggcaagagacagggaagcagtaggcatccaccttttatggccacaaagcctagtattacagttttaaagcctccaaaccatgaaaaccgtcctccaaagagtgaactcgggttccaaccagaccatgtctgaaccagaacatgagctaacttccgcatcctggcagtgatttccatgacagcttttccattgtcatcaatttgtaagcagcaatttgttaaattaagttttccacaaacccccttctgaagctaaaacataattcagtactaacctgttctgataaatggcatctctcatctgggttgcctgtatggctagcaagtctaaggctcaggctgtttcattgactataatttccagaactgcttgcaaccttatgatgtggtttaacatataaataggagtacagtatccccatgacccatcttgtgcccagggggccattcattatctttccagccccctatttcaatgtcctttttaatgttagtatttattttttcctcagtacttatttttgtaaacacatttcttttgactctttttctgccttcatcatagaccagatagcttagatcttccccttgctgcagggggagtagcaaaaagaatggccttattgttcctaatatacatgcccctgtccatttatcggttagtaattgataagcctttgttccacagatcctatataatcctgcaggtgctctccaaacagttggagcttctaattggtaccatgattgatttagtgttgggaactgcaaaaagggattaaagtgacacagaggaatcatctataaagcttctccattgtgttctgttctcagattcttcaaaatattgttgacctaggcaagttgtttcccctatctggttctgaaaggacttgccccaacaggcaatacagtattttccaatgatggggttccttaatagccaaacacttggatttgcattgaattttgtaacaaattcaggcaaggtaaaattgtcttgcagcatcaattctctggcttcccagggccattgatctctcatattagcacctccacatacataacaggaagtaactcctaaattgttagcaatacttttggctagctggacaaacagattttcagttgatataggaggaatttgaatttttgatacttcagaattaaagtgttcattgaaagatttataaaacctgaactgttgtattgggctaagttgaacttgagtcctttgggttttctttgtgatgaccagaggaataccaagtcctaggagagctcctgcctgatcaaaggttagtaatcctttatgccctttagtccagaaagtcatatttggctttagtattgtcagattgagtgggtagcatgttccagttgtgtaccctatcttctcctcttggctggcaaacagagcagcccttccagtgtataggtgctgattaaattcatgtgtggtccactgattatcacaatcagggcactctttttcggactctcctattatggccttggtggctctgctgctgactctttcttgtcctagatttttacagatggtccaaatattatttagtttactgagatgtgcagcttggcaggcatcaaaatatatggagacgggccctttatgcgcgtaagtgaatacttgcgttttgtttacaagtttactgaccccagtttctgtggggtttgtatatgatggcattaggggttcaccaaatttggacttcaaataagaagtcatagggcaagaactctgggtcataacatatttggggctgcccgtttccaggatcacagactgagtaattagtctggttataaacaacaagttcctgtatgagtccctgtacactcatagtaggtctggtataacagagttttagtcacaccttttccagaccaggcttctatcatacagtgatgacagtcatcctggtccccttttataaccataggtgaaagtgtcagtggcttcagtattactaatatgattaaacttatactatgcatgggcacctttctgggcaacaagcttggcagcatttgcaaagataacatgacagcaaaataattactacaagtaagagtataactatgtttgtaaatttagtctacatttacttatgtatcattgacttcctcaggcttcagccatgcatagactagtcagcttccatttgtgtgactagaacagggctcgatgtttcctcaagcttcagccgtgcgtggaccaaccagcctctggtgtggttgaagcagggcagttgtccttgtcagcagtggcttggtttcaccacaggatcagccatgttgagtggtctgggttttgttgacttgtccactggtcctgggtggtggctgcttctggtttcagccggctatgatgaacccaaggtatgatacctgcaactttaacagcagtgggagtagacaagatcacaatatggggactatcccataaaggccctaaagtggttgggttccattgtttgacccagacagagtctccaggttagaagggttgtactgcatctgtgaggctaacaggtattctttctcttacccatccttgcatttcctgcgagacctcacctaaggcttgcatttgccttcttaaggttaattccccaattttttaaatccccgtttatctgagttatgatcagggtgtcggccaaacactatcttatagggtgaatacccagttaatttagtaggggtgcacctgactcagagaaggaccatgggcagcacctgatcccatcttagatgagtttcatggcaaaacttttttaacggctgtttgagtgtccggtttattctttcaactttccagaactctatgggtgataagctgtatgcagttttcatttgatttttaacctctgtgttagctgttgtactatttctgccacaaatgctgggccattgtctgatcctaaagttagaggcagtcgaaatctaggaataatgtcctttagtaagattctggttacttcccgagctttctttgtcctggtgggaaatgcctcaacccaccctgagaaagtgcagacaaacactagcatgcaccggtagcctccggttcgaggcagctcagtaaagcccacatgcaggttttcacagggtgtagctccagtttcttgaatccctgggggccatgttggcccctgctgtggattgtttggggcacaagttaaacattactcataaatggctcgagtgatggcagttaggctcagcaatagaaatgccatcctacaagagtctctaatgcagtttttcccatatgtgttccttgatgaaactgttttatgaaccaggggctattgcttctgggatagctggcgagcctcccatttgagaacttccaccaacttcctttctggtaacttccactttcctgctcaaaccaagccttttcattagaggagtagttagggggttctgtaagaggaagctccaataagggcatggtaagggtttcctcttccttcttagttatcgctgtcattgcagctcttttggcttctctttctgcctttctgttttctctggccttgtcatgtcctcctgtttgatgccctttgcaatggatgactgctacttcttttggagcccatacagcttctaagagctgctctatttcctttttatttttgatttcctttccttcagtagttaacaatcctctttccttatatatggctccatgggcatgcaaagtggcaaaggcataccttgagtcagtatagatgtttaccgactttctttggccaaaagcaacaccctagtgacagctattatctcagctctttgggctaaagttccggccggcagagggcaggtttcagctgctgaattcagtgttaccactgcatatccagcccaactgataaacctttagatatgaagctgcttccatcagcaaagtatttaacatgtgggtcttttaagggctagtcctttaagtcttttcagcttgagaaaacttcatccacagtttccacacaacagtgataccctgggccacacaatgggggctttccatgctccgcccattctatcagcagcagtgtggccggatttagagtattcatagtctccaaggttaggtaggggatttcacacaaaagcccttgatatcttaacattctagggttagaaagccagcaatgtcccctctgctccatcagagtgacaaccgtgtggggcacccaaattattaccattcctctgttgttgggacagtaagggtctttatcatggcttttctttgacctagatttagagtcatgtgcccttctggtataaaggagatttgtgcttgcaatttctggaggaaatctcttcctaacaagggcaccggaaaatttggcattcattcttctagtgtcccatctgcttgcatctcacacattgatctcccttaagcctaagttggccctcttgtcctggcttagcttcctggttttacctagtttgtcctctatcatgaccgcaaccacgaccacatcctctcacaaaaccagtttctcttccaactaaggccaccgccagcaagtctgccttttccttagctctgcatctagcttttctcttggcctcctccttctgatttacaaacaccttagtagccacctggataagctgggtaatattcacaccttcaaacccttctaacttccgatgtcttcttgcacctggcttacaaatgccacattaaccatacactgattacccgcagcctctgggtcaagtggcatgtaaagctggtaagcctcgcacagcctctcataaaattcaccgggacttttatctggcttctggcgaacctctgagacctttccgatattggtggcctttttctctccagcgtttattccatttaggagtgcctctcaatactgctgcaaacttgtagcccttgagcctggttagggtcccagcctgggtcagcctctatcaggagtgcttgttgtgtatactgcctgatatctcctgtgcttgaagatgcatttttctccagccactggagagcagcttgtataactctacggtgctcttccatattaaataatgacagaaaaaaatgtttacaatcaacccaggtaggattgtgagttaggaaaatggactgcattagatctataagagcctgaggcttctctctataggagggagtatgttgtctccaatttaagagatcagtagtagagaagggctgataaaagaagagctgttctcccccttggacttcattctgtgcattcaaataaatttgtccccatgtttctcagagtggcatctgcattgcttgggcacggaccgacctaaggcggccgacctcatcaccctggagttcctcccttggcttttcagtcaagggctctggctcctctctgcgtggtgttgcctgaggggtgcttccttctgagtctgagtctccggaggcagccggggcagccttctgtctaagctttgccagaggtggataaattggtgcatagtggggtggaatttctaactcttcaggcggggcctgtaggacaggtttttactgcttttcctgtgacttttctttttctgatgccttgcagtttctttctattgttcctggttttgtcttggccgttagagtcttacagtagatctcaaagtaggcctgcagccacttagggagggtctgaattatacttagccaggagtcaatatacggaaactgatccaggtgcccgggctgttctccaagcctggtgaccacccgaaacactcggccaattatctccctgtctattgtccccttggctggccaccctacattaaaagatggctattttatctcaaaaaagttctcagtttctgtgaagttagcttaaccccatagtcaccattaaaactttttttaaagtttttcagcacgcactccagtggaataggctttgacgcttttcctcctgtttcctcccttgtgatgcactttcactctcactttcactcttggatccaccagactgggtcctattacaggaggttcggacactgcttagccaggagcatgccttaattcctgtcacagctagctgcagctgtggagctggtcctctgggccgtatgcagtgtcctaggtctggtttttcccacactcgcctgggagcacacagtccacgctaagagatctgtgcctccccacatcaaccccgccttggtctctcccgagaccatctcttttacacactttcacacacctcccccatccccaaaatggttttcctttctgaccgactcatgagccccacttacgtctggtgtcaattagggtgtgagtttcatctgaatcaatgggcctctcccattgtcccaaccccctcgggtcagactagttgtcatgcccttggaggtgaccaggctccccttccatccttatgggacgggtcttgccttagggcccaaaccttactgcagttcatatgtctatgcactgttcttgtgactgtcctgcaaccctttccactggttccatttgcactgttggaggaaggctccagaacgtggaagggctgttctccttctgggctaaaactctcccggtggcaccaaggaccccagatttcccatgtcctggggctctaacccacaggcaaaggagacgaaaatctgccatctccaatcccagactggtccccggaaatgttgtgggacaaccaaagattggagagaccgaaaaaggttcaggagagtttactaaattaaggtgatcagtagcacatatgtccagaaagtctgagccctgagcaaagggcttttcctacgtttaaacatcttaaggtgggaactacatgaggcaggaagcgagatacagaagcaagaaacaaaggcagcattacaacatttgttatattttgagaaagacatgtcttgcaacctaaacttatcagtcttgtgaccctgcagtcatgcaggaactcactgggcctgtaataaactctgaggaatgtggatttgggaagtatagataaggtccactgtccacagagagaagacaggctgttaatattcccttttaacttgagtgtaaggtggggggtcacactttgcagcaactttaagaggattttaaaatttctattactactactactattaggttatagttgatttccttaattccttcttcaggtctacagggtaatggcatgagggtccaccatcttgtcttgccactgtccaggacacacacatggctctgttcataagtccctacgaaatgtttctttctgagaaactggatatgtcagcctttttctttgacctctcagcttccttggactttaagggtaggtttgcacagacctgttcactatggaacatgacttttttgttctttcatgtataattttagtatctctaaacacgtgtagtaaaaaaaaatggtaagaagaatgatataatgaatcatagacagagaacagatgacctgcttcaatcagatttcaaagacaatgtgaaaaagatctaatgtagctcaaaaggagtgtcttccccattcatctttttaaggaatcatgtggtttgacaggctcaaaatctttctccagctcactggaaactgggtgtgaaaatggaagaggaagaggcattagctaaatggagcccaggaccactatggagtgggaaaggctgaagagtacggcagggagccccgtggagagccagatgcagtggaagggtatggggcatagcagggagattaattggggacctaccaaaaagagaggaaaagagtgaatcaacgatagacccctcttgctttgaaccactgccaggggccccgatagctgcaaatgccaagcacattactcaaaatcaccctggcagccaagtcctagtccttggcagcctctccgcctcctggggccagattcccttaaggccccactagttgtttcattcactcacctgcttgccacttgcacaatccctgcactgccctgcccttcagatctgcccatcctcagtgttttacctttctgcagctaatgaagccccaacaaaaaacgagcttcccaataaaacgagcttccacataaaagtgacagcaaatgttttttgaagtgatttttatactttcatatttttcctaaaataaaataatataatgtagtatcaaaataaaattgtagttgcttcaaggaaccatctgccttaaacccgggagtgattgtctgtttgtggattttacagtttcctctttggtcctgagctggttaaaaggaacactggttgcctgaacagtcacacttgcaaccatgatgcctaaacattgctttctaggcttcctcatcagtttcttccttactggtgtagcaggtaagtgctttgtttctttttaattgctcatagctttgtcatctgagtccaatcaaggatctgttggaaatggcactggtgcttttttgaactttataaaggctgcagcttttgatgtcactaaatgatcagagcaggcatggggttagtgtctatctgcagcttgaatgaccccacatgtacttaatgagttcccactaaagaaaaggctctctagagggtgcagagacttcatacagaacaaatgtacatccatttctctctctctctctccttccctccctccctctttctttctctccctctctctttctctctggctctcactcaccttagaatgtcttttaccttgaaggaacactaaatcatggtggttaccagcacaggctcctaagccaagctatcatggtctggatttcagatctgccatttaccatctaggaaaacttgggaaatttacttaacaccctcaatttcctcattagtagaatggggattctaggtcactgtgaagattaaatcaattaatatatgccaaatgcttagagaagtgcctggcacaggatagggaccacaaacaacaggtgagaatttgcttctggtattcgtggaggaaactgcaggagtgtagagcatcttatcagcaccacatacttctgagcaagcctgtaagaatgcaagttaacaaatgggtacctctcagtgtaagtgatttaagtaacttgccaagatggtgcagttgtccagtgactaatacataaaagcaattcaagccttcatcttccagaagtgtttggatttgagaagactctggtacttggtaacagcaagggcacatttagcaaaatacggcaggaattcaaatgctaccaaaatgttcctggctctgcatcttaccaaacctgtaacctcgagtaagagatgcaactttctaaagcctcagcttcctcatctgtagaatgcgataataaaaatatttaccttacttggtggctgtgggaattaagtaagttgtaaagctttgaacatagtgcctaacataagttaatgttcatatatgttcaatgtttgatgaatgccggccagaaggaggaggaggagggaagaaggaagaagataaagtatagcctcagcttctaattggtctgcctctttcattagctcctctctcccatggctttgctcttggttttctgttggagggtaatggcaggctctgcactcagactgtctgggtacaaaatcagcttcaccattggctgcctggcaatctccttcaggtgtccaaggcttcgttttttcagtctgtaagaggaagaccataatgcacagtaccttcctcacagaagagctgggcaaattaaatgagtgaatgcagataaaagtccctcagtgcctggtgcagtgttattactgttggtggtggtagcactgatgttacaaaaatgagagaagaaatccatagacagagagattaagggcattaagccatctatcttcatgttagcaaatcaattctaggcaggccttcaggaaattgtgcctgtcatctcctgaaaacttctggaatgtttatgttctaaagatgactgatcaggcagtgatttttgtgagcaaaatcaactgtggctgtagactctttccaagaacacaacaccatttgatgcactgatggtggtccaaacaataaaagtgaaaacaaattaaaaaacaaataacagtattcacactatttggttggtaagaagaaaggcctgaggaaacagtcttgttcatttgaaaataacaagtcttgaaagttcagagctgagaccatgggcttggaagtgtttttttaaccatctcaataacgtgatacatttgagcaaagacttgaaggaggtggagaaatgagccatgtgaaatccaggggaagagcagaccaggaaaagggaagggccagtgcagaggccctaaggcagagtcactggagtcatggtggagcaagtgaaggagtcaacactgcaaacacaggggtcggggtgacagaagatgaggtcagggagaaaacagaagatatgcttcctggccgggtgcagtggctcacgcctgtaatcccagcactttgggaggccgaggtgggcggatcacttgaggtcaggagttcgagaccagcctgcccaacatggcaaaaccccatctctactaaaaatacaaaaaaattagccaggcatggtggcgggcacctgtaatcccagctactcaggaggctgaggcaggagaatcgcttgaatccgggaggcagaggttgcagtgagctgagatcacgccactgcactccagccagggcgacaagagtgaaactccatccaaaaaaaaaagatatgcttcttgactcctccttctgcccaacttcttatcccttataaaaaaccttgaaccctaagtaaaattttgccaaaattctcttgcctccatgcaactaaaggcaagcaaggttgtaccacctatgttgcctgatttgaggaagaaagcacaagtcatgccagtgcaaaattatcccatgccatgccatgattagtctcagaaacactaccccccagcagggtcttgggcagttttcctcattagcatgaccatttcatctgagggattatgcttggatacttggagccaggatgcaggcaggtaaatacagccattcaggagtgggacagcaaaggcagacctacctggaagcaggacccagagattgagcaagaacctgcgaaaggagggactgagtgctgggctgaggtcctggagcccagaagtggtcactagcaaattttgcttgagtagtaccaatatagtgattcctaagaagatggttggtggtcttagtgtgggtctttcatctcagtcattatattccatcactatttgggaacaaaataagagcaatattttttttaatgcaatttacttcccccacagcctgggaaatagggtgggaaggtatcacgtacatgtttatgatctggaactcattattctgagactttagcgtgcatcaaaatcattgcattgaagattcaaaatgttgatttctgggctccacctctactatctgcacttagagcaactactttagggaatcctgatgcaggtattccactgaaaactactgctgggaacagcagtgctccaagcaacgttcaatgttcttccttctcttattatcttaggaactcagtcaacgcatgagtctctgaagcctcagagggtacaatttcagtcccgaaattttcacaacattttgcaatggcagcctgggagggcacttactggcaacagcagtgtctattttgtgcagtacaaaatgtaagtaaattgagcctccttcagctgatagagatggcactgggataacatgttctagaatgcaatggagtgttaggatccgagctttttttcagtttcagaggggttgagaagaagccaaggtcaggataacagtgacttgtctcccctgaaggctgcctggggactcaaaatgcatgatggtatgcagtgcactgggcagatacttcagccctagacctgcaccaagacctcacaggctcagcctttgcctccatggaggagcctggcacatggtgggttctcaatatagatttgtcaggcgaatgttggaagcaacttattagcacatagcgagtactcagtgagtgaaactatcggtagttgaaaaagaagttgtggcaaacatggtggtgagtgtgtaaaataaggttttaatttaaaagtcactttcagagtggatttactatttagaaaattcctttcaaaaactaatgactctcgtaagcatgaacacaaactggaacacgctgctgcatgttcctctcgtgtgatcctcaggctactcctgctggatcattgccaaaactcagatataatctactcctttcctggctcaaggcttggaaacaaacactcttgacttgaaaatgtcaggtttttccactcatatatttctgggggggtgaggggggttgaggctcaatcctgtctcctgacagtgagacaggagatattacagtttagctttcatggtttttcaatagaaattcaggaaatcaaatgcagctatggccaaagtagcaatttttatcccataaattcatccatgtctctccagcatggggtaggtcctaggtcagattttcctgctaattaatttcggaaggaatatccccagaagcatctccatctttaaccgctacgacttctctctacatattttatgtagcgattgtaaaatgtacaaatctttacaatgaaggtttctccattacaaaagtagatttgtgcattgctggagatactttcagcatgcagaaagtaaagattggtactctttttatgcttcccctggagtagtataaataggtcaaaagtggacctatttgtggtccaaagtactaagaagattagaaactgttttaccatgaatctaatgaagattaaacttcaggaccccaatgcaaggattttatatttataaatcttttcctaaagaggactcccaagctgctatggtttgagtttgtctccaccaaaattcatgttgaaatttgatccttagtgtggtggtgttggaagtagggcctcgtaggaggtgtttgggtcatggggatggagcactcatgaatggcttggtaccattattgctgcagttgagtgagttctcactcttgcaagactgaatttgtcatggaaatgtttctatgagagtggttgttgtaaagccaggatgccccttgagtttggcctcttcacacgatctgttttccccattgaccttctctagcatgttctcatgcagcatgaaaagctctcaccagaagccaagtggatgctggcagcacatttcttgtaacttcccaggctgcagaacattggctaagtacacctcttttccttatcaattacctagcctcaggtgttctgttatagaaacattaaatggaccaagattgtataaatttcagaccccagaatacctgaatccattcctgtctctaagggattttcaacagcacaagacaaatttataattttgaaaactttcactttggtgtatccagttcatgggctataatactgttatatcccttgcgtttagaataggataaacaatgagatattattttaaaagagaagtctgtcattacagctaagttcaagacttattataaataaataataattttaaaacatcaaattatactcaatatatgttgtggttctgctttaattgtgatggaatgaaactgctgtcaccatgtagattaccgagtatagataccgtctatcttccttattatgtgtctagaaagctagatttcaagtctttcaataaatattttgggaaacctttctccccagactccaattccttctcttttccccaccatcactttgttacattggtctgatttatggcaggtaaggaaacaaagcgtgaatcttccctttgactattacaccatcctgtggcctcaggctgagtcaaccactctgcctcttgcctcactaccttttttcatgggattccctccccctctcccaacccctaattacagggctccatatatagtcctcaataaaagttcccgtcaattttcaataaagagattaatcatgtatgttgggtaggcaacacctgagatgaaaagtggtagcaacttctcagaagcagccacattactcaacagcaagctgatgagaagtggagaaaaaccacaaacagccaaaaccacagagcattaaggatgtggagagtgagtattcaaaaatggaagtcagtccacacaccagaaagaacattttgccaagtattaaaaaaaaggttaaaacccttatgttagtgatacagaaagcgtcagggatgtttatcttccagcaagacagcactttaggtaatgctgtggtttctatgtgtcccccaaaagttcatgtgttggaaacctgatccccagtgcagcaatgttgagaggtgggactttggggagatgattgggtcatgaggattctgcccccatgaatggattcatccattgatggattaacgaattaatgtgttattgaggaagtgggctagttatcaaaaaagttggtctgttttatatatattttatattttatatatatatgtatatatatgtatatgccatctctcttgaatccctgtgaagtcctctgtcaccttaagtctctgcagagagtccccaccagcaagaaggccctcaccagatgtggctcttatggctcttagacattagacttcctagcctccaaaactgtaagaaataaattccttttctttataaattacccagtctcgggtattcagttatagcaacagaaaatggactgaaacagttaataagaaggaatttttttaaagattctgaagaggagccataagctatcatggtggtattgctactagaatcaggtataaaaaattattagtctgaaaatactgaagactccttgagtggagaaaagaaactcagatctttgccttttccctgctacagatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaagtgagttccatggagtttctttgcccttgttcttcctgcttttggacagccctcccggagcacggctagtgactaggccttgtgctttgctgaggtctctacatcattatctcttttggtctaattgtcagaacaactctaggagatagcttttattatcctaattttctagtccagaacatcaagatgtagaggctttagtcattgctccaatctcgcaatctgtattatccaagtcagggttcaaatttgctatatctgactgcagagcctccactccatcaatttgtcaccttgtgtgtgtgtgtgtgtgtgtgtgtttgtgtgtgacagggtctcgctttgtcacccaggctggagtgcagtggcacgatcttggctcactgcaacctctgcatcccgggttcaagcgattctccggcctctgcctcccgagtagctaggattacaagtgtgtgccaccacccttggctaatttttgtatttttagtagagacggggtttcatcatattggccaggctggtttcaaactcctgacctcaggtgatctgccccctttggcctcccaaagtgctgggattatgggtgtgagccaccatgcccagcccctaaaaaagtatttttagacagcagaatttgtcatagtgcctagtccttccccaaacacgagggttaagttcatgaaaatactgattacaggaattttctgttgaggaaattaagacttttagtcacctccccaaaaaggcagaccaaaagtgctttctcagtatccatcctgaaggatatttattccttttttagtttagtcacaaccatagaataatataatctaagacataggtgttaaaattaaccattaccaacagacattggataaaatagtagagagagagagagaaggggtttaatgtatagatataaagatgtgcataaatagaacaagaaaaaaaaaagatatttaccacagtcctcataattgcaacaagtcaactagtcatgaagctgtagttaatatttatgacttcttccttcattataaactcaacattcactttctttccagccagcacttcagctctttatccacgaggagtttgagtccttttggtgtttcctgtctccgcttgacctaaccttacattaatttttatcactgaatagagaagctctaagaggcacaccagaggataccaagaattcttccacctgaccccattgtatttataactatattatgccttgaaaatcagaatgaatcaccctagacaatataagaacctcattttctttttgttagttaaatggcatgaggcgctccaaatggtcaggagagagcctcgacttccaatttttggaaaccatttttgttataaaccagaagaattcaaggccaagcatatgggaaacaaaaacatgtcataagttgttcactatgggtaacagtcagagttgcccctcccacttctacttcttgtatcctagaccagtgaattctgtctgtggaagaaatagcaccatatattggccctaggcttagtgaagcatttaccaattggagcatttaccaattcatatgccaattcacaagacgtctctcaaactgagttttcaattatccatttcaccttcctataaagtcatggatttctgagcgacaaatatatgatatatatttgtcctatgggtcttgagaccttgcttcactcctttcacattaacttaagttctttgtcataagcaatgtattgtggagtactatgctcatgaacaaggcattgactacatctatgggtgtatgtgtggtcccaggagtggttaggggtctgctaataaaagcattgaagcagtaaataaaaatctataaacaaaatctgtaaccagaatctatatccagcagtaaagaaaatctataaccaatgtctcttgccccctcccttttggaagggaacaaaaataaacctacctgcaacgagatggaagatgagagcccctggaatatggcactatactaggggttcaacattgatcttccttactggaaagttggacactctgcaggtcagaccaactttggtaagaggagatccatattgttaagtctatatatagcctccatcatgcaactattttgttcaagagcccatagagcaactacaggacactggggaaatagatggtcactgcatccacttagatttttttaaacagccttattgagatataattcacacagcctatactttaagcatatagcatacagtttaatggtttttactatattcacaaatatgtacaaccatcactcacagtcaattttagaacatttttatcacctcaaaaagcaactccataccctttggctatcaccttccagtctcaccattcccttagccctcagccccggcaactactaatctttctgtctctatagagttccctgttctagatagactaatataatacatgatttttttgactggcttctttcacttaacgtgttttcaaagttcattcagattgtagtatgtatcagtacttcattcttttttgtgaccaaataatacattatatggatataccacatattatttatcctttcttcagttgatagacatttgggtagtttccactttttggctattatgaataatgctactataaacagtcatgtaaaaatttttgagtgtgagtttttttgtttttttttcttgtttgtttttttgagagacaggatcctgctctgtcacctgggctggagcgcagtggcacaaacatagctcacttcagtcttgaacccctgggctccagcaatccttccacctcagcctcccaagtaccaaggactatcaggcatacgccaccacacatagctgggcatacctttatatttctcttcaatatatacataggagtggaattgctgggtctcatagtaactctatatttaatcatttgaggaaatgccagactactttcaaagcatctgcactattttacattcccatcagcaatatatgagagttttgatttttccacatttttaccaatcttttttgactatagccatcctaataggtataaaatggtaactcatgtggtttttatttgcatttacctgctaattaatgatgttgagcttctgttttatgcttattggctattttgtaccttccttggagaattgtccattgagatcctttgcccatttaaaaaatttaatcaaatctttttatttttgagttgtaagggttctttatatattctgcataccaatgccttatcagatatatgatcctcagctagctcctcccattctgtgagttgtctttttactttcttgatggtatcacttgacaccaagttttaaacttggatgaaatccaatttatttcttcttttgttgcttgtgcttttggtgtcatatctaagaatcctttgccaaatccaaaatcatgaagatttaccctatgttttctcctaagagttttatagttttatctctcacagttaagtctgattcattttgagttaatttttgtatgtggtgtgaggtaagggtccaatattattctttgacatatgactatccagctgtcccagcaccatttgttgaaaattatcccattgagagttcttggcacacttgttgaaaatcaatagaccatagacgtgtagtttatttccagactctcaattctattctattgagctatacattcatcattgtgcccataccacactattttgattattgttgctttgtagtaagctttgaaattgggaagggtgagccctcctctttattcatctttttcaagattgttttgactattatgggttccttgcaattctctaaccacccagattttttaagaccacttttcagtatgagccttttgctttgcattcatatggccacagaaatattcacattctgtatcttagtacttagggatccatccatacacctcttctaactggtgcaaggtccagtgagatccaaattaattagatactgtccaaaatgctagatgcattttcccccaactctctaattagcaggagggtggaatagagttgagcaaactaattcatggtaactcttggttgtctcttggatacattgaaattcaaagccaatatactcaacaagcaattctctagtagaggaaaaggagatttcatgactaaactgatgaacaccagtgaagggaattcacagatcagtgtgattattatattcaagcctagaaatagggtcacattcaaatttacttatcaaacaaagtttccttcagtctaagccattaggccagtcaggtaagaatagccaaagacattgactgacacagctttagctcaattctatttaaattgggatagtgttgagttaagaagggtttgtgtgttttctgtatgacctttctccctaaaaaaaaaaaaaaaaaaaaaaaaatcagaaaagaaaagaaaagaaaaaagctttagaccaggtcctttaaaaagccattttatttcggggcctcttagtagaagaataagaaacccagtctatagctactactcttgttgatgcaatagtgagaagaatcacccactcagctgcctcctcacccccaggcttgcgctctcccaccacagctcctaagaacttctgaagaacatatttcaaaaaagcacgtttctagttcctcaagacagcatgtttgtggcatctgtgatatagactaatgagccagctgcatgcattgcctcctctgacacctgtttttgagcagcaggatgttatcttagattaagaagttctgatttatggtgtctatctagagacaaagcaagattttaaaaataaaataaaacaaagtaaactttcttcagttaaaagcagcgtttgatacttagcgagatttcagtattatttgaccctagaattacttggattaaaaatagatgtgaaggccaggtgtgttggctccatgcctgtaatcccagcactttgggaggccgaggtaggaggatcacttgaggcaaagaatagagcatttcaagcaagggaccagcatttgcaaaggccctctggcatagcaaactcaagggactgaaagataaccaatatattgaagaagagcatgcaggaaggagtccataatgagatgggactggaaaggtaggcaggtacaagaattttttaaggagttgtgacttcctccagaaaaacataattttatttaggagccatatgatcagacttgtgtatagaaaagatcattttgactatattttggggaacaggttggatgcagataagtgaagtagcaggttactaataatagtctacaggagaccgaatttggcttatgaaaaggactagagaaaatttattcctggagggacatttagtaagcaacattggcaggaccaggtgatagatcggatataatggtgaagaggacatgtcaaagatgacctctaagtttcttgcatgcataattagatgaattgctgagatctttttgatggggtttgatgaaaaagaccagtttggtgggatgcaaggtaatagagattatgagtttggttttgaatatgttaagcttaatatgcttttaagagatccaggggacatatctcttcagatccaagactcaaagtaaagtctttattagagacaaaaatttgtgagtcatttcatgcatacagtacagtggacattgataggattgcctagggagagagtagtgagtgagaggcagttttgagtaagaccagatattgagggactttcacccaaagatgcctgagtaagaaaaatcttaaaaggagactgagaaggaatagccaaagaggtaggaggaaatctgtgggctgatatgttcatgaatagtgcgggaaggtaatatttcaaggagagagctgttaaagagtaaagtgctatgaggtcaaataatcttgacttggtcttgtaacacaatcacaatccagtgaatgggtcaagaaacttgcaactgattgcaaaactgattttgcaatcaattgcaaaatctagcatcacagatcataagccaggagccctgtgatgtccgcagctgactcactgataggacaatgcctgaaatatgtgcctcactacaaaagggacatgtttatttaaagttaactatcccattattccaatatagttggaaagtgctttaaaaacttatggttccaaattaaatagcctgggagtaggaaactctcttcttctaaaacacttagaaattctggataaaacacattctccaaactccacagaggggcaaaaataaaaataaagggaatccttgggggccaaaacaaagtaaacggaaatcaaaggggaaccagaagaccaacacagtgactgccccagctgccctgaaggcatttgctggatgtggtaactagaccctaagtggtaacagccactcccaggacaaaagacaaggttttaggccagcacaaggcagggagttagaactaatacccctacaaaagtcttagaacctccaagggctacactgtcaataaaaagtcagactagcctggatgtggtggcatgcacctgtaatctcagctactcaggaagctgaaggagaatcacttgagtacaggagtttgagcccagcctgggcaacataatgagatcctgtctcaaaaaaaaacccaaaaccaaccaaccaaacaaacaaacaaaagtcagattaagaaaagcccttccaataaacagaggaaagtaatttgtatgtttccatctttattctgctaagaatctaacactccctacatttataaaggttcgagattcaaatacatatgcaattttcttttttatttttgttttttgacatgggtttcactatgccacacaagctatagtgcagtggcatgatcatagctcactgcagcctcggcctccctgggctcaggtgatcctcccaccatgctgatttgtcattatacataatgcgtctgtatataatacattcctttgatgatttgtcaaatttttatgttttttcttcagcaaaaatagatcctccagtcatgaatataacccaagtcaatggctctttgttggtaattctccatgctccaaatttaccatatagataccaaaaggaaaaaaatgtatctatagaagattactatgaactactataccgagtttttataattaacaattcactagaaaaggtaagttcagatgaatagatatatttagagtttttttcttttgtttatttaaccaatattgtggtcatatgagatgtcctcttctgctactctgcctcctcttacttttccttatctttaatttcttcttactctcagccatcattgatcaacggttggtggtggcatcaccatcagaatgtgtgtgtgccctttccatcctccggtttgtctctacagtcttccctgcatatctaaagattggtattaaccgtatttaattgcatgtgactgccacaaatattcatttttacgggctttgcacaccttatttatttatttatttatttatttatttatttatttattatgtattttatttttagaccaggtgtcactctgtcacccaggctggagtacagtggtgatcatagctcactgtagcctctaacttctgggcttaagtggtcctccttcttcagcctcctgagtagctgggactagaagcatgcccatcacatccagcttttttttttttttttttttttttttttttgtagaggcaaggtctcactatgttgcccaggctggtctcaaactcctggcctcaaccaatcctccagccttggcctcccaaagtgctgggattgcaggcataagccacctccccggcctcacaccttattttaaaatagcttttgaatcacatgattatttttgtgccagttttgctgcgattttttttttgagacagggtctgactctgtcacccaggctggggtgcagcagtgcaatcacagctcacggcagcctcaacatcctgggctcaaatgatcctcccacctcagcctcccaagtagctgggactacaggtgcatgccaccatgcccagctatgtttttttgtacttttagtagggacaggctctggccatgttgcccgggctggtcttaaactcctgggatcaactgatctgcctgccttggcctcccaaactgctggcattacaaacatgagccaccaggcctggccttgcagtggtattctaatccaccatcggtgcttctgtctggatttggtggataattgaatttgttccttttttggtgccatctaagatgaggggtttttgtcgtaaggagcagaaaccacagtttaacttgtttagaaacaaaagaggaggggagggataattaggagataggcaagcaatctcagggacagaggcaggacgtagagtgccggcagccttagtggtgactgggaagggaaacggaagtgagttctaagggatcctgctctgtctctcagactttctgtctctatgtggccacagtttcatgcctgcagttatctctgctcatctcgctgcacatcattctcactgcacacttcaaattcttaaaaagaaggccaggtggggtggttcatgcctgtaatcccagcactttgggaggctgaggcaggcaaatcatttgaggtcaggagttcaagacctgcctggtcaacatggtgaaactccatctctactgaaaatacaaaaattagccaggcgtggtggtatgcgtctgcaatcccagctactcaggaggctgaggcacgagaatctcttgaacctgagaggcagaggttgcagtgagccgagatggtgacactgcactccaggctggatgatggagtgaaactgtatctcaaaaaacaaacaaaattcttaaaaacaagactctgaccatggggtcaaccagccaacagccctcaaggagaagtcaagttgcacctacacagccacttgccttgtccctttaccaggctatggcctaggactctagaaaagaaggatgtgtctgggaagaaaccccacaacccatctactgctgtgaccatgtacaacttgttaatttaaacaaaaatgcagctgtgacttaatggcagccatttaccaactgattattttctctctcgtgtgtaggagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctgtttttgcttttgtgcttaggcaagtgcaaaatactctatggaaatcataattgtcatcttcttcatggtgttagggatatattgtcacatgatttcaataaatcctttttttgcttta

SEQ ID NO: 61 - DNA, 754 bp, Homo sapiens
  misc_feature (739)..(739): n is a, c, g, or t
cacaaggtcaggagatcgacccaccctggctaacacggtgaaaccccgtctctactaaaaatacaaaaaattagccgggcgtggtggcagacacctgtagtcccacctactcgggaggctgaggcaggaaaatggcatgtacccgggaggcggagttgcagtgagccgagatggcgccactgcaccccagcctgggtgacagagtgagactccatctccaaaaaaaagaaaaaaagaaaagaaagatccctggagtatgagtcaggaaacacaggttctgctcccactctaccatccttctggcaccgtgaccttgggcaagtcatcatctctgagtcggattttctaacattctgtgactatgcagaatcacaggatgggaggaggcatgccttagttagttcatggggtcgctatgtaataaatgtttgattatgtattggtgacctcattcatgcattcatcagatatgccagggatcacagcaggcatgaagatacaaagtgaaatgagaccagtccctgcccatgaacaggcagcatgacaacatgatggacagagcacggattttctgagggatacagccaggtcccacccctaattagcttcttgagctcagctaagttcttaaaacttctctgagccttgattttctcatctgcatgatggattattttataggttgaccactcgtcctggtttgcctgagactgaagggcatcctgggacacagaacttncagtgctaaaaccca

SEQ ID NO: 62 - DNA, 42300 bp, Homo sapiens
ggaggcgggcggtgggggcgcgggccgggtggccgcgcatgcgtgcggcccccgctcccccggggcttccccggcctcgtgcgtgcgcacgcgcgctgtcccccggaggcgtctgggtgtgcggagcgcgcgcgcgcgcggctcggaggcgcacctgtgaggtgtccctgaggagagggaggtgggtgcgcggcgcccgcggcctggggcgctgactcccctcacttggagtgagttctcggcggccgggctgcagtctttctttctttcccggagggaggcgggggccgggggccagggagcgggctgggggtgggaaggaggtggagtggcttaaagaaaagaaaaacaacccatcccggaggatgggcctcgggatggcggggaaggtcagagcggctccgcgcagcctggcgggtcccgggctgagaagccgcccctcgggcctcgggcggtcggccgcgggcccgcagtgcgggggagcggggccggggggcgcagatggcggccggtgcgagcgagggctgggcagcgggcagggcgaggccgggcgaggcccctcgggagccggactcccgagccaggctccattgttgttggagccgagggaagggggagcgctgccgccctcgtcgcccgtggagccgcgtcttggagcccttccaggcgggtcccgggagaggcggtcatggccgcgccaggggaccggggagccgggcggctgcggaggagccggctgcatggggtgctgtgtgtttttcagggcgccctgcgtccggcagaggaggcgagcatcccgctcaggtgatgaggaacccctcgcgcacccagcgcagaaggctgctgccgccggacgcctccattgtttgaccacaacaagggccggattctcacccaggtaaaccggctgccggcgctgtccacttccctctgactcccgcctccgcaggcgttctcaccccttccaggactcgactgcagttttctcactgtccccggcttctcatgaactccgtataccccctcccagacattttcccgtccggatccatctctccgccacatcacctctcatttcccccagaactcagctcctttgtgaaacctttcttgccgaactctaacaactaaatctccccgggagcctgctccgaactgaactgttctggttgctagattgcttacgggctgtcttattgcaacaaaggagaccagataccgaaaaaagatttctgagctattgccttcttcaaggaacgttttctgatatttacagtttattgttttcacaggctggaacggtttttaggcattttggcttcttatttagagagggctcctatttccttcatagacgcatagttttttagagcaggaaattgaccttgttcaacccgcaggttaattaaaaatttaaaaattaattctaaattagcagagtagtacattttctttgtaaaaacagcatatcacagagatggcattttgtctttgactatcaacctctgtcttcagggatgccgactattatgtgtgtggtgtttatccttctagatcttttggagtacttttacgtgtgtgcacttaacatcatttttgactgctttaacaaggactgttgcaccgtaactttcaatgttagcatgtaatgcttcaagtcattttttaacaactgctgcaccatgttccatagtttcagtatatcatggtttagccatttcccaaattgatagcagtttaagttttaactttaaaacagcttttttgctggtggtggttctctgatgagatgaaatttcggtgataggagcacagatctacgctaattatcgagattcggcatttatgatgaagttctcttttggttaagaaattgatatgtggaagcagccacccctcccctatggtagttctgactctagcagttagaagttgtgtgaccttggggaggacattgaatcacaccaaacctcggttttcttttctgtaaatggcctgctctgtctgctccatagagttcagtgatacagtgcgtatgtgttgtggaatgtaaagtagtatatataaaggttggttttattagcctttgtgatccaaaaattatttgcaatatcatttatattttttgaccagatgtgtgtgtatcatatcacagagcactacagatagtcaactttgaatgctttttaatttgtgactttttaaattaatttttatcaagtactgacaatacattagtcttcttaacaatattttgcaaagcattttttcctagggctttcttttcttcctcttcattaaaaaaaaaaaaaaagagagagagatagggtctctttctgttgccgtggctggagtgtagtggcatgattctagttcactgcagcctgggactcctgggctcaagtgatccttgtgcctcagcctccccagtagttaggaatgactacaaccatgtgccaccacacctggctgatttattttatttttgtaatgacaggctcttactatcttgccccaactggtctcaaactcctggcctaaagcagtcctcccaaagtgttgggattacaggtgtgagccactgtgcccagcccctagtggttttacataccttaaaaaataaggcatataaattagttgactgtgaataaacatattagcaaactgaacactagacaatactcgcactataatatttaagcttatttccttagagttgtaagttgtacatgtatttttctgtggcagcagcagattcagattagcttttatgtccttcagggaaaagggattgttactaaatttgcaggctgcatcagagttttaatattgagatttaatattttaatcatttgaataatgattgaatgatgtgatgggtaacattttaagatgtatgagatacgattaggggctttttatgtatttttctttctttcagatatatatgagtgcctgtagtgtggccagcaaaatcaacttattttgttctcttgaagcttatgatttgtgagggggattggaatttaaacacaatcacaactacacgtatgatcacaaactggtatctgctgtgaaagttaagaagcacctgctatgagggagtataaaaaaggggagaccaaattttagagtggagagaaggggcctaggaaagacttttctgtataaataagatttaagctgagatttgaagagtgcgtaggtgttagtgtggaggaaagtgggggataattttccaggcagaggaacagcatgtgggaaggcctcaaagtggggaaaaagctttgcccattccaggaactgaaagaatgaatgtggatagactatggaggtgaaggggaagagtggctaggccaggggccagatcaagtagggtcatgtagggcaggttaaagtggttgtattttatcccgagtgaaatgggaaaccatgatatgggttgggatttacgaagaggagtgacataatcagatttgtatctttaaacagccactctagtcgttgcatgcaagatgtgggggcgtgttgggggtggagagtagaagtggggagaccaggttggccatctcagagggctgcctggaagagacgtgagctttcccttggaattcacattgacctcacgttaccagctacactaaggtcaaatcaatgtttgattaaaaaaaaaaaagatcctggccatgcacagtggctcacacctgtaatcccagcactttgggaggcaggtggatcatgaggtcaggagaccgagaccatcctggctaacacggtgaaaccctgtctctactaaaaatacaaaaaattagctgggcgtggtggcaggcacccgtattcccagctactcgggaggctgaggcaggagaatggcgtgaacccgggaggtggagcttgcagtgagcggagatcatgccactgcactccagcctgggcaacagagggagactgtctcacaaaacaaacaaaacccccacaaatccttgtttctaatttttaagaagtggggataaataaaagcaataaaaaggtacttggtatgcaaaaagtacacataaatgttaaactagttgtctatacttaaaagtatcagagagtcaaattaaaaattgggacattatttaacaaggtttgtatgttttgacaaagcggtaatatgtgagataggagtgaagtgaggctctaaaatgaagggaaatatttgtagatgctattgactatgaaaacaataacaaaaattattagacaaaaaaattgatggagtgaccatgtattagtatatgtataaaattaatagctttctgaataccagaaataacctactagaacctaaaatggccaaaaaaaaaaaaaaaaaaccctaaacaagaaactggctctgaccaggttgcagcaaaacaagtgaaccgtgtaggcacaaccttatagagtcaagtgtgcactctgtggaggagaccataaagtatcctgaaaggtctgaaggggtaccttgaacggaaagagaggccatcttccgggctgtgatgtctgcatgttatggagatgctcattttggggtgaacgtggtagaatacttatgagtaatgaggtgagacaaatatatttaaacatattatagagccacattcattaaaacagtatcgttctggctgtaaaatatccatacaggtcaatggaacttattcagcaccccagaaataaacttttttatatggaaatgtcataaataataatgaaatcatcacaaatgccccctgagtctaaagaaaatgtaagtaaatattaaacatctggaaagaggagttttacatgctaaggtggatggagcacatgctttagactcagatgtgtctaaactggaatcttttaagtgaggaaaattatccccactttgcaggtgttatgagagtaagagataaagggccaggcacctacagggcactcaaatctgtaagtagctgctgctattagaaacaatagagaaaataataattaaaaattagtgtattagactacataaaaatttattctttaggaagagaagggaaaaaaaaaacccgaatcataaagtggaaaatatttgtggcaaatgataagctaagagttagtattttcaatatgcaaagaactcatccaaattggtgaagaaaataatgaagatccacacacaggtggttataggatgtgaatagacagttcgctggatagaaatataacttgtgaaacattggaaaagctgtgtaattcattaataatcaaatcactaattaccgtatagaaaagttagattctgttctgaatagcagcaaaactagaaaacatttacaagtaagacataaatgtaccaaagctttatgaagagaagtaaaaacttttacctaaatgatttaaaagctaacctaaataaatgggcagacttgttcctggaggggaaggcatcattgtagattgcagtacctccaaattaaactatgatttcaatgtaattacaattgaaatcccagtgggaattcttctggacactagataaattgcttctaaaactcttttataggagtaaatgtcctagaatggccaaaaaatgacaaacgtttttaatggaaaagtagtgttgggggatttgctatatgagaagtcaaagcatactgaaatgctgcagtaatataaatggtgaacacaagaatagacagattgacgcctggagcaaagtagaatccagtaacagacccatttttatatcagaatttagtatatgataaagttggtgttttgcaacagttgggaaattataattcagtgtgttgtatagggataagtggctctttatttagaaagaaagatcctacttcacattcaaaataacttagatggattaaggaactaactaaaaaaacctataaaagcattagaaggaaatataagagaatttgttatgtagaaggatacactggaaatgatgtgttttaggtaggccatttaggtaagaccaagacctaaaatcataaatgaaaggattgataaatttgactataatcacagttgataattctgtgacaaaaagcgttacagagtgacagactgggaaaacaacctgtagcatgtataaagaataaatagaattaacaaattaggtaatgaattgaggatatgaatagttcttagataaatgtgttcaaacagtgaagagaaattcaacctcattgtgattaagagaatggaaatttaaaaactagatttttttgttgggaggagggcatcaggcaaaaattaaaaactatccagcgatgtaaaagaggcacctaatacattgttgggacataaaatttttccaagtttttagatggcaattttggcagaattttatcaaaataaaagtacacgttgatttagcagctacacttcaaggaatctgtgctattttcataggagaacatacgttaatataaacaatgtctattgcagcgtcatttataatgaaaaattgaagataatcacaataaattttggtacccatatactgtggaatatcaagtagcgttttgttttttgtgggattttttgtttgttttgttttgagacagggtcttgctctgttgcctaggctggagtgcagtggtacggaatgtggttcagtgtagcctcagcctcctgggctcaagtgatctgcctcagcctctcaagtagctgggaccacacacacacacacacaccactacacctggctgatttttaaattttttttgtagagacggagtctcaccacgttacccaggccagtcttgaactcctggcctcaagtgatcctcccgccttggcctcccaaagtgttgggattacaggcatgagccaccatgtctagcctattagttttttatatagagaggtagatttgtatgtactgacatagcctgtatggatgtctagaatatactgttgagccaaaaaagcaagcttaatctcattttttgtaagatacaaaacaaaataatgaagggtgagtgtgtgtatatatatatattctgaataagaattagaaaaagactagaatacctgaaaacatttaattctgattacttcatgggaaaagcctaggggagactggtttttcatatcacatgtgtttgcattgcttcagttttttttacaatgggcatttacttttgtaaggaagatgttacaatttctcaccaatttcatgaaggtctagatttagacaaaaatatacagtgcctagtacctaaaaggatgtggtaaaaatgacacactcttatgttacattggccatatgtgtcaagagtcttaaaattatttacatttcttgatggtctaggaaccatcaaaagaatatttttaaatacagagaaaagctttctgcacaaaatatgtatattgtagaattatatttatgggcacagtttgcagaatggttatgatacatcccctatatcatatatttagtggcaaataacattgccattaaaaacgtttatgaagaaaatatattaaaatgcttatgatagtgttaagtggaaggaaatcaggatacacaattgtatacctgatatgatgaaaacgccccaaaaaaagtcccagcagccttccagtaaaacctatgaatggcaaaaatatgtagaagaaattagatggaaatcttaagaattgtggaattcggtaggatgtcgggtgatttaaataatcttttttgtatttgccaagattacatgtacctgtattacatgtatgatggaacatttgatttaacaaagtatatctgggacatgatagctacatggcaaatagacatgagcacttttttttttggttaaagccaatgaataaatttggaatttacactgaaaatgattgggacccattgaaaacttgtgagtagggtaagaacaatccattttgcattttagaaggttacattagagtagataatggattagagggaagcaagactggaggcttttgtagaattccagggaagatgatggtggcttgagttaagttgagacaatgcaggtacacagtggagagtttccagaggtatttggaagagagtggctagacctttgtgatggggggaagtcaatgatattgacttgggcaattgaggggagagtggactcatttactatagttgggaattggctatggtttgaatatttgtcccctccaaaactcatgttgaaacttaatccccaatgtgacagtgttgagaggtggggcctttcagaggtttggctcatgagggcagagccattcatagattaatgggttgtcatgggaggggacctgggggctttataaaaagaaaagagatctgagacagcatgttaacatgctcagccccctctcatcgtgtgatgccctgtgccggctcagggctctttggagagtccccaccagcaggagagctgtcaccagatgtggtcctgggctttttcagcctccataactgtaagagataaatttcttcataaattatccagtttcaggtattctcttgtaagcaatagaaaacagattaagacaggaatatagtaggctttggtgaggaagtgactgattcagttttggatgtacttgagtttgaaggtcttataggacacataggtgtgtcacgaagaggatttacaaagaataattttacagtacacatgttttgctgtaagaatgactagatactatacatagctatggtattaaaatcaatatttctacatggtaaatttttcttgcaatatagttgtacttctgtaaattggggcatatctgtctagatagactggaccattgatatttttcacatagaattatttgagactgcatgacctcgacttcagataataccatgattgtctttggggttcattgggtagactcttgcctctctgagtgggtggtggaggttcctctgggcattagtggtccttttgtcagtcatcctgttgtcagagtacacctgacttctgggagtgatttctcttcatcttggtaaactggtcccttccacgtaggggcaggccaggaaataggcagagtggtgccctttcatccatgtgtgagtgcccacctggctgttaatagtatggctggagcatgggtaccttgaaggacaagtggagaaaaggtagcggagaaagtgcctgccaaggtaacagaagtcattagagaggaaggtagatgtcttcatcagaggttggggcccagtcgctgggaagttggtggcagtcagtgtggctgtgctctttgccttcatctcccaggcttctcctgctcactgtgtgtctgccctatgcttctatgtgtgcctgccctccccctaatctcttctctcgcttggcagtaaataacacgtgaccccaggtggtcactctggaaggccattctgaaactctaacttctgccagctcacatcacagacccagtctttccacttcccacttcccaattccaaattctctagaaggacaatctgattggcttagcttgggttccacgctcaccgtatcggttttactgttgcagcgcttacaggagcagattcatttagtgtgagcctggtggactggctagaagggagtgcagacgaggacactcaggagagacgtcctggaagttagaaagtttcaagaatggacaggagcagtagtttcaaacggcctagagatgtaataaagggatcaggagtgaatcttagatttagcaaattgaagtctttcagcccaggttgaaagttgtgtctactgggcatggtggctcatgcctgtaatcccagcactttgaggggccaaggcaggcagatggcttgaggctgggagtttgagaccagcctgggcaacatggcaaaaccccgtctctaccaaaaatacaaaaattagccaggcatggtggcacacacctgtggttccagctacttaagaggctgaggtgggagcatcactggaaggcagggctgtagtgagccatgatcacgccactgtactccagcctgggtgacagagcgagaccctgtctcaaaaaaataaaaaaagaaagcaagcaagttgtgctacagctaatccatgtgggagagtcacaaggtggaaccaatggctatgattactcatttgtaagacactgaaagaagagaatttttaaaatacaatttaattttgaagatgtagcagaagcattcaaaatgtaattttaaaaatataattcgtattgctttttaacgctaaaacatttctacacctttattctgattctgaaatacacagtgtctcttgtgtcacttgatacattataagaaattcagtaaagctattctagaactcatttatttttcatacccctgaaagttcataaaataatcataggttatttccatatcttattttgcagtgtgttctatgatattgtgacagagcttgtgaggaagcctttatagccagagcagacccctgtcccaaagatgatgaactctgccacttaggttaacaatacaacagttcatagaaataattggaaccatttttcttctgcagagtaaatcctgtatgtccctctggctttcaaaatatcacttttggatgtgtagttcaaatatgtttaggattgagcctgatgggggtttaagaatatttcattgattcaaagtactcggtgttggctagaaaacatgtcaagtttctcagttaaccgatgttcaataaattacttttaatactataactttacattgtgataggactaggaccttgtggtaagcctccagactcacagttagaatcagagaacctgcacaaagcgggttgcatgcattttcatgatgcttggcaactagaggtagtaacccattgtgacattgatttcaagtcctaactccttagtgtgaagagccgaggtttctgagcaggtgtttgagtgccctctggaggccttgtgaacagttgaaatgtggactcctagcaaagctttctttcacagccagagttgagaaccagtgggcgagatggttgaaactggtgtggatgttaggagcagaggagaggggagatggaactcatgggaatgaactagtgtttacaagagcttgcccggccaactgataatactgggtttatgcagtgagtgtagaacacagaggccgtagggtcacagaaggagccaagggagtgtggccagtaatgtccagtgggataaagaacaaaaagtgcccttggattggccaagagaaggccgacaatgagagaggaacctcggtggtgtggtgttggattgaggcatgagtgggaagtgaagcaatagaaatctggaaaaatcagtctttaagaggtctggatggggaaatggagggtggggccagggagacagggtagctagagaaggcctgggattaaatgctgtttttccttaaggttgggggagacttctgcattgtgtttaaatgctgaagggaagaaacaagcacagaaagaaaacagttgaaaggggtgtgggggccggggaggaggagagagttggtttcaaagttctttgcctgggagatctgttgagggaagaagttgccttttatagggactttgagtttgtcaaagtagtgattttcagtttatcgtgggatgatggggaaataattctagtaggcagttggagatacaggtaagaagaaaagactgtgttaagaaactgtggcatcatcatcatggaaatggtcatcattccagccaagcaggtagttgagctaaaaaatggagacaggacatactgtatggaggactcctatatttaggcataggcatgtgagatggcagacacaatcagcaaggccagaggaaaagtgagaatgtgcagggaactgggagccgaggagaccgtagactaggattcagggtgaggcaggaggaacggccccaagatttgactctgagagcagttttgtagtgggggtgggggtacagaatggtgtgtgggaggtgcacacagaaggtattatagatgctgtggaggagctcagtagtgaaagtgagaagagtgaattggtcttagtcgggggatggctccagagaacacatgtcacttatctgtgcatatgaaattagagctgtaatcaacaatgactctagaaaggattatttttgcttttttgtttttaacaccatcatctcagaatataagatctaagtttcatgtaacttttgtgccacttcctactcttctcagattgagaatctgaccagaaggaagaaaatgtctaggtctattcatgacatttgagggagttcttgcaggagagagtaaatgtgactgatttttgatttactattctgacacacgtcaaatgttaaatcctttaaatctatgagaccatttgctatcataaatgacattttaaaaaacttcttggtaaaactaatagtatggctaatagaagttatttggcttcacttatttaaaatatttcgttaagaaaagataacagattcctaatatcagaagtggtaaaataactgtgtttaaatctgggaggtgggatttgacctctcactttagactgagtgcccagtttgagcggccaggcgtacagtttaagcatacacttatccaaggggtggaatggcaggttccagcttaggcccaaacacgtccgctgctgtgggactggtgcgaagatctgtgaaggccttaagccattaaacttttggaggcctttactatgtcatatcaaacattaaatcacccatgtcccacataaaattagcttgtacaaaaccatatgagttaagctttgattggctatagacatttaacatttattaactttaattttgcaattttcttttcatgttttgcatccagtaatgttttttttcagatctgaaacatttacataggtcttcgagatgctcatgagccttagggactgtgcctatatacctagagataagacatcccagttctgctgggaagtggacattgggtatgtctaggcatgtctggcggggggctggagggggtgggcttgcccagaatctgtttgtttgtggcactgaggcacctcctgggaaaacttcatcttaagggggagttgaaggaagtgttttagttagggattttttgttgcaaagaacagagtttcattcagaccactttctgtacaaggggctatattggaggatgcatgtggatcagacccatgaggaactcaggctgtccagagacaagccacagtcttcccatggacagtgaggtctctcacggcatcactcatttctttgtgtctttctcctcttgctgccatctggcttgtttttccctcctctgtatgtcttttctaaccttttagctcctccttgcttatagattctacttcctcatgagtttggtttgctgtgatttgatgacctccgcagtcattttgcggatcataacctctcagcttcatctctcacagctgataacctcattctctcagtattgcttagattcctgagagagagggaatctgattttgttttgcttttattgttgttccaagccacatcatatgtcagagttaagctcttgggtcagatgtctgcacttggtctcagaagtggtcatgtggccgatggctgcctgggcctacccttaaagctgaagcagttcccattagtaggatttgtaggctagcaggcaccatgattggcatgtatagttcagtaagggaggaaaaaacctggcccaatatcaagaccacttgaaattcctccaaatgtattcctgccctttaaaatattatcctgctaacagctttcattctaagttgaacctttattcccacagagaaactaaaatagctaaatgtgttgaaagcattttcacttttccattttcttcctgttttattcagtctctgacagtgcagggccactcagcatagtctacaggactctatttctaatgttagtgatttctgctgaaaatgatatagcaacttcagatagctattagcaagatggatcattctaaccacatgcctttcacataatcctttcccccaaagctctggggagctgtagaggcatactgtaatccagcactgtccccagattgacaacagctagaaaaacatgtaaatgtcccatccacatgtagatacggcagcagtgtgaacctaagttccttaatatatcataactcccaggggaaagtgaagttccccaaacttaaagctagatcttgagatctatacctaaacttctctgaacaattatagaatatagcagaggcggggaggtagtagatggaataaataaaataatgataatgatagctttgttgagcccttgaaatttgccaggcagtgttttaagtacttctcatggattaattgatttaatccttaaattaccttatcagatcagctgcctttattatctccattaactcattcttaacctcctaggtgaaggttacacagcaggtatgcagtagggccaggacatgaactcacccagtctgactccagtttgtgcttcttcagtaccctgagagactggaaaatccgtgaaaaaacactattgattgtttattccctggcattttagccagtctgagtcagttatcttatacctatgaaccttaaactcattttggatctggttcccatcacgaggctaattgtgataatgggatacctatatcttggagggaagttgtgcagagtgcctggattttcctttctgtggtttctcagatttgctcatcccttctttggacctccatgccttgaatcccatatatttatataaatcccagatgtaaataggtctgtcctatcttctgagctgggaccccacgtttatagtagctagttcatgaaaacattttgtgatcctaaattctctataaataaacccatttttctctttgcatttctcccatccagcaggatcctaaggcctttgtagtccttcagccactgtgggccctgcctctgcctgttcttctggaatgtcttgggggttttgatcctgtcactgtggtaagttttccccttgtttcaccatttgtcctagatggagaatcccccttgagtattttaagccaaagctgtctctagaattttttctgagcatgtgccctttgggctcagtgaggaagcagctctccgtgcacgctcttcctgacctctcgcctttatctggcattggattccccagatcttggaccaccttccttactctaaagatgtcagaaacatttttgtccaactctttttgttccctgggatcttcattttcttctttccatgtgaaccattggttattaaaactttgtttcagttgtcccattttcttctgccatcttggaggccttacatggattctagatctcatgccaccctttgtctttttcttctgttgttcctatcctcaccgagctatcaaaactttttaaaagctcggttgctttgtaaatttctggtgttttttttttccccaacgtctgaataatagctttttccttaaatatgagttcctgaaaatcttcttacctgaggattatggtttcacattgatctgtgcagacttgattctgagtgtcattgtgttcccagcacaactatttttttactttgttttctctttggatttgttcttttttaaagatttttttttcccttctttggctcaactcaagaaggcaacatatataggacaggtatttgtttatctttatttggtcattgctgaaatccagaatactccagttgagcatacagtctagatctctgtgattcacagacatcatgaaattgtatgttatttccatgcatagctgggcaggaagagaaaggaaagcccttgtcttgatagctgctggcttctgggggcatgagcttcttgtcatttcccctgctgccagaggctggtttctcaggccctgggcttctgccttcccagacttcactttcccatgcaacaaggaggattggctgtgggaggtaaaggatattgtgttggcctctgtcctagtgggtctagtgactgtgcgttgttagaaggctaagcctatgtagatgtgtgatgtcttttctttttcctggctgtatgtggctagagtggtaaggctggggctgcccctgaacggaaaggtcttgaccacctctcttccttttctctcttttcccatgtgctggattggtttccaggtgactgacctatttagaagtgggggcaagtggaccctggcacaagggcaaatgttctctcttctctctctctttctggctgcattatctcctgtgctgatttgggtaacctcggccagtctttatcgtgagtggtaagaccaaagagtcatgtctaatattttatgaattccttttcattcccgtatgcgctttggtcccagtttaagattgccactaatgtagggaaaaggagttctccatgtgatccagcctaccttatggaatgctgcattggaaattggattcacaggcccagctaataatgaagtgttctgtattttcagttcagtcctgtgtacatgtccatctagggtacctagaagttaggggtgtttgctgagcccactggccagatttgctattagccattaataacatacattttcagaacagtactggatcaacctccagtgccagtcctacaagatcaaaagcctgaaggccagagttctgcataatttgttgtgaccattccctggccctctctgagagtatagtggcaataaatttctgtccatccatgcagatactgaattctattcttaggattctcatcatctctgttgatttttggctgtaagaggtcacctgctcttgcactttgtgcttcctgaatgagcctactcaaaaatctctctcccttgcttgctttggtttgccagacaatacatgttacgaattgtgacccaggtataaaaatagccagactcttgatgtacttaagaatagtcacattcatggagtcaagaaagtagaatggtggttactggggctgggggagaggtaaaaggggagttgttattgaatggggacagagtttgtgttgcaagatgaaaaagctctggagatctgtttcacaacagtgtgtatatatgtaacactactgaactgtgcacttaaaatggttaagatggtagattttatgttatgtgtttttttaccacaatttttaaaaatgcatacaaatgtcagaatcacaaatccataacttttgaccccctaactactgttgctactcctactgccagcatcattgagggcagtcttgctaattacccacttttcattttacctgttctccagggcccaacctgtcttccttcttttagttggctaggctggggcccctgtgaccttcaggtgttccttatacctcttcctgagggtggcttgagctttccggtctgttcttcttttcttctgggcctgagcatgaattttgtctctttaggtcttactaccacagtggaaggaggaaacaagtttagtaaatgagcactagagctaacctgaactaaacctctgtgcttccttttgtgttccctcccccagctagttcctgcctgacctcagatcagaaagaatcccctggccagttgtgaaagactggtcccttgagggagacaaatccagtagtcagccaaagggaaggataaggaagaggcagagtgcaggaaagtgggttttcttatgttctgttgttctttctgtgcgttgactctctctaggtatcctaattgtatcctgaggaaatcgtatttttttctgttacctcatcggtgttccttgttcctgaggaggcatgagtagagggtgagagtgagcatctccatgactcacagtggaacttctgtttcatagccgagtaaactgaggctggtgagaatcagtgactacagtcagacagctatttagtattaggtgaagattttgaacttaggccttttgggctgcaagtccagtgttctacccaccaaattattatgattcttagtgcatgtgtatgttacacatttactagttagataagataaacttaggccttgtatgtggggttcacgtaggggctatcactgaagctaatcattgtgtcccattactcaggtgtttctgtatatggggttgaacagcaggaaaaaaaagtagtggggtgcaaaccaggggaaaatctcactaaagtaatattttttaaaaagcaatcctgtgactagatagtcaagaagggaaaagttatgggtgggaacagggagcagcagacacataggtataaaggcagggtttcaccttgaatggaggaagaaccctaattacagggagattacatcatcaggtgtttggaagcctctgcctgtgaaatgacattcttggcaaatgaatgaatgtgtcatgcactaattaaaataaaggaaataaggaaactaacattcatttagcctcagctatgctgtgggcactctgataggtactttcatgtttattatctttaattaccgcagcaaagtattgtagacattattatccatacatttgcagctcgatcagatcagccacagtcacatagcaggtggcagagcagaggcctatacccagtgatgtcattccagaggtcattttgtgagaggacttggctgaaggaaagctacagaatggatgcctgtgtcatccttgatcaccctgataacacatgcacttatccttctcagactttcttctcagactcagcagaaaacttggcatcattcccttgataacttttgttgcccttctctggacctaatttcatagtctttgtggtaatttcttgttaaagaaaaatcagacacagcttcttttgtcttttatcttttctccattaggagtcattaggctaagtcatgcaaagacgaatttccgcaggacaaaatgaagcatatcttccctatagctcattaaaacccagagcccaaatcgttaagccattgaactttgtctgttgtgagagaaatcagggaacatagaactttggtgtgtagggtataaggaagtatgcggggcagtaaggaaaggggagaaggaggcgaggggcccaaacacctggggaccaagtaggaaagtggtctgagggtggagacgaggtcctaggagtgtctggaaggactgttgtcagtttctctcctagtgctcaggagtcaagctgagtcacaggcttttctagccagctggtggcagggctgtgcacaggagggcatcagaagtgatgtaaaatcctctcttttcagtctggagcagatttttaagtttgccctcattctggaaaggagaggagtataaccgggctgatatcctaaatttagttggagaatcctgctcagagtcagaacttcttttgaccaaactcaaaagctgacttcagaacccttggggaagttgttcctagtatcacagaggctgtagttattaacagcatgttcgggaaatgctggctgctacttgagccacaggtaagggagcgtttggattcctgtcagggcgtgtttccaggatgctgcatgaatgacagccaatggggcagagactgatgttcttttgaggagcccacttttagaggtcattctacttttcagaagtgcatgtactccagtgactacagcagaatgcattggtgcctgaactgacaggcctttgagtcaacagaacctggaatatctccgaggctgggctttgtggtgtggaggatttgaccacagagatttagacctgggaattatggctgtgcttgggctactctgagtgaaactcttctcctctcagttctgaccacctccaacctctagtaactgaactcggcccagaaagacaaagaaacccagattcacttctgtgagtgataagcacatctgagaaaaaaggcctggcagttggaccttccgaggtgctgtcggctggaggagatgaagtgtgagaagttgagtagctacaggccttagtggccacttaagagggtttggcgaagtcagagaaggaccctctttcagagactctgaaagtccattgtcaaggagagaggtctaggaccctacaaggtggagcttcactgtgacctgttatcattgaggtggccaagggcacatgcaggcactgtaatggggaaaagggccctggcttcttcaagagtggggaatgtgaagggcctctttgggacatgaatctgccttgggcagccagaatcttcaatttcagaactattgatgatggtggaagcaaaatagaagggatctgacattccacagtcctaatcagtgagttgccagtgactgccataattaagttattctaaggcaaatagttaagcaaagattaagtggacgagacctctgtaacttgagtatctaagtcttcctataccaagttatatgtattttagactacacttttctaaaggtgtagtagagactagtgaggaggtagatacaacatctgctgtgttcccatatacctgaggctcatggagagtggtggccttgaacagaacaaatgccctcttaacccggttcctttggcggtatgtacgtcctgatacctaaacaacgtttcctttaatttattttttgggtgtgtgccaaggcctgtagaaaaaggctgagcagaggttctcttggagttgttttatctgctgagacttgccaaattagaatttgatggctttgatttctgggacttcctgatcatttttgaggaggaggagttcctaactaagctggagggcacatactttctccacatgagtggggcacccatgatgtcagcgaggacagtgtcagatagatgcacagcccatcacccagaaactaaggtcttgtaagaataccttagtgaattgtgccagatggaataaattctgaatcctttataaagcatctctttgggagagttctttcttgtagtgtttaggtctcaatcctctcatgcacgaaacttcagaattattttggaggactttggggggcgtttttcttatatctagaagaggaatgtttggtgatggaaattactcactacacataagtggtcatcttacagtttgtttgcatactttcagtcttcaaaaaaagtgggtttaagatggattctcaacccctttttgtgtctggccttccttacactttaaaaaccatttttaaggactccagagaactttaagtttatgtgggttgcaggctttggtacttattgtaatagaaatgaagactaaagttttatgaagatacttactaactcatttatttaaaaatgataaactcattacatgctaacataaatgacatttttatgaaaaatagctattttctgaaacaaaacatttagtaggaagagtggcaatatttacattttggcaactctttaaatgtatggagtttaaataaaagacatctgcttctatattcagtctcttgcaatatgttgttttggttgaagtagatgaagaaatccggccttgcatagataatgtagttggaaaagggattttagtagccttttcagataattgtggctttatctgtgacatgacaccaaaacttgacaagtggtagatgcctacgggttagttgcaacgtacaatctgaaactgtattcatgaacttttcgtactctggtatgttaaaatcccttggtctctcttacactctgaatagatcttttacaaactgtgtgaccacatgttggtcatttggagccttcatggagtgcctacctagatgaacattaattagcgggaattgtactataaattgtgagaacatgttgagaaggaggatctagatcagtgggtgcttagctagtttattcaggaagggtttcagctggggcataactagggggcaaagaacatctgttacagtaaaggcaatgatgaaaatgtactatttgcatactcagtaatctgaggaggttgggattacaagcccattttacagacaggaagctggtgctcagacagttgagagcatgatctgagggtggtagggagaggtgttgagcatagagccgtggcccattgtgtgtttcatcacggtgttgtgcagctaagccccatcctctgctgagtagagctatgagtcaagtaggctttaaaaaaaatagtttacagacaaagaacattttcatattaagtgtgaggccgatcaggcacttgccaagaaccacatttagcctctgagtcaatgcttcacagactattgtgtgacctggggatcctgctaaaatgcaattctgatttggtaggtctaaggtggggctgaggttttgcatgtctgacaagctcccaggtgaggctgataacgctgctccatggctcagttttgggaatcaaatttccagagccagtttaccatttgttccttaatacatgatatgaatgttaatcccagtcactcaggctttggagaaggagaatggaggtgggcggagatgggtggtaactatgtaaaattctttgtcagttagggctgcctggtaatcagcaacagaaatggactctagctaatttaaggtaaaaatgaattttagaatggaaggggacgtggaggaacccagtagcgctggaggttcatagttgtaggaactgcttagatgtctgtcctgggtgctgtcactagcacatgtgaatgaactctaatttttaatgtcatctttgactcttcacaattcagagtacgtggagagaagactggctggctcaacagaggtctgttttgtaccccctgactggaccaggcactgtagtgagagggaagatctggggatcttgtccttcacaagggaggatagaagagcaccctgatttatcagcccattattgccgcatagagagggagaggtaatccctgaacaggaagttagagtgcagttaggaaagggaaaggaaagctcagcaggaaggctgacctgttgccaggctcctaagccatctttcagttaacagtgtgcattccctgtacttaccaggcaggtacattgaagaaagaaagtatgtattgagcttaagtactataataaatatgcattgttttatgcaattttcaaagcaaccttaagagatgcaagtataggtattattgaggaaatgagtcttggggttgaacaacttgcttgaggtcacacttagtaagtgggagagctgcaacttgaattacaaagtttctgctgcagtatcatttgttggcagaaactgctgctgcttggggtaaaaggttgcttcaagtgggctgagtgtgagcataagtggtggaagttggggagaatgtgtatggacacacagagctggagatgcataacaattcaagattttggagatagaatgctctgtaaaacaagctcaaatttagctgtgtctgttaagagcttcatggcctcaggaagggctttcagtctcttagctctaccagattatggctttgcctgtgatgggaaaggatacttccacggaatggaaatttaaggtgcgaaacccaaggagagcaggcaggaatggggaaaagtgttcatctggaaatcagacagagtggacagaatgtcgttgggggcgggctttataattgatgggtagcttttgcagtggccaattagattgcagggctctgtcctcattgcctggccagggagggaatgaagctcattcctgcattaccaggacaaagcccacttgtgtgtgatggacggaagtaggctgggtgccccatgttatatgtattatatacaaaacccccattcactctggctagtctaattgtgaagccactgctcaccccttccccaggctgccagccacagaagtatgtatgtgtcgttgactttttggtgtcagaggtgaagactgtagatactgtttgtggtttttttgtttccttgggagacagaagcaaagaataaaactcttgtaaaggaaaggaaaaataaagattttctatgaaatgtaatctcttaagtaaaaatatttaagtgaaatctgcaacttctttttttggacgtgattaaaggtgaaatgactccgggtttttagagctaaaagggcttgggtgaagtgtgaaataagcaccatccattcagcatcaccaaagaataaacaatgccccttgtgtacatagagcccagatggaggtaaggactgtgatggcaaaatttcactgagagcatgccacatcctccttgtagtttccttgggctgctgtaacaaagtaccacaagctgggaggcttaaaacaatagaaatttattgtctcacagttctggaggctggaattctggattaaggtggcagcagggccgtgctccctttgaaggctttacaggagaatcctttgcctcttcctagcttgtggtggttgctagtagtctttggcgttccttggcttgtagacatatcacttcactctctgcagtcatccccacgtggcctttttccctgtctgtgtgtgtgtctgactctccatgtcctctcttttataaggatagcaggcattggatttagggctcacactaacacattatgatgtcatcttaattacatctgcaaagaccctgtttccaaataaggtcacatcctgaggttctggatggatatgaattctggggagacactattcaacccagtatactttttgcctttcttccttagagctccagctaatccagatgcaacattgacgaattagtgccggaatgagtatcagcacttggtactgcaattagaacacggggatttggctgttgatttattttttgggctacactgggagggaggctcagagacggtgtgggtgtctgaaggaaaaaatacgtgttaagtgaagtgaggacttcaaacgaaatcatacagttttgggaaactgcattggatagggaatgctggagccaaagagtgttccctgttccagaaagggaggtaacatttgcaggagggcttctgaggtcagaagttcctcctagaagtgcagggtgtatcagccatctcaggagctgatttcctgtgcaactttttctaatacccccgggagcctttcttatactttatccctttgtatgtttatggatcaggtccttcccactcttcggcacctgtgacaggctccacaggcttccaacactttaaatgccttctgtttttcctaaaagatagagtcctgagcttacaggacttcataggaagacctgtaagtctctgttggtctttataggtggactactatctcctgggtgtcttgtaactgtaatgtttatattttttcagaaaaccctacagagatgccttggtcactccagataagagtttctgtggctgagaggccccactgtatgactcctgtttctgcctgctggacttcactttctggggcttggcatctgatgacctctgtatacatgctgtgcctcctgttctttatgtggccacttcactttgtcctttgggtttcagcttaaaagtagagtcaactagaaatcttcattaccatgctgagactagttaggatgcccctggctcatcagctgtaatgcctctgtcaaagctccactcaaacatgctagaaccatcgccttcccctcctcaactgtaaaccacagaaatgcagaggccctgtctgttttgttcatcagatcctccggagcatagcttactgcccaacagatgctgggtggtaaataaatgtggaatatgtgcctgtgtgtgtgcagctctgaccctgtgcctcagaggtcagcttccaggactgttgcctcaataacacctctcttccaagtctgtgtcagggtgggctggcttctctcattgtcacttatctatgtcaaataatcaacatgtgttagaggactagggatatagggatctttctataaaacccttcccattaattaagggaccaagaagttaatgtggatcctttatatgttatgattactggcttagtgcatcgtctcctgagccagggccctttgattatctttcttagagaatcttatccagcccctatgacacaattgcctgctgtatgcatgtggggagatgaatcacatggtcatctcaactcattgcagttggtagtggttatttttggtagggattggaggccgacatgtcatcttcccagttctttttcacttttatctttcccagaaagtgtgcccttatgctttgagtggcaaaattatataccacacattctgatagatctggttctgggtaggaaattaatttgatctctgttgaaattgattttactgtcagagtctgctattgaagagggggattatatatagttagtgcttcataggaagacctgtactcataatactgctgaaagatctgtgatacttacaggtttcttaaaatcagaacagttgtctcaaaaataagaaaataggtaattttcacttgacttttatgacaaagtaattgtatagttatttaaaaacgactttagatttttctgagccagcagtccgaatttcagataatgtattcaagataaaaaaagaaaagctcagtccagacatccagagaggagcggtgttgggctgaatcttaagtaggacatggacacttcttccatttataaaaggaagaaagggctagagtcgggcagtacatgtaccttgatagtttggctggaattggagggagttctctgatgggttctcccttttctgtgtggcatttggtttgaagagcagagctagctgcaggtcagacatagattgaacatggggaagggggcaatagccacatagcaagttggggtgaggtcacacaagcattcctgaggcttggaagacccagctgagggtatcactgtgaagaccttggtggtctatgattctgttagcatgtgaaggtagagatttggattgggataggggatgatttcctttagaaggaaggcccgtttgtcctttgacgattctcatttggcaaaaactcagttttgcagaaacttagctatctgccttccccatgcagcccctgaggaactgagccctgggccaaatccatgcccaccctcgatgctgctggcagtctccctacgtttcttgggtcatgccactctcccaccctccagacaaccatctcacaccacctctgttctcctcaaacctccaggctccccattgccctctccttctcagcagatggccttgcttcctgcttcccagcagccagggactgtcagtttctacttaaacacacacaccacttcctaccttcgcctgttcatagaggcccgtccttctcctctccagagctcattcctctcgtggagctttggatcctgtctccattggccctttctgttatttcttttctctcccatagtttagtggaattcctctcatttttatttcttccctgaacttttccttgaagtctaacatgcagattataaatagggctgtagtgtaatgaattttcacagctatgagttgagcacacctgtgtgccccagtgcccagataaagacagcacatgacaacgatccctagaaattccctcgtgcatctttctagtcattagcccctctgtctgctctgttgtgtaacagcatcagttgatttgcttgtttttcaactttatgtaagtggaatcattcagtatgtgctcttctacttggcttctttcaaactcagtcattaaatgttggtctcctgtagcttagtcccagggccctcttcccttttcaccctttgttggtaggcagtcttattccctccccctgtttaagttaccatctaaatgttaacggctcacacatgtataccttataaagtcctgatctcttatctcagtgccagttccatccatctagctgctgtccttgacatcgacttttggatatcatgagcatgtctaaaatggaaatcacaatctttgtcttcaaaccttggtctttctaaagttttctgtcttactgaatggctccatctccatccagttattcaaataaaagacctgggggtcatccttggcatttccttgtccctcacccattgtattgaatctgtcaccaagtctgatacatttttctctcatctccaccattgctttagtccagattatgatcattgtttccaacccaaatgactaagatgatcccctaccatgtttacccctaaatgctcttgctttctacccatcctttaatttctgtactttagctacagttttctatttaaaatggaaatctgatgttactaccaaattttaaaacaaaagctaaccgctctggaggcttccactgctactaagataaagatcacgatgcctagcttctaccctctcatctggcactgagcgtctccagccccgctggccctgttctgtcccgtgcttgcctcctgcccctcaccatggtcctccacgcatgcctttccctcgggtcatgtatcttctcttcaccctgcagaggcctcctctagatctgaggtcagccatcagttcaaagtggtctcccctgacctctgacccctgaccaggtcagcctcacttccagcccagcctgaggtgctcagagcactgtgcagggctgctttggagcatttcacatagatttatttgacatttctttgtggacaccttgatgaacattgtctccccactagactgcagcttgcactcggaaagggactggctatgattctgcactgctgaaggcacagaagctgacataggttagacactcagtaaacatttggtgcttgaatgactttggaagacaaagagatgaaggagttttagagattcacaaatttcataaattctctgcagtttctgctgatcaaggagcttgcattcaagagagcagggagaggagcacaacaaaggaagcatgtgcaaaaatgagcacaataattccaggcagtaagtggtaatgttctgtacaaaagttaaattaagcagaaagaggtggtcagaaaggtgtgagggcagagaggtaagtcagctgaaactgacaagcccgggagccgctttctaggaagacaacgcatgtgctgaggcctgggtgttgagcagatgccagctccctgaggaccaggaagaaactgggcagggggctcatgtgaaggtactgagggcacatgaggctggcaagcttgaagactagaaaggagatgagggaggctggtgtgtggtttgcagagagtgcaggaggtgaggttggaaggaggcggtggctgggccacctccagcttgtgagccagtgagaggatgtgtgttctaaagagcaatggaaggattaagcagggcagtgacgttctctaacttacatttttaaaagataagggtgactactggtagaggtccagttgtggaggagcaagaatgaaagccagagagacctgtggttgagaggctgttgaaatagtgcaggcaggaggtgaccgtggcctggatagggtggagcttgtagtggccatggagagatgcaagggcagggctgggttatgttgtggagaggaggtagagtgtgcagtgatttgcactggtggggctggaggaaagcagaattaaggacaatgcatctggatggatgttggtgtgcttgacagagatggggaagaatgaggaaggaacagtttgaggggagatttggtttggaaatgtggttgtagtgcctttcagcagagattatggagcagtccagggctagagataaaaatgggagccaacatctaaagagtattttagatcacgtgactggtgagattacttagagggtatagattcagaaaagaaatggtcccaagcaggagccctgaagcaccccaggatttagaagttgaacagaagagaggtcagcagtaaaaggaacaaggagtggctagtgaggggcagggacgggccagctaagaaagcaggtgtttccagccctgtcttggggccctgtcctgacagaggcaggacatgttgggaaagaaacatgttttcagtggcatgttgggaaagaaacccgcctgcaggggtggggctgtggtatccaaaacaattttaagaaggaagatactagaacatgtttgtatgagaatggacctatagctaggatggaattgacagtggcaatgagagggagtacttacaggattccatttggagaaggcccaggaagtgcactcatgggcacaagtggaagggctggtctttcctaggaacagggcaccccctgttggagtagaaggtgtgaatgcaggtggcctagtggatttgcagtaggaaaatgaagggcttgccatctaattgcatctttttttttttttttttgagacagagtcttgctctgtcgcccaggctggagtgcagtggcacgatctcagctcattgcaacctctgtctcccaggttcaagcgattctcctgcctcagcctctggagtagctgggattacaggtgcgtgccaccatgcccagctaatttttgtatttttagtagagacggggtttcaccatgttggtcaggctggtctcgaacacctgatgtcatgatccacctgccttggcctcccaaagtgacgggattacaagcgtgagccaatgcgcccagcctgcttctattttcttaatcagaaacaggctcttggcaggttatcagccacgagtgagggagtcagagggaagatgggagatttgaagagaaaggagaatgatgaagtagcaatttaaagtattgggaaaatgtgtgtactgaagacttttggaggaatttaggggcactccagtgcccatttgagatgtgtggtcgtgagttaaataaacctggcattattcagccacttgggtgcgtgtatggatagatggagagttgggtttgaataaggtgcggtgtcactgagagtaggtggggccagagagttctggtgagcgcagagagaagctgtggacaacagacagggaacaaagggtcaggccactgggtgcaagcctactgcatgaagttcctggagccagttaactggaaggggagggagcacccggtgtccaagaatgggttgcttaacacagatttgggagggagcacagtttctgggggtgatagagctagagtgtggccatggaaacagtgatgatgacagaagagagaggtgaacctgggtggagggagggcataaggaacccaagccagcatggaagccaggaagtaaagacaaacagggccacattagtaggacaaagattgaaagaggactggaggtcctgagggagcaaagaaaaggttccataggattaacagagcagaaagctggaacaggatgttttggttaaaggctagagtttcactcaagatggacagattgcttacagacttctggacttgcataggttggtgttgtcagtggaggcggaggcaatgtttatttagctttgtaatttagaacactgttgtattctttcttacggctttagattgtcatacagggattttctaagccaggggtccccaacctgtgggccacagatgggtaccagtccatggcctgttaggaaccaaggccacacagcatgaggtgagtggtgggaagaaagccagtgaagcttcatctatttatagctgctccccattgcttgcattacctcctgagctccacctcctttcagatcagcggcggcattagattctcgtaggggcgtgaaccctgttgtaaactgtacacgcaagggatctaggttgcacgctccttatgcgaatctaatgcctgatgatctgttactgtctcccaacacctccagatgggaccacctagttgcaggaaaacaagctcagggctcccactgattctacattatggtaagttgtataattatttcattatatattacaatgtaataataatagaaataaagtgcacaatttaagtgtaatgcacttgaatcatcccaaaaaccatcacccctgcccccagtctgtggaaaaattgtcttccacaaaactggtccctgctgccaaaaaggttggggaccactgttctaagcaaaggcttcctggcttccattttattatggaaaatttcaaatgaactcaaaagtagagaaaaaaacaaaatgtactcctatgggcctgtcaccacacgagttgaacccaggttaagaaaccgtgagctttttgctgttcttattttgtctaccctctctacttttttgttcacacaagaagccagtttattacttgagttgggttttgttgaatgaccacaggtcacatactcggtgctggcagtcttaccataacatgcagtcagcatttttgaaaacaatgtaaatatataatacagttgtctatcttttagtttccaaagtttgttacttcacattttgactggatgataatttatagaatgtgtgtgtgtgtgtgtgtgtgtgtgtgtgtgtgtgtgtgtgagagataggccagcatgtctgtattatcctcattatataaaaagaaaacagatgcaaagtagtgttaggtgacatgttggcctgaagttccaagattaagtgggaatacattttaaagttccctctttgctgttcccttctcttgggaatgttcttcattcatacagcatctgccctccatctcacatcccccgtctttctaaaggcatcactggcccatccctacaacaagctgtctccatgccagccccaagtgctagtaagacattgtcctatacctccctggtactgggctctgcaccagtgtgcccttctgcgtactcttttcttcaccagcctggcagtgggatgttagttgctgggcggcgctattctcttcctcagttggtggtgacagctgggtccctgtgcctctgcagttcttgcacggaggtcatagccttgcgcagagcaacacagacgaggcacttggcctcctgcttagtagtcggcatctgctggctgaacactgtggacataatctgatgtcaaggctgaatggctgctaattcctttaggagtgtaactggatttttctctcctgcccagtcaaggtgattagtctttatttcatatccagcctgtgttgaatataatccagttcatagtccactttgtggaacatcgattgtagcttaccaacctctacctccatgtaaatagttggcattcctctgatgctctggtcatcccattagggctgctgcaaccaactcctgcagcctcggccctatgctggagtggtagtctccccttcatgcagcgggttcgcctcttctgccgctagagtgaggaacttttggtctgaacagccttcaagggaaaccagcttcattctcccagcctgttagtcctgtacccccgtcttcaggttcccctttcttatgccgtgacccagagcacgtgttctctcaggatatggttcttgtatttaagactcagtttttgacttccttgaatcttagcatcagttctttattagctagttgccctcaattttaattgtactgaaatattagtactgattcagtattctgtggtatcacaaactacagggagagaggaaaggctccttttcatgaaaggtgaggatttgaggtagatgggctaaattttaagctttcgttttcttggttttcaactgcactgtcattttgttgtttgagttctcctccagtgtgagtcgagtgcacaggatgctgggggcgttcctgagcttgcaggtgcaggctctgagtttgtccttggcagccttcctcctcaggtcagaaagagggacttgcagtcatgtgggatgtccccttgaaagccccagtaggacgttgattttgagacataagggggagtctggagtgagagatagccttgggaacgtggtgtgttcaggatctgtgagctctgtggggttccataacctgtatctgcctctggatttacagctgcctctatctgtgtggaagagttgggtgggggctgtgttaggcgagtctgtactggagatccttgctgtgtgttggcctttctgttctttggttggtcacgtggaaaatttgccggagtttcttttatctttctttttcctacagaatgcaccttaacccctctcatccccccaccgtgcagtgagacttacagacaggtctgagaattttatctggaaggaatggcagtgcctgatgcctgaagaagaactctagtgggaggtcatgttggactcccctgtcagggaccttggtattgaactgttgcccttctgagcagagttggactctcctgaggctaggctggcggagtaccctaaccctggcagcttgattcctggagggggctctggaagacacccctgctggggttagcttgccaggcaaaagagcagagcgcagtgctgctgcctttgtcttttgcttgtcgctgccctgcagccactgccttcgcctgcagccactgcctttgcctgctgtccagaggcctcttcctgtgttcattctcctgtgctcaggattgactggggaaatgagagccgtttcggggattatattcgtttcagtcacagttgcccctctatgcggtggtcctgggattagtttgccattgccagaagagcaggaaaggaatatcttagcattcacagatttttttttttaaccatgaaaatttcaaccatacacaatattttacaatagaatcttttagagtagactattatctcttacctaaatgcaatggttacaatgattttaccacatttgctttgtctgctcttttttactttccctttttttgtttgtttgctgaagcattttaagtcacacatgtcagacgacatgtcccgtcattcctgttcttcactgtgcatctctaaggctgtagacattggtttacatagctacaatgacatgatcacatagttaacagcacacagtgtaatctcataccccgaatcacatttccttgactgtcctcttttagcagctggtttgcttcagattgcaaagaagttcctctgattacatctgattgttatgtctcaaatcgctttcatttagagcaactcctcccaccttaccggctttttttccctcgtgtccttattgcaaaaaaaaaggggcagttgtgctgtagagtggctcaccttttgatattttgctacttgcttcctagtagttcctctgtcccttcagttctttccattaaaaattagctccagaggcttgattaggttttgcttcagtcttttgacaagaatgtcttcagagggtgctgggtgtttcccattgcaccacagcaggaggcacacgtgtctggttgttcctctttgagtcatgctaagatcgatccctggcttcaggtggtgacagcctggtcctggcagtgtcaagtcctggatcagccttccagccgcttttttcacccattgcttttcatggtttgaatcaggtgtttgatgaggagaatgcacatattagctggttgtttctttgtcttgaaagagagttcatagaggaaataggatagatgcttctctccatttaattaccaatttttagggtaaaaagttgggcccctagttaattccaattttgttcagtgccttgggtctctccatctctctgcctgcctgtctgtctctttcttccccattctctacagtcattatgagctcctggggtttgtatattgaatgcgtctcactcaattgcctttcttattccttttgatgctcagttgcatgattggctctgtgttcctttggcacggccctcttgctttctggcataacaggatgtcccaggctcattttgtaagtgctactctggctttgaacccagccattcctccaaggaccccttgcctcttggtggggagaggatttaagggaaggggctgtaggtgtgctcattgctatcgcttcttattgcttccaggtctttttggtgataactaaaaagaaaaaaaagtgaattcagactgatatgtctaagtcaaattttatattacagaattttttcttaactttgattttatacttaaatctaatttttcctacattgaatcttggctcctaacaactttaacataaactacttatttgtattaacctactttaaaatacaccacagtaacagttaaattgttgaaagaagtgtgatttctttgcagcttatttgtcaaaagaatatgttctaggtatgtgcaatcagtatactatgctcaaaagccatttgtggctatgtcaccaatatgataggtttattctctttattttgttttaacattcatttaattttattttttaactatagaaacatatgtttccagagtcatgtaacagtatattcagagaagtcttaactgtattctcccccataagtaatcattaaattaaattctggattatctttcaccatgcttatttattttatttatttattttatattttatattttattttagatagggtctcactctgttgctgaggctggagtacagtggtgcaatcttggctcaatgtagccttgaactcccaggctcaagccatcttcctgcctcagcttcctgagtagctgcgactacgggtgtgtgccaccatgcctggctaactttttaatttaatttaatttaattttttttgtagagacagggtctccctatgttgcccaggctggtctcagactcctagcctcaagtgatcctcccacctcggcctcctggcatgctgggattacaggcatgagccagtgtgccaggccagagtttattttatatattaccttccttttttgcagaaacggtagcatagaacatatactattgtgtacctttttttttttttttaacttaacagtgtgacctgggttcactccatgtcagtgcacagtgcttgtcctcattcctttttgtcttgtgaggaggtgccatactcgactcggctagttccctatcgatggccttcggttgcttgcagttttgctgccaaatactgcctcagtgaataaccgggtatatcagtcatttcctatttttaccaatgtgtctttaggatatattctagaattattactaggacaaaggatagatgcaaacataatttttgtagatatatgaccatttttgccgaaattttggggacctaattgaattttgtaattgtaacactttcacctataagcagtccagtttattttacattttaacattacatctcctcaaacacccatgcatgttctctttgtatggaacatattaaaagtgttactttaagaagacctattgatttcatttagttaattttaaagtatcatagcgtatagagtaaaagaaatgaaaagattgctaaaacatagtcctaaaccttaaaagatttcagagtgaatattttgagatttattttcttcttttatctcctccttattctatttgtggtgtattttgtcccctgtaggctatcaaagactggaaataaggcactaagaaatgtacctttatctgctccaccagaatgaagcaggatatgtgtgtgggtgccagagggtgtcctgaagtactctatagattttcagaaaatattcattgaacacctctcattgccaggttataacagagagcaacgcacacagttcctccttcatggcacttacatcctagtacaggagacaggttaaaaaccagggaaccaatacgataattacaagtcctgtgggctttaaaggaatcaaaggagatgaaaacagagtctagccggggggcctctttaggtaggggaggggcagctgacccacaaagctctgcacaaagtaggggagggagtggcttaagtgctgggaacagcatgtacaaaggccctgaggcaggaaacgcttagggtgtttgagagctgaaaaagaaagccagaggcaggaagcacagggagtgaggtggggagaggggcaggtcaggtgtttgagttaaggattgggattttattttaagtacatcaggaaatcattgaggacaagtaggagaatgacatttgataccaacacatcatgtacttattctttctatagattagaaggcaagtcaaatacgatgttttatctccaaaggcagcaatgttgtaccttctgaagttcaaagtggagatcgttttcattgttgttcctttttacaggacagctggttttcatactcacatgtaggtctttttgaggatttcttttctctttcaataatgttccccttgatgttgctcagataattacaatgagttattgtaattggattatatacttgagctgtaaacaggagcatgatatctacaaattctctccttcagacctgcaaatccaagagacacatctttggaagataagagagcttcttcaagaccaaaaaaggtttgtgttactgctgtcacatttatataaaattaattttggaatcaatagcagttttccagataaaagcattttcaatttatttatttatgtttctattacaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataa

SEQ ID NO: 63 - DNA, 118251 bp, Homo sapiens
agcgtccttgtttgtgtggtgccgccgccgccggtgcagccgtcgccgccgccgctgcccccgtctgtaccgcagtgtctgctccgcccgcccgccccggtccggcccgcccccctcccctacccccgtccctagtcccgtcagcagggtctggatcccctgtgccgtcgcctcttcctttttcgacgcctccgccgccgcctgaggaggcgagctagccgggagttacaccgccaccgccaggtgaggagctttggcctaggccagcctggccgcccgcccgcccgggggcggtgaggagcgaggaagggaaggaggctgggaggaggcagtggtggcggaggtgggggaagggaaaggtggaggggcggggggaggggaagcgcccgcgagccgacgcccgcccgcgcgcccccgccttgcgtccccctccccccaccccggcacggcgcgcccccgcctcgcgctccttcttcacctcatcctctccccccttggcgcgcgcgacccggtctttcacttcggcctcgcgcgcccccagctcgtgtcccttcatttcgtctccttgtactctttctcccctccctcacgccccgtttcccccgccatccccgctttcactccctgcctcatgcccgccatgctcccctcctttcctctctagcgcgcccccccctttttttttttaactctctccacccccagtggtgccctcagggtgcgggggccgctccctgctcagtcttgtgtttgcgggcggatgggacgaatggggaatctaagggtaaaggaagcaccagataattatctttatttagggaaagggatcaggagcgcataaccttacccctttatttcgtcgtccaccgttcgctcgccctcccgtaggggaagagaattgtctcaggctatgtgggcacttagcttctacagcgactgggcttgtgggacacactggatctgtcttccagttcagttcctgagggtcggtggaacttacccttccctaaccacaccgggacttagagtacttttggcctccctgctctcaattacattgaggagcgagccactcatgcgagtgcagaggttcaggtgccattcgcgcgcccggtacagctttcccgtttcataaaggtatggtagcctctttggattcttccccagcatcaacttccaaacacaagatgttagctcatagggctggcagtgaggtggagatggaggcttggtggtgggtggcatgtggatgctaactgagctagctagcaaccttttctctgttgtcccctggaaaatcaggtagcctcctgagaaccagttttctcatttctgataaatgcttatttggggggcgtgtgtgtgtgcgtgtgtgtgtgtgtaagagagagagagagatggggggatacttaatacatttcagcagaggcgaaggatacttaatatatttcagcaaagggcaagagcagtgttttcaggccagactgcaaaagagggatttggatttgtagctgatggaattaaaacaggtttaacagatctgtgttggagaagagctgatgcttttgtagtttttaggacattttttctaaaaatttatattttgagtagaaaagcatgcatgtggttgtacaaagtgaaaagtaagcttccttcccatctctgtcctccagccatctagtctccttcccctcctagcacagatgactttgatgttttctggcagcagcatggtgcctatatgttgttggtgattatcctgtttgggagtttagtgctaactttattgcttttcatttggtatgctgacctgaactcttccttgcagtctgataacttggattcttattttggtgctggagcagcctttcaagtattgtcctagagtagtatttctgtcagtacttagttgggaaggaggccacttctggaggtgctatggaggagttcagtatattttgagggaaggcccacacttgttggatcgtgctgctttttttgtgacggatatctagtccctggccatttgggaatggactgggtcaaggatcggattcatataagcagatagcttatatgaataactagttgatggtaaggctgtcttcactttttaggggaatagagtttttttagtccagtggcagtgatagtcatcatggaacaaggtagaaaagtactaatcagcaggaatcagaaggctgaatctataggctgagtgacccagtttgagtagaggtgaggcttacagacttttgtcctgcctattattccttacttgagaacactctccatgaggtgagagtgatttgtagttgacagcagcatccatctttatgacactgtggtttgccttccctgaccgtatgtgatgtgtgttaacttcctgtttagaggcagtcccagtagggtctgaatataggctgcactcaaatacttttctaggaacagtgttaaccaggttccctgatcagcccttcaaatctaaattctggcagtaacttttactgctgtgcttagcatagggccacagggtggtggcagagggaagtgtgaggaatttgttctgagcctcacaaccttaaagtactttcaaaagcttgtatgctgtcccccattttggggttttgcccccttctcccctttttttgccagacgggcaaggctggacctccaggttgaattttggggaccattgtgtcagtgaaggtatcctaatcatgtgttgagacctctgaattcatctcacctttaagcagtgagtcttgtgtgttgcatgtaaagcattcctcctgtttcaatttactgattcttcttcctttcctcccccacccaccaagctggaggtgcatgtggaggaaaacagcagctgtgctgtcctgatttctagactctggagcatattccatgttagccaccccattgggagtcatgctgacaagcagcccctctgcgcttaacttagaaggctcatgttgcttggctcattgagaaaagccaaccagctttggttgattaaaacaactgctagagaaatcgtaagatttgagccataactgggactgagggactttcttttccagacctttgcagtacttaaagccctgcattattacatatcaaggcacaatagccagacattttctgaggtagtttggagggaaagaaaaagtaaagacacacacccagattgactgtaaatctagtcctggcataaagctgtccacctcttgcttggggaaaaaatccagtctatcagacaataccacatagagttgcagttctcctgcttttggctaagcctaggaaaagatatataaggaagttcagtttatgttacaatgactggattttgtggtgtatcttctattagccatattatttggtttatcctcagtagtctctgtgaagctttttctgtaggtcctgtttggggattttggtggctccagaatccttgaagcagcaacctcctttctttgtgtagcagtgatgaaagcttctgaagaataggtctgatttgaaacagacccctcctcatgttccatcttttaccttctcccttgtggatatatgaaatattcctgtatagcttgaattcatccagtaagaagggagtgtcccagggtcattagggcttttaacctgtctgaggtatttagatggtggcttggtaatgtttgctgtctctcacaaaatcccccttacctttgccatttacctaggttgccatcagctggcaagaaactatcaacagttttgggttatagtacaaaaagcagcagattactaagaacacatcattcgttacttttgagatatgaagtggtcagatccagacctcaaagaatcatagtaactgcagaagcatctttgacaatgtgtgaacttgttattaataataactagtaaactgctaaagaaattaagggaaattatagcaattccatattcctgagccattctcttactgtttttcacacctggctagttccattttattttattttattttatattttttgagatggagttttgctcttgttgcccaggctggagtgcagtggtgtgatctcagctcagtgcaacctctgcctcctgggttcaagtgattctcctgcctcaacctcccaagtagctgggattacagtcacctgtcaccatgcctggctaatttttgtatttttagtagagacggtttcaccatgttggccaggctggtctcgaactcctgacctcaggtgatctgcccacctcagcctcccaaagtgctgggattacaggcatggagccattgtgcccggccttagtatccatttaaaaaaataattcaggttactgttacctaaagctgagagtcgtactttaaatcttttgatcaaagctttcttcggcttgtctcatttcaagggagggtggaatttataatctttaaaaatacatgctggaatgttagtaggatttagattagacaccaggattaataaattctcattataattgtgaaggattgcaaatgttaactgaaagacttgtgcatctcttgcccagaggatttttataatgttagcatttttagagtatttaaactcaaacttgctgaaagagaggggatgaactaatatgtggcagattggactagtggaacacaggttgtggagagccttgaagtcctgggttgaattctagctttgtgatttattagctaactgattttgggtaatgctactaatttttgaattctcatttcttgcagacagagtaatgccagtccttgcaatagcctttaaggctttacatggtttgccctccccaacctcttccatttttgatcggctgtcatcttccctcttgctctctccattccagccacactgacttgctccttgaatgctgatcagtcacactctatcttagaaccttggcaggttcctaagaccaagtgattccttctagtgggaaaacagctaggtttccccacagagaatggctgattgcctcacctccttaacgtctttgcttaaatgtcacctttttaatgaagtcttatccttcctttctttaaaattgtattgtcagttcccatccctcatgcttatccttgcctgctctattttctttttcataggacttaacacttttataatatatttatttgttacatttattgcctattggttctctttctatgatgtaggtcttagaaggcatggatttgttttggtaatttgtttagtgcctagtacagtgcctggcatgtagttaataataaatgtttgttggccggggttggtggctcatgcctgtaatcccagcactttgggaggctgaggcgggcggatcacatgaggtcaggagttcgagaccagcctagccaacatggtgaaaccccgtgtctactaaaaatacaaaaattagctgggcgtggcagtgggcacctgtaatcccagctacttgagaggccgaggcaggagaatagcttgaacctgggaggtggaggttgcagtgagtcgagattgcaccattgcactccagcctgggtgatagcgtgagactcagtttcaaaaaaaaaaaaagatatgtggggcatggtggctcacacctgaaatcccagcactttgggaggccgaggcgggtgtatcatgaggtcaggagttcaagaccagcctggccgagatggtgaaaccccatctctactaaaaatacaaaaattagccagacatggtggcagttgcctgtaatcccagctactcgggaggctgaggcagagaattgcttgaacccaggaggtggaggttgcagtgagctgagatcgtgccattgcactccagcctgggtgacagcgtgtgactcagtttcaaaaaaaaataggccgggtgcgggggctcacacctgtattcctagtactttgggaggccgaggggggtagatcacgaggtcaggagttcaagacccgcctggccaaaatggtgaaaccccatctctactaataatacaaaaattagccagacatggtggtgggcgcctgtaatcccagctactcggggggctgaggcagagaatagcttgaacccgggaggcagaggttgcagtgagccgagattgtgccactgtgctctagcctggtcaacagagtgagactctctctcaaaaataaataaataaacaaataaaagtttgttgatccaataggaataaaaataacctgtcatactaatctcatgtttgtatgtaacaaaagtatgaaatacaagcataaaatgttttgtgaactttaaagcataatgcaaataatgatgaaattattgccttcccgttaaaatggtaaaatacacttgattattgaaaaaaacttcatatatattcaatatattatcatttctctcctaaactccagccctttgtttccggttgtctactgtgagctagacgtatctatacctttgtatcaagttggtactcaaactcaacatttccaacatcatttcttccctgtgattcattgagtcatctaaaccagaaatgtgagcatcattgtcacttctgtcttacctattactttctaaatatttctgaatctagcttcttctgtgtctccattgctgttctcattcaacagctcttattttgggatattgccttgatcgcttacacatctgtttatagtcttactctctttttcttttttttttttttttcttgaggtggagtctcactctgtcactggagtgcagtggtgcaatcttagcttactgcaacctccacctcctgggttcaagtgattgttctgcttcagcctcctgagtagctgggattacaggtgtctgccactacacccagataatttttgtatttttagtggagacgaggtttcaccatgttgccccaggctggtctcaaactcctgacctcaagtgatccgcccacctgggcctcccaaagtactgggattacaggcgtgagccaccgcacccggctgtcttattctcttgtaaactctctatcatcgtgccttcaaaatagtctaacacttactgattattctactttcctcatcttaaaagtatttagtagtttccagttattaaaagattaaaatgtaaactttgagtggtattcaaggccctttatgttgttggtgtttgccttcctatccagccctacttctgtaccttatagttaatgtgtgagcaaatacagtggtttttcttttcttttttttttttttttttttatatagacaagttctggctctgttgcccaggctccatggagcacagtggcacgatctcggctcactgcaacctccacctcctgagttcaagtgatcctcttacctcagcctcctcagtagctgggtctataggcctgtgccactttgcccagctaatttttgaaatacagttctttttaattacaggtagcttctgaatctcataaagaatgccacttcttctgggaaaccttccctgacttgcccaaagagagttagatacattttcttctttgccctcataatttttattaagtttatttttatttatttattttttgggatagagtctcgctctgtcacccaggctggagtgcaatggtgcagtcttggctcactgcaacctccgcctcccaggttcaagtgattctcctgccgcagcctcctgagtagctgggactacaagcatgccaccgcgcccagctaatttttgtatttttagtagaaacggggtttcaccacgttggccaggctggtcttgatctcttgaccttgtgatccgcctgactcggcctcccaaagtcctaggattacaggcgtgagccaccgcctcccgggttcaagtgatcctcccgcctcagcttcctgagtagctgggattataggcacatgccaccacacctggctagtttttgtgtttttagcagagtcagagttttgccatgttggccaggctggtctcagactcctggcctcagctatccatctgctttggcctcccaaagtgttgggattacaggcgtgagccactgctcctggccttttttttttcttttgaaacacagccttgctctgttgcccagattggaatgcaatggcacagtcatagtttagtgtaaccttgaactcctgagctcaagcagtcctgcctcagcctcctgagttgttgagaccacaggtacacaccaccaagcctaatttttaaattttttgtagagatggggtctccctgtgttgcccaggcaggtcttgaactcctggcctcaagtagtcctcctgccttggcctcctaaggtgttgggattacaggtgtgaaccactacacccagccttgctgtgtctttttactattgtatttccattgcctagcatggtgcctgtcacctaaaaaatattttaaaatatttgctgaataaatactcctatgggtttagaaaatgcagcataaatttagaaatgccccttctgttatgttctgggaacagaacaagggttggagccttggttctgccatttaccatctgtgtgaccttggttgagtcacttgaagtctctgagccttagtttcctcagcttagaaatgagaatcagtaactgctttatctatttcgctaggtttctttgtcagtcaaataagataatgcatgtaaaggttactttataaactgtaaagcactgtattatttttaatcattatgtgtttacacaagttgagctttgctcacaactctttttttttttttttttttttttttgagagtctgggggctggagtgcaatggcatgatctcggctcactgcaacctccgcctcccgggttcaaacgattctcctgtgtcagcctccccagtagctgggattacaggcgcctgccaccatgcccagctaatttttgtatttttagtagacatggggtttcactgtgttggccaggctggtctcgaactcctgaccttgtgatccgcctgccttggcctcccagagtgatgggattacaggcgtgagccactgtgctcggccccttgtaactcttgactaaattttttcttctttttttttttttttgacagagtcttgctctgtcatccaggctggagtgcagtggcacgatctcggctcactgcaagctctgcctcccgggttcacgccattctcctgcctcagcctcccgagtggctgagactacaggtgcccgccaccatgcctggctaattttttttgtatttttaatagagacagggttttaccgtgttagccaggatggtctcgatctcctgacctcgtgatctgcctgccttggcctcccaaagtgctgagattacaggtgtgagccacagcacccagcttaggccagatattttttagaaacatcagtggtatgagggctgccatttttcctccatgaattcgaaggcaaatattgcagttcaaccagcttagccttcaccttcagtgcattcccaggaggatagttgtaactgagctggtgcccctgcctttcatctaacaggctagaaacaggagagtaaggtttcaattttgttaatgagcagaaacccttgctttctgtaaagatggcagtatcacactaagaaagctgtaaaactcaccattgtttctcttctgtgaggcatgcagacaggcctggggatcagaggagaaaaggaacaatacctttgattattttttttccagtcctttaaaagtttatatgtaggtcttgaaattaaatcaaaactttaagaaatttgtcctggctgggtgtggtggctcacacctgtaatcccagcactttgggaggctgaggcgggtggatcgcctgaggtcagcagttccagaccagcctggccagcgtggtgaaaccctgtctctactaaaaatacaattttttttagagacggagtctcactcttgttgcccaggctggagtgcagtatcgtgatcttggctcactgcaacctctacctcccgggttcaagcaattctcctgcctcagtctcccgtatagctgggaggtgccctccaccacgcctggctaatttttgtatttttagtagagacagggtttcaccatgttggccaggctggtcttgaactcctgacctcaggtgatccgcctgcctcgacctcccaaagtgctgggattagaggtgtgagccactgtgcccagcctgtcctgtcttataaaggcgtaaaggttatctgaatgatgttcactcctagattccaaactttttatctagcagtgtgaaattttaatctaccagtaaagaaattgaaaaaatttgctcaatagggtaacattttttaaggaggggtggttttccaatcactctttaacatttacatggctagattgatgtgttgccatcaaaaggattgaaacagttggtcacatgtattgctactgccgtggacaggttggccagaagacctttgaagtattgcaccgttaggttctgtgaaatttggtgtgaatagcatgacattctttctgtgcactacagtttggcctttaataagtgtccatgcataaatttatgtgttactgtgtcattctcttattttataattcagatagtaattctcagtttctcacctgagtgtatagagaatttgaaagttttgcttatttatttattttgagacggattcttgctgtgtcaaccaacttagccttcaccttcagtgcattcccaggaagatagttgtaactgagctggtgaagaaaaaaaaattcttcaatttcttttgagaactcatgaatttacatatataggtaccaccctttatgaacattttgattgttgcatgactttgtactatgaaagcctttaaatctacctaatattatactgtaagttcctaactttgtcaaatatattgggtagatatcaccgaagagtataactaaggttagaatctgggcatttttaatttccaaattaaactttctattctggctccgcgaatacttgataattacagggagagtaaaatagaatatgataaagttttatcaaaatagaaaaattaaaatgtagcttatgtgtgacttttgtgttgtgttctagattcagttgtgttgagggtataaaaggactgatgaataaaggatactgttatggtgcacggaggtattagaggaggacagtgagatttttacccattattttataggtttataaattgagtgaagaaggctttggaagttggctttgttttttttgttttttgtttttttttgagatggagtttcactcttgttgcccaggctggagtgcagtggcgcgatctctgctcactgcaacctccgcctcccgagttcaagtgaatctcctgcctcagcctcccgagtagctgggattacaggcgcctaccaccatgcccggctgattttttgtatttttggtagagacagggtttcaccatgttggtcaggctggtcgcgaactcctgacctcaggcgatccacccgcctcggcctcccaaagtgctgggattacaggtgtgagccaccacacttggcccggaagttgtgcatttttaattctgttgttaattttgttgatgcactgcttagtaaatctttaatgagctgcctaaactgtgtcacattagctctttcttttgttggttattgtgaagactttgttgatttgtgtgtatgtgtatctctctcattctctcctcttgctctctgtctttctttaaaaaaaaccaaccattctcagtgttgtgtataaattgaatttttgtggctggatatgagcaaatagtattggtggtacttttagtggatatttttcatttaatttcttgaaagcttttctcctttggttaaactagaatagcttttgctcttttttcactttattccctggaacatctgtgttccagagaatatgcttgaatttctcactgatactcttaaagcttctgtgaaccgaaatattttagagatatatttctctaccttctcacctgtagggaacaccttttattgtactatatacagatgctctttgatttacgatgaggttatgtccctgtaaacttattgtaagttgaaaatagcctaagtcagaaatgcatttaatacagctaacctactaaacgtcatagcttagcctagcttaccttaaatgtgttcgaaatgcttacattagcttacagttggacaaaattatttaatataaagcctattttatttatttatttattgtatttatttatttattttgacacagagtcttgctctgtcacccaggctagagcacagtggcgcagtcttggctcactgcaacctctgcctcctgggttcaagtgattcttctgcctcagcctcctgagtagctggaattacaggtgctcgccaccacgtctggctaatttttgtatttttagtagaaatggggattcaccatgtcggccaggctggtcttgaactcctgacctcaggtgatccacccaccttggcctcccaaagtgctgggattatagggatgagccactgcgcccagcccaaagcctattttgtaataaagtgttggatatcttatgtaatttattgaatattataccaaaggtgtaaaccagaatggttgtatgtgtacttgaagtacagtttctactgaatgtgtatcaccttcacaccatcgtaaagtcgaaaaattttaagttgagccattgtaagttggggaatgtacatgcttggcaagtggtcttctaatctgtgtgtgaaaatcactagtagcttaccaattcaccatgaattccttgtttatttttaggcagtattttagaaagcttacatatctatacatataacattactttttaaaaaattattattattattattattttgagacggagtctcactctgttgccaggctggagtacagtggcgcattcttggctcactgcaacctctgcctcttaggttcaagcaattcgcctgcctcagcctcctgagtggctggaactacaggcatgcgccaccatgcccagctaattttttttttttttttttgagatggagtcttgctctgttgcccaggctggagtgcagtggcatcatctcggctgactgcaacctctgcctcccaggttcaggcgattctcctgcctcagcctcccaagtaactgggattacaggtgtgtgccaccacacccagctaatttttttttttttttgtatttttagtaaaggtggggtttcaccatgttggccaggctggtctcgaactcctgaccttgtgatctgcccccccgccccctcagtctcccaaagtgctgggattataggcttgagctaccacgcctggccaaattttgtatttttaatagagacaggtttcaccatgttggccaggatggtcttgatcttttgacttgtgatctgcctgccgtggcttcccaaagtgctgtgattacaggcatgagccatcgtgcctggccttaaaaattatttttaatgtggccgggcatggtggctcacgcctgtaatcccagcactttaggaggccaaggcgggtggatcatgaggtcaggagatcgagaccacagtgaaaccccatctctactaaaaatacaaaaaattagtcgtcatggtggtgggcgcctgtagtcccagctactcgggaggctgaggcaggagaatggcgtgaacccaggaggcggaggttgcagtgagcccagattgcgccactgtactccagcctgggcgacagagcaagactccgtgtcaaaaaagaaaaaaaaattatttttaatgagacaagattttgctctcttgcccaggctggaatgcagttgtgtgatcatggctcactacagccctcacttcctgggctcaagtgattcttgcgccttagtctcccaagtagctgagaccacaggcacatgccaccatacccagctaatttttaaaataaattttgtggggatgggaatctcgctgtgttgtccaggcaggtctcgaactcttgggctcaagcagtcctcctacctcggcctcctaaagtgctgagatgtaatccgtgttccagagcactttgggaggctgaggcaggagaattgcttgagcttaggagttagaggctgcagtgacctaggattgcaccactgtgttccagccttggggataaaacacaaccttgtttctttctttctttcttttttttttttttttttttccaagtatgtttctaggccaggtgcggtggctcacacctgtaatcccagcactttgggagggccaggcgggcggatcacctgaggtcaggagttcaagaccagcctgatcaatatggagaatccctgtttctactaaaagcataaaattagctgggcgtggtggcacatgcttctaatcccagctactgggaaggctgaggcaggagaatcgctggaacccgggaggcggaggttgcaagattgcgacattggattccagcctgggcaacgagcgaaactccgtctcaaaaaaaaaaaaagtatgtttctggtgtcaaaaagtcctgggttcaaatttctgctccaccgtttagttagttgtaagatcttttacttaacttctctgtgcctgacagattgtaaatgtccagtaaatgttagttatgttttacttttcattttttaaaattttatagcgatggggtcttgctgtgttgcccaggctagtctcaaactcctaggctcaagcagtcctcccaccttagcctcccaaagtggtgagattacaggcatgagccatggtacccagcctgttagtcattcttgtaaaaaagataatggtaaacctggcacatagatgtgtgcgtgcgtgagtgtgtgtttgtgttaaaatgtacataacataaaatttaccatcttaggctgggcgtgatggctcacgcctgtagtcccagcactttgggaggccaaggcaggcagatcatgaggtcaggagttcaagatcagtcttagcaacatggtgaaacccagtctctactaaaaatacaaaaattagctgaacgtggtggcgcatgcctgtaatcccagctactcaggaggctgaggcagaagaatcgcttgaacccaggaggcggaggttgcaatgagccgagatcatgccactgcactccagcctgggtgacagagcaaaactccatctcaaacaacacaaaaaaaattagctgggtgtggtggcaggcatttgtagtcccagctactcaggaggctgagacaggagaattgcttgtacctgggaggcagaggttgcagtgagccgagctcacgccactgcatcccaacctgggtgacagagcgagactccatctcaaaaaaaaaaaaaaaaaaatttacccttttaaagtatacagtttagtggcattaaatacattgatgttgtgtaaccaacaccagcattaatctccagaacttcttcatcttcccaaactgaaactttgtatatattgaactataactcccattctcccctctccgcagttcctggcagtcaccattctactttgtttctataaatttgactacttcaggtacttcatataaatggaatcataccacatttgtccttttgtgtctggcttattacactgaaaatatcttcatgatttatccatgttgtagcatgtatcagaatttcattttttaaggctgaataatattcctttgtatgtaaatatctcattttgtttatccattcatcggttggtggatatctggattgtttccgccttcggctgttgcaaacaaggctgctgtgaacatgactgggcagatatctgcttgagtccctgctttcgattgttttgcgtataggatatatatccagaattgaaattgttagatcatgataattcatgataattcggtttttgagtaattgttacagttttccacagtaactgtatcatttacatttctgtcagcaatgcacaaaggttccagtccctccacgtccctgccaacacttgttattattttttgtttgtttgtttttgaataggaattctagtggatgtgaggtgctgtctcattgtggttttgatttgtaattccctaagattagtgatgttgatcatcttttcaggtgcttattggctattcgtatatttcctttggagacatgtctattcagatcctttgcttagtttttaattgggtttttgttgttgtttttgtttctaagttgtaggagttctttgtatattctggattttaatccattatccacatatatgattctcattcagtgggttgccctttcactctgtagtgtcctttgatgcacaaaaaatttaattttgatgaagtccagtttatctgttgtttttttttccttttttgcctgtgcttttggtgtctaataaatcattgtcaagtccaacatcatgaagcatctaagagtgttagctcttctgtttagtctttcatttattttgtgttttttctcatttttttaaatttactttttgtattgtatcatttttgtattgctgtaaatgtgttacagcaacttgtaaaagaacaatattttgtgttaattttttgttgttaagacagagtctggctctgtcgcccaggctggagtgcagtggcacaatcttggttcactgcaacctctgcctcccagattcaagtgattctcctgcttcagcctcccgagtggctggaactacaggcacacgccaccacacctggctaatttttgtattttttagtagagatggggtttcaccatattggccaggctggtctcgaactcctgacctcaaatcaagtgagatcaagagagcctctggctctccaagtgctgagactacaggtatgagccaccacgcctggccccacactgttttgtgtgtgtgtgtgtggggtgcgggggaggggagcttttttttttttttttgagagggaacctccctctgtcaccaggctggagtgcagtggcgtgatctcggcccagtgcaacctccgactcccagtttcaagcgattctcctgtctcagcctccctagtagctgagattacagatgtatgccaccacacccagctaatttttgtatttttagtagaggtagggtttcaccatgttggccaggctggtctcgaactcttgacctcaggtgatctgcccacctcggcctcccaaagtgctgggattacaggcgtgagccactgcacccggctttttttttttttgtttgagagactggttcttgctatgttgcccaggcatggtttcaaactcctgggctcaagcagttttcctgcttcagcctcccgagtagctgggattacaggcaggtgccactatgccgggctaccacactgttttgattactgtagttacgtagtaagttttggaatcaggaagaatgagtcgtctgactttgttcttttttttttttttttttttttccaaaattgttttggctgtttgggcttccttgagatgccatatgaattttaggatgggtttttcttttcacatagttttttactttgggctaaaaatctgaatgggattctgctcagttatagatagtttttatttcacctaggcccttgaatcactgtatttttcttattttttttgagaccgagtcaggctctgtcacccaggctggagtgcggtggcgtgatctctgctcactgcaacctccacctcccgggtccaagagattctccctgtctcagcctcccaagtagctgagactacagggcgcctgccaccacgcccggctaattgtttgtatttttattagagacggagtttcaccatattggtcaggctgggtatttttctttatgtattgtgttgctcttggccaggtgcagtggctcatgcctgtaaccccagcactttgggaagctgtggcaggcagatcacctgaggtcaggagttcgagaccagcctggccaacatatagtgaaaccccgtctctactaaagaagacaaaaattagggccagggcggtggctcatgcatgtaatcccagcacttcgggaggccaaggcaggcagatcacctgaggtcaggagttcgagaccagcctgaccaatatgatgaaaccccgtctctactaaaaatagaaaaattagccagatgtggtggcaggcgcctgtaatcccacctgctcgggaggctgaggcaggagaattgcttgaagcagggaggcggagattgcagtgagccgagatgtgccactgcactccagcctgggtgacagagcaagagactctgtctgagaaaaaaaaaaaaattagctgggcctggtggcacacgcctatagtcccagcttcttgggaaactgaaacaggagaattgcttgaacccatgaggtggaggttgcagtgagatgaggtcatgccactctactccagcctgagtgacagagcgagactctgtctctcaaagaaaaacaaaaagaaaaattatgttgctccatacatctttgctcttataaatgaatcattttgttatggttggagcactttcttcttgttttaaagtttgttttcacattttaaaaaattaagatatagagtgaaaactttcttgtcactgtcttttaacttcctagttttaaaccccatcactgtttttccatttctatcatattagagtttctttatacatatacaagctaatatttatttatttatttatttatttatttatttatttatttgagatggagtttcagtgtttcacccaggctggagtgtagtggcgtaatcttggctcactgaaccctctgtcttccagtttcaaatgattttcctgcgtcagccttccaagtagctgggattacagatgcctgccaccacgcccggctaatatttgtatttttagtagagactgaggtttcttcatgttggccagactggtctcgaactcctgacctcgtgatccacccgccttaccttcccgaagtgctgggattacaggcgtgagccaccgggcctggcatatctatttatttttaagacaaggtctcatgctgttgccaacgctggagtgcagtggtgcagtcacggctcactgcagccttcacttcccgaactcaggtgattgtaccactttaacctctcaagtagctgggaccacatgtgcgtgccaccatacctagctaattttttgtattttttgtagagaggggatttgccatattgcccatgctgattttcaactcctaggctcaagctgtctgcccgcctcagcctctcgaagtgctgggattacaggtgtgagccccacacttggccaatgttagaactttattgggaaagaatatttaggcatatggtaaagagtatttaggtatattgtaatatgtcctgttaacagaaattctgtacttttcctgttgcttacaattctgctatttaatgattttcatcgctattattttgttaacattgaacaatttgagtactactagtactcaaaagtactttaaagtatttaaacttagtttaggaatgctgattgcctagttcatgaagtcttattttataatttcatctgtaatcctgaatctcaaactatggcagaaaatccagggctctgagcaatgatatgagtttatttttccaatttctggagtgaagattccagatgcttttctctgtcttaggcctattgtctcgaaaaatgatagttaattgttctgatagagagaaaacttgggtctggtctcttgtcctgcttgtcagagctgcttactttgtaaccacttttttttttttttgagatggagtctcgctctgtcgcccaggctggagtgcagtggagcgatctcggttcactgcaagctccgcctcctggtttcactccattctcctgcctcagcctcccgagtagctgggaccacaggcgcccgccaccacgcccggctaatttttttgtatttttagtagagatcaggtttcaccgtgttagccaggatggtctcaatctcctgaccttgtgatccctctgcctcggcctccccaagtcctgggattataggcgtgagccaccgcggccggctgtaaccacttaaatctgctggttgtgggaaactgcaaaggcctccacataacatttcttgtatgcctactatgtaaagtagtatgtaaaagatataaacataggtacgttagaggatataaagataaattacaagaagatgcagtcagtagactaaagactacatgtattaaaagactgcagctgggcttggtggctcacacatgtaatcctaacactttgggaggctgaggtgggaggactgcttgagcccaggagttcgagaccagagtgggcaacaaagtgagaccccatttacaaaaaatataagaaaacttagcagggtatggtggtatgtgcctgtggtcccagctacacaggaggctgaggtaagagaatcccttgagcccgggaggttgaggctgcattgaggcatgtttgagccacttcactcgagcctgggtgacaagagtgagaccctgtctcaaaaaaaggaatacaataattataatactaggtataatatgtttgtaaattaagtaacttgcatattaggaacaagtaccccttaagtaggaattataccctcattcagcactttttacaccttggctgtaagtatgataggcttaccaaatcctgaaaattcttttttttttctttttttcttttttttgagatggagtttcgctcttgttgcccaggctggagcgcagtggcgcaatcttggctcaccgcaacctccgcctcctgggttcaagtgattctcctgcctcagccttgctgagtagctgagattgcaggcatgtgccaccatgcccagctaattttgtatgtttagtagagatggggtttctccatgttggtcaggctggtctcgaactcctgacctcaggtgatccgcctgcctcagcctcccaaagtgctgggattacaggtgtgaaccactgtgcgcggccttttttttttttttttttttgagacggagtctgattggcccctgctctcctcctgattatccctgttgccccaaggccattttagacaggaccgggcacgttcagggtggtatggctgtagacaccagggccattttatttaatttatttatttatttatttatttatttatttttagcaagagttttgctctgtctcccaggctggagtgcagtggcacgatcgtggctcactgcagcctccacctcctgggttcaagtgattctcctgcctcagtctctcaaatagctgggattacaggtacacgccaccatgcctggctaatttttgtatttttagtagagatgggtttcaccatgttagccaggctggtctcaaattcctgacctcagatgatccacctgcctcggcctctcaaagtgctgggattacaggtgtgagccatcgggcgcagttggacattttaaccaaagaaaaatcaatcagctagttaactttcatggaagtatcaaaatggtgttgtccagtgaagtctcatcttgaataaatttaactctaatgcacttcccctctacgcatcactctcgttattaaagttcctgattctcattttgccttggagatgtgatagttttatttatttatttagagacagagccttgctttgtcacccaggctgaagtgcagtggcatgatcttggctcactgcaacctctccacctgggttccaacgattcttgtgcctcagccttaacatacaaacatataaatttttttttttttttgaggtagaattttgctctgttgcccaggctggagttcagtggcactatggcggcttactgcaacctctgccttccgggttcaagggattcttctgcctcagcctcctgagtagcttggattacaggcacaggccaccacacctggctaatttttgtatttttagtagagatggggttttgccaggttggccaggctggtctcgaactcgtgacctcaagtgatccacccaccttggcctcccaaagttctgggattacaggtgtaaaccaccacgcctggccagtttttatgatttttaaatgattgaaaaaaaatcaagagattattttgtgacatgtgaaaattacatgaaattcagatttcagtgtttataagtaaagttttattggaaataactatgctcattttttttcatattgtctttggttgttttcatgctgctacaatgtcagagttactagtcacaacaaagatgttaaggcctccaaaacctaaaatatttactatctggctaaagaaaaggcttgctgggcctggcttgatggcacacgcctgtagttgcaactacttgggagaggctaaggtggaagggttgattgaacccaagaggttgaggctgcagtgagctgtgatctcaccactgtactctagcctgggtgacagagcaagaccctgtctcaaaaaaataaagaaaaagaaaataagcttgccagtctgtgatgtaggtgaattctggtcccagattaatggtcatattactggatactcaagctattcttttcttttcttttttttttgagacggagtctctattgcccaggctggagtgcaatggcatgatctcggctcactgtaacctccgcctccctggttcaagtgattctcctgcctcaagcctcctgagtagctgggattacaggtgcgtgccaccacgtccagctaatttttgtatttttttaagtagagatggggtttcaccatattggccagatttgtctcgaattcctgacctcgtgatccgcctgcctcggcctcccaaagtgctgggattacaggcatgagccactcactgcgcccagtaaaaaaaaagaaatttttaatagaatatatatatgacatttgcagctcattgttttagtgactgtataatatttcattgtatggatataccttaatttacctaatctgtccacttctgaggaacagttagggtgtttgcaatttgtgtatacgtgtgctatgataaccagccttccagtgaaacatcttacatagatctttacacatttaagtatatttgtaggtaaaagttctagaagtgtaattaatgaaccaaatggtatgcccctttacaattttgttagactttaagttattctccaaaaatttgtaccagtttacaaccgcaccaacaggctataagagtttctgaaacaactcaattgaaatgtaaacttgagagaagtagtgtggctggccagcaatgagaactgtctgtcttcaagtgcctttgggaacacttatataccttattagcatttcctttcaaaaaaaacagttgtctttggattttgattgtcaggcatgtgactacagcccaattattggaaagagaagaaggaggctttttttttttttctttttaagatggagtttcgtcgtcgttacccaggctggagtgcaatggcgcgatcttgggctcactgcaacctccacatcctgggttcaagcaattttcctgcctcagcctcccaagttgctgggattacaggcatgtgcaaccacgcgtggctattttgtatttttagtagaaatggggtttcactatgttggccacgctggtctcgagctcctgacctcaggtgatccgcccaccttggcctcccaaagtgctgggattacaggtgtgaaccagtgtgcctggcaaaggaggctttttaaaatttttattttaagagacaagatctcgccatgttgcccaggctggaatgcagtggctattcacaggcatggtcactgcagcttcgaacttctgggtcaagcagtcctctagcctcagttccccaagtagctggaattacaggtgtgtgcaccatcgcacccagctggagtatacattttaagataaaaattgtcttctttgaaatgttcctcaaatgtctcaacttttagtctaagtgtaaaagttttgataatctgatttcttgtcctcacaatcttttaaaatcaggggcaacttcaggagtaaggagcatgtacggttcctagttgagcttctaattggcagaggcagagagccaaacacagctacatcagcagggtcatactgttttcagggaatggagatgttaaggcaggtaagggcaaattcctaataaaagttagattactttgctgactgattttcttgctctaataggtcacttgtctttctcctcatctcatttttctgcttttacagtgaaggtgattattttattcaatagatttaggttttgttcaatgaatttagaacttactgggaggctttcacttgctcagaatagggtcagagtaggaaggttatctttgttggtgcctcagcctcctgagtagctgggactacaggcgtgcactggcacacctggctaattttttttttgtatgtttagtagagatggggtttcactgtattggccaggctggtctccaacttctggtctcaagcaatcttcccaccttggcctcccgaagtgctgggattacaggcgtgagccactgtgcccagccaagattggaatcttttaaatacctgccagagctatatgatttgggattggtatttttgtagtttattataatttcttttttcttttctttttgtttttgtttttcttttttctttttttctttttttttttttttttgagacaggctgttactctgttgcccaggccgaaatgcagtggtgcagtcatagctcactacaggcttgaactttgggttctagcaatcctctctctccttagcctctctagtagctgggactacaggcatgtgttgttatacctggctaatttttttgtactttttgtagagatggggttttaccgtgttgcataggctgatctcagactcctggactgaagcgattggcctgcctcagcctcccagagtgctagaattataggctttagccaccgtgcctggcctgggtttttttttttttgtttttttttttctgtttgttttttgagacagggtctcattatgttgcttgagccagtctagaactcctagcttcaagccatccgttcgtcgaggtcttccaaagcatcgggattacaggtgtgagccaccgtgccaggcccagggaacgaaatatttgaatatagaaacatatatagttactgaggaagtgcatcgttttcagcaattctttaaaaaaatttttttaaatatattggccaactgtctagctttgagaccttaacctatatagcaggagtggtgatctgaatccattacaatatagttgatatttttagaagacataaattctgggtccctatagaagaaatttttcttaagcagaaacttacactttagagcaatataatgtagttttgactttttgtagaaaatatgtacttagtctcttatcagttattttcctgagaagcactcatctttctcttgcacccacattgggtagtctgagatagttagcaccaaaagtcaagtaatcctatttgaggtaactctcttttgttcacatatcccaatcttgcataagatcattctgttctcatcgtattagaagaaacagaaaagccaaaatcagatgatttgagtacttttcatcttttcttcttatttttaaaaaacaggtgttttggtgttttggccaggcgcagtggctcacgcctgtaatcccagcactttcggaggccgaggtgggcggatcacgaggtcaggagatcgagaccatcctggctaacacagtgaaaccccgtctctactaaaaatacaaaaaattagctgggtgaggtggcgggcacctgtaatcccagctactcgggaggctgaggcaggagaatggcgtgaaccccagggggtggagcctgcagtgagccgagatcgtgccactgcactccagcctgggcgacagcaacactccatctcaaaaaaaaaaaaaaagtgttctaagagctattttagttcccaaagccataaccacagtattttttaattaactggaagtatttgtttaaccaatttctctttttgaaaagatccttcaaaaatgggtcttactaatgttgccttggatataaaaagcaatgagtataaaatctgtagtttgatgacattttttcccttaagaaatttatggatgtgttagcagaatatagcatgatctcctgaactctctgtagttaatatttcagtcagtattaggagttgcttcattgaccttgaaaattttcttgttcatggttgggcacagtgactcatgcctgtaatcccagcactttgggaggccgagccaggcggatcacctgaggttgggaattggagtccagcctgaccaacatggagaaaccccatgtctactaaaaatacaaaattagctgggtgtggtggtgcatgcttgtaatcccagctactcaggaggctgaggcaggagaattgcttgaacccgggaggtggaggttgtggtgagcagagatcatgccattgcactccagcctgggcaacaagagcgaaactccatttccaaaaaaaaaaaaaaaaaaagaaaattttactgttcactcttacaggacctcaagccattctgtttttatggtccctcctactttcccttttgtttcagattatcccctttatctgacctatttgttggagtggagaatccagttcttctttgagtggtgcttttgattcaggataggcaactatcttaatattaggagccaggatctgttttatgcctcatctcatgcagctttctttaatgctatttagagacttccttgttagatggattttttttaaaatatatttttaagagacagaatctcattctgttgcccaggctggagtgcagtggctgtatcatagcttactacagcctagaactactgggctcaagtgatcctcccacttcctcctgaggagctgggactacaggcgcatgccacagcacctagctaattttttttttttttttttttaagacagagtcttgctatgttgcccaggctggtcttgaactcctgggttcaggtgatcctcccacctcagcctcccaaagtgctgggattataggcatgagccactacacccagcccagatggatttttgaaaagcctttcttatttccagagtcagaggtataaaagtctcaatgaacagcgtactcagccctaaccttagctgtgagcatcagacttagaatctttgtagataaagagaaacaggtaactgaagctatatggataaaggaaggacccaaatactgcatatcttagattcaagagtacatcattatattgtcaataaatttttagtaacatgtctcctttgcccctcagatgtctccgttctttttattttttcttcttttttttttatttttatttttgtgggagacggggtctcactctgttgcccaggctagagtgcagtggcacgatcgtggctcactgcagccccaatctcttgggcttaagtgatcctcccatatcagcctcccaagtaactgggactacatgcatgtgccaccacgactggttggttctgtacctcttgtacctgactgtcatcagcattaagccaaggaaatactgccaatctcttgtttatcagtttctgtaaactttttttttttttttgagatggagtctcgctctgtcacccaggctgcagtgcagtggcgcgatcttggctcactgcaccctctgcctcccaggttcacctgattctctcatgcttcagcctcccaagtagctgggactacaggcacgttccaccacgcccagctaactttttgtttgtttgtttgtttttgagacggagcttcgctcttgttgcccaggctggagtgcaatgatgtgatcttggttcaccgcaacatctgcctcctaggttcaagggattctcctgcctcagcctcccaagtagctgggattacaggcatgtgccaccacacctgactaattttgtatttttagtagagatggggtttctccatgttggtcaggctggtcttgagctcctgacctcaggtgatccacctgccttggccccccaaagtgctgggattacaggtgtgagccacctcgcccagcctttgtttgtttttttgagacgtagtctcgacctgtcacccaggctggagtgcagtggagcaatctccacttactgcgacctctgcctctcgggttcaagcgattctcctgcctcagcctgccaagtagctgggactgcaggcgcgtgccaccatgcctggctaattttttgtatttttagtagagacggggtttccccgtgttagccaggatggtctcaatcttctgacctcgtgatctgcctgtctcggcctcccaaagtgctaggattacaggcgtgagccactgtacctggcccgtaaacttttttttttaactgaggtataatgtacatacagaaaagtagtttaattgtaaggtgaccacccagatagagatatagaagacccagaagtctttttttgttttttgagacagaatcttgctctgtcgcccatgctggagtgcggcggcacgaattcagctcactgcaacctctgccttctgggttgaagcgattttcttgcctcagcctcctgagtagctagaactgcaggcgtgtgccaccacacctggctaatttttgtatttttagtagagacgaggtttcaccatgttggccaggctggttttgaactcctgacctcaagtgatctgcccgcctcaacctcccaaagtgctgggattacaagcgtaagccacatgctcagtcccagaagtctgttttatgttctctcctagtcattaccctcctccactccaacaggtagccactattctgacttcctctggtagtatttgtgttcaactacaagcttgagacttggtaataattgccacaaacctccttgaagataaagtcatgttggtggtgtttaatatagtggttccagttagtatggggacattttttgggtttttttttttttttttttttttttttagatggagtcttgttcagtcacccaggccaagtgcagtggtgcgatctcggctcactgcagcccccgcctcccaggttcaagcgattctcccgtctcagcctcctgagtagctgggattacgggcacctgccacgatgcctggctaatttttatattttcagtagagatgggatttcaccatgttgaccaggctgttctcgaactcctgaccctgtgatccacccaccttggcctccaaagtgctgggattacaggcatgagccagtgtgcctggccaagaataaacttttctaaaagttcagttttacttaggggaaggggtaaacttattttatttttttttttgagacagagtcttgctctgttgcccaggctggagtgcagtgttgtgatctcggctcactgcaacctctgcctcctgcagctcaagcaatcctcccacttcagcctcttgagtagctgggactacaggcatgtgccaccctgcccagctaactttttgtctttttttgtagagactgggtttcggcatgtcacccaggctggtgtgaaacttctgggctcaagtgatctgcctgcctcagtctcccaaagtgctgggattacagatgtgagccggcccgtgcccagctgggataaactttttaaggtgaacatttactgccctgtaaaatgataagcctgcctactataccaaatcctcgtaacaacagtcagaattttgacaaatctttatgtcactgaattgaagaaaagtgtcactgtttttcctgtaggttccatgtgctcatcaatgctaatgggcaaatctcagctaatagactgctagaagtttcctctaggtaaaatccagaccagacaagtttttcctcttgtactgtgtttaggtacagcctcacagaacttgatccactcctctgcatgaatattttcttccctcatttcaataaagaagatttcttggccgggcgcagtggctcacacctataatcccagcactttgggaggccgaggcgggtggatcacgaggtcaggagttcaagatcagcttggccaacattgtgaaaccccgtctctactaaaaatacaaaaattagccaggcgtggtggcacgtgcctgtagtcccagctacttgggaggcggaggtaggataattgcccgaacccgggaggcagaggttgcaataagccaagatggcacaactgcactccagcctgggtgacacagggagactgtctcaaaaaaaaaaaaaaaaaaaaaaggtttcttacaagtctactggatactgtctaatgttgggcccattttgatgacaaaattattttataatattgttggacagaagcgatgaatgtccagaatttcacattggcatatcttatccatcaattctgattttaaactccttgaccatttactagtcaattgttatgagcagctatgtattcatgtatccctctacagtctagagagttctaggtgagtgatgatgctttgaccctgaaagacccctttacttatcagtttatttatttttcccttggattcaataggagggaatacttattagtatgtttaatatttggtcagctagatcttttttcctagatatctgatctttagcctttagtgtgtcttaccttaactagtggtagtgttctatatactataatagtcttgttacctgttttactcttgagttttgtgagtgacttatgctgcttctagctaggcctggggattctgtccctaattgtcttgtcttttcttttttttttttttttttttttgagacggagtctcactctgttgccaggctagagtgcagtgaaatgatctcggctcactgcaacctccgcctcctgggtttaagcaattctcctgcctcagcctcccgagtagctgggactacaggcgtctgccaccgccatgcctggctaatttttgtgtttttagtagatacggggcttcaccatgttggccaggatggtctcgatttcttgacctcatgatccgcccgcctcagcctcccaaagtgctaggattacaggcatgagccactgcacccggccataaactctgtccctaattttcattgtgcttatgtcttttagtaattatgttaaatctagccattccttttatttttaaattttagtcagtttttggataggtgatatatgcacatggtacagaatttacaattggaaaaagtttacagtaaaaaaggacatctctttctttggagacagaacttaatctacttcttttccctcccctcccccccccccatacttacctcctcttacccttcccctctcctttttccttccctttgcctctcccccccacctcttttttttttttttttttttttttaaacgagacagagtttcacttttgttgcccaggctggagtgcagtggcacgatctcagctcactacaaactctgcctcctgggctcaagcagttctcctgcctcaacctcccaagtagctgggatttacaggtgcccgccaccacacctagctaattttttatattttgagtagggatggggtttcaccatgctggccaggctggtcttgaactgctgacctcaagtgacccacccaccttggcctcccaaaatgctgggattactggcatgaaccaccactcccggctgccttcccttttttcttccctttcctttttttttcacctctttctttcctttcccttccctttttcctttcctttcttttccttttttatttgtgtgtttctttgaggcggaatctcgctgtcgcccaggctggagtgcaatggtgcgatctcagctcactgcaaactccgcctcccaggttcaagcagttctccttcctcagcctcctgagtagttgggattacaggtgcccaccaccacacctggctaatttttgtatttttagtagagacggggttttgccatgttggtcaggctggtcttgaactcctgacctcaggtgatcctcccacctcggcctcccaaagcgctgggattataggtgtgagccaccgcacctgtcggcacattttattaaagaaaaactttgcatggtttactttttgccagtctgttctggcatgcgtttaatgatagcagaatcacctgggttaacgatagccagtgtacaaactctgtagtattttctacatgccttacagttattgtcactgtaatgatggatgccagttttggccaacatggtgtttagtactctgttttggatttccttaaagatgggcagttggtgaggatgaccaatttcactttaaataagttggagcctagagttgatcaactccagccgctttttcatcctctgcggccaccagctttctgtcttaggttcaggatggcccccaaccaagagcagctgccaggctggctgggaagcaagaaagcctgtttcttgttctgtcgtttttttttttttttttgagacggagtcttgttctttcgcctaggctggagtgcagtggtgtgatcttggctcactgcaacctctgcctcctgggtttatgcgattcttctgcctcagcctcctgagtagctgggactacaggtgcgtgccaccacgtccggctaattttttgtatttttaggagagacggggtctcactgtgttagccaggatggtcttgatctcttgactttgtgatcactcgcctcggcctcccatagtgttgggattacaggtgtgagccaccacaccaggcctcttatctttctttttttttcttttttttttttttgaaacagagtttcgctcttgttgcccaggctggagtgcaatggcgcgatcttggctcactgcaacctctgcctcccgggtttaagtgattcttctgtctcagcctcccgagtggctgggattgcaggcatgcccccatgcctggctaattttttgtatctttagtaaagacaagtttctccatgttagtcaggctggtctccaactcccgacctcaggtgatctgcccaccttggcctcccaaagtgctgagattacaggcgtgagccaccgcgccccactggcctcttatctttctattgataatgtagatgtttgtaaatttcctgtgactttttttattttgtattctgaagaacttacatacccaaatagagtacaaagtaattaactttcatgtgcccaccacaagcttcaaaaattactaacattttgctattctttacagttaattttaatgttgaaaatacagagaacatatgaaaataagtaacatgtgagtgtattttaaatttgacgttcacgcatctacaactttcctcttgccagctgtttccttttatgttgtctccatctttctcattagtgtaattatgaggggggttaattgtgtgattgtcttgaaattccgataattggatggctcacaagtctaccaagtttgagtgaagtaaattctgaacttgcctgcccagagtgatttataaatatacatggtacattctttgttttgtgtgtttttttttttttttttttttttggagacggggtttcgctcttgttgcccaggctggagtgcaatggcacgatctcggttcaccagaacgtccgcctcctgggttcaagcaattctcctgcctcagcccaccgagtagctgggattacagggatgtgccaccacgccctgctaattttgtatttttagtagagataggttttttccatgttggtcaggcttgtctcgaactcccgacctcaggtgagccaccacacccggcctgatacattctatttttattcaataattagatctagttctagtatagcctgttgaacatagcaattcagtgaggtgattattaaagtggagggcaaattaaaagatttatggaagtcactgactgtatggctgtgataacttacattttagtcttaggttttctattattactcctcatggtttggggctcttaagtcagagattgagtagaacgtcactatatagagggtagctatatatttttttcttttttgcattgtttatgatttcagaggataaagataagagcaaccttcacaacagaagtgaaagatgagaagcttaatgtagagtaaaatgtctgaagctctaagtgaaactgttgataagctgggatttctactcttggaacgctagagaggaagagacacttagatacttagtaacagcaaaaagccaggccaaaaagtagaactcaagtgcttagaaactctgtggcaaaagagataaacgtgactactaaaactactttctctttcgtctgtggcacttagttgataacagttgttagcacatttagatgttcaagtttaatttttgttgtcagaaaagtatgaacatttgtgacttgcctaaaaagaacttggtccccctgcaaagatagagggaaggtacagatcggagtgaatgaaaataatcagcaatcaagtattaagaaatgaagtatttgcacacctcatcactgggaatcaatagcatgctgctgatacaggatgagaataagttagggatttaggactattctagttaggtactatcttgtagacactactagagatactttgtcttttggaagacagaaattattctgtaggtattaaatactaatataatgctccatatgattttcatggttttttttccaaggataggcagtggaatcccccagttgccttaggaaaatgtataccacccttacagaagagattggcctagacacatcttgtgctgtatgataaatgaaaaagttgatctgtttattttctctgttcctgtatgatgattaagtcattgagtagtgtatggcagtaattttttttttttttttgagatagagcctcactgtgttgcccaggctggagtgcagtggcgcgatctcagctcactgcaacctccgcctcccaggttcaagtgattctcctgccttaacctcctgattagctgggattacaggtgcctgccaccatgcccggctaatttttgtatttttagtagagacagggtttcaccatgttggccacggtggtttccaactcctgtcctcaagtgatccagctgccttggcctcccagagtactgagattacaggcatgaaccaccacacccagcctgcagtaattttttatgcttatttgcaatacttgagtcaatagaagtcttgaaggcctctacagttatcttacttcctgtaaacccataatgagttaacacattaaggaatatgctttgactgtgtacagtggcacacaccttagtcccagccactgggacaacacagcgaaaccttgtctctttaaaaaaaataaaataggagtactactttgagaacagtactccctaatttaaatgctgtctcaggactcgaagtcttgttctcatttcttgtgtctgtgttaagaactagtccatattctgcattataaggtagtgtacctagtttttactttagccaaaattttgataaatacatcttcccaaatagtggtagacacttacttcacttgtcaatcaatcagtcattgattggtaactcccaagtgattgaaaactgacttcccttgttagactaaactgcctttttccagagaactcagcagtgcacattaggttgggtgtgattcccaatttgtgtatcagggattgggaaagcaaatggttttctttgtattagtgcttgattgcctggtgtgctatttctaaacatgtggagaggaatcctcatctccaaagaactgatgttttcttttgaccagttgagctattttctgtttaatgaagaaaaaatgtaactttttgaccatatgaatggggtttggctgttctgtgatctgatttgttgttgtaatagtaattttgaagcattgtggtctgatttctccaaatagactggaccgactcaaagcagacaggactataagaagtaggagaggactaacagctagataaacaaattttggcttgtattattggacaccagtgaataattttaagtgtaagttaaccatttagccatgtttcagcataatgttggctttttaaaaaaacagctatttttcggccagacgcagtggctcatgcctgtaatcccagtgctttgggaggctgaggtgggcggatcatgaggtcagaagattgagaccatcctcgctaacacagtgaaaccccgtctctactaaaaatacgaaaaaaaaaaaaattagccgggcgtgttggcaggcacctgtagtcccagctagtcgagaggctgaggtcccagctagtcgggaagctcagacaggagaatggcgtgaacccgggaggcagagcttgcactaagctgagatagcgccactgcactccagcctgggcgacagagcgagactccgtctcaaaaaaaaaaaaaaaaaaaaaaaggaaaactatttttcagcgtttgtaatggttctaatactgatctgattgctgagtccaaggatatacagtcatgcctcacgtaatggtagtcccataaggttgtaacatcatacttttgccatacattttctatgtttagatatgtttaaacaaatacttaccattgtgttataattgccagtatagtaacagactatactatataggtttatagcctaggagcaataggctataccatctaggtttgtttaaatacactttacaatgttcacacaacggtgaaatcacctaatcatgtatttttcagaatgtatccctgttgttaagcaacacataactgtatgttaaaatggggacaaagatttaacaagttatttataaaatttgtaaagggcaaagataacgactgtttttgccagtttatgatattactgagtttttgttaagtggttctatgaagtttacatttcttttgtaggagtacctttaagcattcagttgcaatcaatttgaactctgttgcctaagcctggatatcacctcttttcttatgctattctttgtgatttgatcctcccagacagcatttatcaaattctttttgtatctaggttgtacatctttagatctttagtcttccttttttttttttttttttggagacggagtcttgctctgtcgcccaggctggagagcagtggcgccgtcttggctcactgcaagctccgcctcctgggttcacaccattcttctgcctcagcctcctgagtagctgggactacaggtgcccaccaccacgcccggctaatttttttgtctttttagtagagatggggtttcaccatgttagccaggatggtctcaatctcctcgtgatccacccaccttggcctcccaaagtgctgggattacaggcatgagccaccgcgcccagcccacactcagctagtttttgtatttttagtagagacggggtttcaccatgttggccaggctggtctcgaactcctaacctcagatgatccacctgcctctgcctcccaaagtgctaggattgcaagtgtgagccaccatgcccagccccttttttaaaatttaaatatttttcctttacttgtcactgacttgaagctcatgtccttagcttttcagaagtagtcctgggtgaaatcatctatgagtggagatcatacatgtctgtcagagactttatgtgtttttacttccatcatatttggctaatattttctttaatccagtgggtaaagtggagattggcaaggcaagcatggttaccctggagaactgggcttttgagtgctgagaaatgctcaaggcatcgtggtatagtggaaagcatatgggctttggagccagcctctaattgtgagctgtatgagtgacttcatttaagctttttaaaatttcactgaattaatttccatatccagaagatggagaacagggccgggcacattggctcacacctgtaatctcagcactttgggaggccgaagcgggaggatctcttcaggccagtagtttgagaccagcctggccaacatggtgaaaccctgtctctactaaaaatacaaaaattagctgggtgtggtggcaggcccgtgtaatcccagctgcttgggaggctgaggcaggagaattgcttcagcccgggaggcagaggttgcagtgagctgagatcgcaccattgcactccagctgggcaacggagcgagactgtctcgaaaaaaagaaataaataaaaagaaaatggagaaaagatcctaccttcctggcttggtgcattaaatgctcagtgaatgtagatctttttcttaactttagataatttggtattctttagggtatcacaacttgagtaatatttaccaagaggaagtttttttgtttttgtttttgagatgaagtctcactcttgtcccccaggctggagtgcagtggcacgatctcggctcactgcagcgtcatcctcccaggttcagacgattctcctgcctcagcctccccagtagctgggattacaggcacctgccaccatgcccggctaattttttttttgaggtggagtctcgctctgtcgcccaggctggagtgcagtggagcgatctcagctcactgcaagctctgcctcccgggttcaggccattctcccgcctcagcctccggagtagctgggactacaggcacccgccatcaccacgcctggctaatttttttgtatttttagtagagacgggtttcaccgtgttagccagaatggtcttgatctcctgacctcgtgatctgcccgcctcggcctcccaaagtgctgggattataggcatgagccactgtgcctgcaacgccaggctaatttttgtatttttagtagagatggggtttcaccgtgttggccaggctggtgtcgaactccgggcctcaggtggtctgcccgcctcagcctcccaaagtgctgggattataggcgtgagccaccacgcctggcaaagaggaagtatttttaaatttagttttcacctcacacaattaagtactttggttttgggtgagtatgatttagctgaaaagagtagggtctctgcccactatatagttcttaattttccaaggctctgaaggtacctctggactactaatcaatccaacatatagagggagatatagtaaacgtagagtactgcctcagcctctacaatgttgaagatttaactcatggcaatcaatggtaattgctacagacagcttaattgtatctaagctttttatattaaaaactgataaaaaagaaaaaaaaaaaagaccagtgcagtcagatgtattcagcagactcacgtgggaattatctttgaatgggttgttaaaaaatagacaatcatacttaccatcatcaacatggaactagtgagcttcagtttaaaattcataattggtttcctgtggaaatgtgatgaatgagaagaaataatctattttgcttgcgacatttatcatgttttcctttatgttgtaaaatgatagcagtgtctagatctggatacctctgatggtctcctattaagaggaccttattgtgactgagatagtacggtatcaaccacttgaagctcatgttgtgttgtagataaagggttttcctttgtagtttgtaaattgttgaatttcttatgccagtggccagtactacttagttttgatttagctcggtgttagttttctgaaaattgaagttaatattatatggctcaggaaaacttttatttagaaataatatttttgcgtagggtgaagattatttttctccatgtttgctagaaactttaatatttgagaacaagggctttgtgagagactctgatggaggcagtaattatgatgtgaatttcagaggtccaaatgaggcaagcatttggaatgacatattcatgggagatatcagttgaaaagtaagaaaatccctccccccttgttattccttgttacaatttataactagttgatcagatagagaaagatcctagagcaaaggtcctcagccaatagatctccaagaaaacaattaccattgcccttcttcctctttggtttacttagatttcttccccactattttctgaccccatatcagcactttggggaagtgaaaagtccttataaaatgattggaacaagttgctctaaaacaggaaagggaaagttaatcagagaccaggcttaggtatgtctagcatctggatttgtctatagaatgacatagggatgtgtgtgtggtaagtgggatgtggtaggtgaggaggtgctagaatgcaaagagtaaagtgttctagctatgacacaggaaagtggaataatattgcaatcatactatggctgggcttaaagcattaaaaaatttttaaattgcagtaaaatatacataacaaaggcctaagctgtttttaaagaatgcatgggtactgtcttgactactttgctgtgaaaccttgctatgctttgtgttaggtgcggattcagctgccctgaacggtgtcaatggatcgggttaaatcagatgtcctatctgtgggacagcttcaggaaaaaagaaaaattagtgaatacacctgctgtcttattagtacctgttccctagcactagcaatagggataaagaaaagaagtttggtgggcagtatgtcttcattttgttataatttggggtgtgctttggtattgatgctgtgatttcctatcttggatgttggctttggaaactaaacagttaaagcatcatgatttgagaggaaactagctctcattcatgaagacaaagtttggcactaggctgcaatgatggggggatagttagggtggggagactaacagacttttttgtaccacaaatgacttttaaaaattaagagataattccatgtcctgaggttataaaccggctacaactggtttttctctccctccctcctgtccccgctaggcatcatgggtaaaagtaagcatccccctgtttcttttgtttaatataacagtacaccatgtgattggcagggcagtgcccgcttggagaccgggtttgtgcagggctctcaagggggctggcacgcatgggggccacctctgtgctacagaaagagcttctcttacggtagaaaagagacgatagaacagagaaagaaaggggaccctccacacacacacgaccctccacacacacacacacacacgaaaaaaacctaaacccatctcattattttcctcctttttctgttctctttctctatttcttatctctctcacttttctggaagctagaggaaggaacggaaaaatgtatacctctaagtagttttaactgtcttgccctccccaatccttatttttctttgctaaaagcagaaactcgaaatctcttctgagttctttctagtagtttttggctatgtgtagaaggtaatatgctgaggtttctaatgggattgaagtaataaacactgttgctttaaaaaaatttgttgcagaattattgtttctcatacaaagctcctttcggtttggatcttctttccctctgcttcatccatttgctataatggtaagggtctctggcttctagttgtcttcaagctgaagcaataaggagagtgttttattaaggttttctctttctccttcctcccctttttaaaatttcttttgtctgtagcagtgatggttctagcctcccccttaccctctctacccctccccttttccatgtcagctccaaccctgctctgtgaatggagtcaaccagctgactgagtgttggcatcatgccaggggctgcaaagcaatgagaatgtgcgcgcgctcgtgtgtgtaagtgtatacagaacacaaagggaaaggcctgcagtctaggaaatcacaggccattatataaggaagtctgcgtcatctctgcttgcttgggctgatggacaaggagagggaggggggaggcttagagcaagaaaaatacccttttgacacatccacacatacacttttttccttgctgtcttagaaagaaaaaggtatttgtgttgtggcaaaacgagagagcttctgtgtgcaagtgttattgaccatgttcctagtagaagtagtaactgtcctggatctccttttttatttttttatttttttgagacagggtctctgtcacccaagctggagtgcagtgatgtgatcacggctcactgcaaccttgacctcctgggttcaagctatcctcccaactcagcctcttgagtagctgggactgcaggcgtgtaccaccacacctggctaatttttgtattttttattgaaatttggtcttcctgtgttgtccaggctggtgggtctcttctttctgttcccattcaaaggtgtatgtgcttgagaaaagaatgattaaaagagaaatgcctcctggattttacagctgtagtttgttaagatacttaggggtgaggagcaaggaggcaggggacaggccacattgtgtggcttttttgttttttgtttttgtttttgtttttgacagtctcacttggtagcccaggctggagtgcagtggtgtgatctttgctcattgcaacccctgcctcccaggttcaagtgatttttgtgcctctgcctcccgagaagctgagattacaggtgcccaccaccacacccggctaatttttgtaatttttttttagtagagacagggtttcaccatgttggtcaggctggtctcgatctcctgacctcaagtcatccacctgcctcggcccccacggtgctggaattacaggcgtgagccactgcgcttggccgactgtttctaatcattcagaattgccaagggtacaggggtgggtgggggagaggggttgttcttaaggagaagcaaaaagccagataatagagcaagtaatatctattaactactcattcgagactcccccttcttttttatttcttcttttctgtttagtatgatattatcaaaatgcggtattctttccctgccatctgccagagttagaattgtacaaaaggacagtcaaacagcacatggaaggaaggaaaaattagagattgttctaagtgtccatgcattgcaagtgttacaattttggggttcagttgtagtgattgtgtctttcattggcaattaggggatcagcattcatttagaaattataattctgctcagtttagtatgatgtctttttttttttttttttttttgtagacagtgtctcgctctgttgccaggctggagtgcagtggcgcattgttggctcgctgcaacctccgactcctgggttcaagcgattctcctgcctcagcctcctgagtagttgggactacaggcctgcgccaccatgcccagctaatttttgtatttttagtagagacggggtttttaccatgttggccaggatggtctcgatctcttgacctcataatccgcccgtcttgacttcccatagttctgggattacaggcgtgagccactgcacccggcctgatgtcttttcttaaattctctttatgtgcctcctaggtgtgatatttatgaagcagcttttgtgttaggtgaaaatgagaaagtatattaaagaataaagtatggggccgagagcggtggctcatgcctgtaatcccagcactttgggaggccgaggtgggtggatcacatgaggtcaggagtttgagatcagcctggccaacaaggtgaaaccctatctctactaaaaataaaaaaattggccaggtgtggtggctcatgcctgtaatcccagcactttgggaggctgaggcgggcggatcacgaggtcaggagataagagacgatcctggctaagacagtgaaaccctgtctttactgaaaatacaaaaaattagccgggcgtggtggcttgcgcctgtagtcccagctactcgggaggctgaggcaggagaatcgcttgaacccgggaggcggaggttgcagtgagccaagatcgtaccactgcactttcagcctgggcgacagagcaagactgtctcaagaaaaaaaaaaattagccaggcatggtggtgggcacctgtaatcccaactactcgggagcctgaggcagaagaatttcttgaacctgggaggtggaggttgcagtgagcctagattgcaccactgcactccagcctgggcgacacagcaatactctgtctcaaaaaaaaaaaaaaaaaaaaaggaataaagtatgggtcacactgttacagttggttttatgtgagtttatttttgcttctgaccattcagaataacagcactgatggggagagttgggaatgagagggaactttcaaactcgttaatcctgtagtaagagtttttatcaggttgcagtctagaggaaattccttaatttgattgggaacttgtatatttttgttaaagcctgtaaatttctcttcttgccacatctttacaagcaatagtctttgaacgtctgtattttttggtgttaatatctgtgctttttttccttttgttaggaagtgaatatgaggttattactttctttaaggattgtaggatgagctggtcacagtggctcacagccgtaatcccagcaccttgggagaccatcgcagaattgcttgagctcaggagtttgagaccagcctgggcaacatagggagattccatctttacaaaaaattagtcgtggcatgtgcctgtggtcctagctactcgggaggctggggtgggaggctgcagtgagccatgattgcaccactgcactctagcctggaaaacaaagtgagaccctgtctcaaaaaaaaaagaaaaaaaaaaaaagattgcaggatgggacctaccacaatggttgttctgcttattccccaggctgcctgcaattatttccccaccccaaggagctggagcctacttttctaagtccctttataagtaaactaaggagtattatttcctagtctgttgagtactgaaagacaaaatagcaacagaccaaacttgctacaacctagaggctaggtaaagattcattcattgttgttgtgggattacctagttcttagaagtaataattacccttttttttttttttttttaagtttttttgagatggagtctcactctgttgcccaggctggagtgcagtggcatgatctcagctcactgcagcctctgcctcctggattcaagtgatcctcccacctcagcctcccaggtagctgggattataagcatgtgccaccacacccggctaattttcgtatttttagtagagacgaggtttcaccatgttggtcaggctggtctggaactcttgagctcaagcagttgccccacctcagcctcccaaagtgctgggattacaggcatgagccaccatgtccagctatatcctttatttttaccttttctcttgatgttaggagccagattagtgaggataatcttagtgattatgtagtcataatcagcaaggcataaaccagtaccttctcttaaaggatagatgagaaatttttttttttttcttaactctcataggccttaattgctgttttggagtggctgaagagtaattttgaagtgtatgtgaaatctgccctttggccacgtctgtccctttaattctatttatttattagagacagggtctcactctgttgcccaggctggagtgcagtagtgtgatcatagcacactgcagccttgaactcctgggctcaagtgatccttttgccccagcctcccaagtagctaggactgactataggcatgtcaccatgcctggctaatttcattattattatttttggtagagacagaggctcactgtttttcccaggctggtctcaaactcctggccttaagcagtccttctgccttagccccccaaagtgctgggattataggcatgggccaatgcaaagaacctttcactctaatactgcctgttcttcttttcttttttgaggcggagtctcgcctttcacccaggctggagtgaagtggcacgatcttggctcactgtaacctccacccgccgccctcccctcaccaggttcgagtgattctcctgcctcagcctcccgagtagctgaaattacaggcgcctgccaccatgcccagctaatttttgtatttttagtagagacggggtttcaccatgttggccaggctggtctcaaactcctgtcctcaggtgatctgcccgccttggcctcccaaagtattgggattataggcatgagccaccgccctgacctctcatatcaccttttctaaatgattgtctggcacatttgctttcgtgtatgtcagaacttctgtgctgatttgtaaggtgacagtaggagaaagctgtttacctcctgttcattacctctaggcagcacactctaacttgtcacatttaagcatagcgacctttacaatccttggtgcatattactgagcagtatgttacccactgcaaggtcatctaggctctttctttcaagaatgtgagccaaaggtttgtgtagtaaactcagtgatacagaaaagacactgtaagagcatgtaaacagtaatagtctttcataagaattactctcttaccagtctggttggatcggaaaccaaaaatgacaatatagatagcatagtacgatggttaaggacattgactcaggtaagacagtcctgtgttttaaccacgcccagccatttaaggactgtgaaatctttttttttttttttttttttttttttttttttgagacgaagtctcactgtgttgcccaggctggagtgtagtggcgcgatctcagctcactgcagtctccgcctcccgggttcaagcgattctcctgcctcagcctactgagtagctgggactacaggcatgcgccaccacacccagctaatttttgtattttttagtagaggcggggtttcaccatattggccacgctgatctggaactcctgacctcatgatccgcctgctttggcctctcaaagtgctgggattacaggcatgagccactgtgcctggcctggactgtgaaatcgtatgaagttactcagtttatctgtttttcttttctctctaacaggaggataattatatctccagaggttctaaatgagataatgcattgtgaagcactttagcgcaatgcctagcacatagtaagagctcagtgaatgttagcaagatagatattcctgtctgttgggtttgtttatactattttcattgttcttactagtttattttagccagcttgtggctaccttttttttttttttttttttttccctccaaactcgtggtaggtctattgacctgtatcaagatcaggagtcagcaaactatagctgctgcttgttttggtaaatgaaattttgttgaaacacagccacacccacttgcttacaaaagcagagtttagtacttgccccacaaagtctaaaatgttattatctggtcctttacagaagaagtttgtaagaaccgcatggtatagatcaagcttgtctaacctgcaactcttgggctgcatgcggcccaggacagctttgaatgcagctcaatacaaattcagaaactttcttaaaacatgagattttttttttcttccagctcatcagctatctttagtgttagtgtattttatgtgtggcccaagacagttcttccattgtggcccagggaagccaaaaggttggatgcccctggtctaatcaagagtctttttttcctagaaaagtgacctatgaagcaagttctagaaatcagaagagaaataatgagactaaatttggctgggcgtggtggcttacacctgtaattccagcactttgggaggcctaggcaagaggatcacttgagcccaggagcttgagaccagcctggtcaacacaacaagaccccatctttgcttacaagaaaaaatgctgggcatggtggcatgtccctgtagtcccagttagttgggaggctgaggtgggaagattgattgagcctgggagtttgaggctgcagtgaaccatgagctgtgatggagccactgtgctccagcctgggtgacagaacaagaccctgtttcaaaaataaataaataggctggatgtggtggctcacacctgtaatctcagcactttggggggccaaggcgagtggatcacctgatgtctggagttcaagaccagtctgagcaatatgatgaaaccctgtctctactaaaaatacaaaaattagctgggcatgatggcatgcacctgtagtcccagctacttgggagactgagacaggagaattgcttgaacctgggaggtggaggttgcagtaagccgagatcgcgccactgcactccagcctgggtgacagagggaaactccgtctcaaaaacaaaaacaacaaaaaaaccccaaaaatagataaataaaaatttaaaaatagactagacttacatggactagaaggaattaatcatttcagatttttaggaataggattttgaagaagggagggtctattgacatggctaataagcattaggtgaaggaaagtaccgtttgaagttggttaggcagtaacagcacttatttttaatctcttaggggcacttcatagtagtgtgttgtcttagtccattttctgttgctataacctgagactgggtaatttataaagaaaataaataaatttctttccctctctcttttttttttcttttgagacggagtgttgctctgtctcccaggctggagtgcagtggcactatctcagctcattgcaacctctgcctcctgggttcaagcgattctcctgcctcagcctcccaagtagctgggactacaggcacacgccaccacacccagctaatttttgtatttttagtagagatgggatttcaccatgttggccaggatggtctcagacgatctcttgacctcatgatccaccctcctcggcctcccaaagtgctgagattataggcatgagccaccgcacccggtcccctccctacctttctttctttcctctttcctttttatttattctctgtcacccaggctggagtgcagttgtgcagtcatagcttattgtagccttgaactcctaggctcaagcagtcctcctgcctcagcctctcaagtagctaggactacaggcatgtgcctttgcacccagctaaattgctttaaaaatgttttgtagagatggggtctcactatgttgcctaggctggagtggagctcctgtactcaagcaatatatccaccttggcctctcaaaagtgctgggattacaggcatgagccaccatgaccagccccaagaaatttatttctcacggctctggaggctggaaagtccagggtcaaggggccatatctgctgagggccttcttgctggtggggaccttgcagagttccagagtggcacagggcatcacatggtgaggggactaacgagagacagccacattggcttttattacagacccactcttgtgctaactagccccttctctgaataacccattaatctgagaatggctcaagcacttcctaaaggtctcgcctcttaacacgcctgcattgggcaccaagtatccaacagatgaacttctgggggacacattcaaatcgttgcggggtattaaagcgaagtacaaagaagagagatttgctgtcaagtagtttgcattaaacttggaaataaatatgaattggtaggttacctattaaacaagtgtgttagagtagcctagcagttttcaaagtgtagtctgtggaatcctagagaatagactcctttcatggagtctgtgagatcagaatagtttcataataatactaagtcatcatttgccttcttccctgtgttaacatttgcagtgatatccaaaagcaatgctgattaaaacgttagggtaaccctgagcaatagcaccaaactagtagcaggcattgtgttctttattgtcatgcagtttaaatttgcagtaaaaaaaaaaaagtttcatttaagaatgttcttgatgaagcagtaaaaattaattttatttaatcttgaccttttagtacttggcttttgaatattttgtgtgataaaatgggaagtactcaaaaaacacttctgttatatattgaagtactgtggttgtctaaggaaaagtacttttacagttatttgggtttccagctaactagttgtcttcttcatagaacagcatttttacttgatgaaagaataaccaacaaagtacgttatttagacttgggtatttggcagatgctttcttgaaaattttcaaggaaaacaactatttttgcccagtgataaaattaaagcaaaaatgagaattttggaaagtttatatactccaccatgagacggtccacttcccagttagttttgtggggttttttttttttgatattatgtaatatgtcaaccttcgaaagagctgcatgacttagtgaactagaagttttcacatgaccaatatattatgtgacaaaatcagatttggtgagagatccactcaaagtataaagtagaccaatgtattttaatgtaataatacaaaagttcattgatagggtttcagagttcacatttgctgctaacctttagaaattactgggttgcttttttttttttttttttttggagacagagtcctctgtcacccaggttggagtgcagaggcgggatctcagctcactgcaacctctgcctcccgggttcaagtgattctcctgcctcagcttcccaaatagctgggattacaggcacacgctaccacacccagctactttttcatatgtttagtagagatggggtttcaccatgttgttcaggctggtctcgaactcttggcctcaagtgatccgcctaccgcagcctctcaaagtgctgggattacaggcatgagccaccgcgcctagcctaggttgctttttaaaaattaagttaaatttcacataaacatcaaattaacttttatttattaatttactaattaatttattttttgagacagggtctcactttctcacccaggctggagtgcagtgacacgatctcagctcactgcagccttgacctactgggttcaagtgatcctcctgcctcagccccccaagtagttgggactacaggcacgggccaccatgccctgctaaagaattaaccatttaaaagtgtacaattcaggctgggcacggtgtctcatgcctgtaatcccagcaccttgggaggctgaagtgggcggatcacttgaggccaggaggtcgagaccagcctgcccaacatggtaaaacccgtctctactaaaaatacaaaaattagccagacttagcagtgcatacctgtagtcccagctgctcgggaggctgaggcaggagaattgcttcagtaatatcaaggaaaatatccacgattctaataaatttaagaggctgttaaaaatgcctctttctctggctgggtacagtggcttacacctgtaatcccagcactttggaaggccaaggcagatggatcactaggtcaggagtttgagaccagcctggccaacatggcaaaccccatctctactaaaaatacaaaaaaacaagtggccgggtgtggtcgctcacgcctgtaatcccagcactttgggagactgaggtgggcagatcacaaggtcaggagtttgagaccagcctgcctgacatagtgaaaccccgtctctattaaaaatagaaaaattagccgggcatggtggtgctcacctgtagtcccagctacttgggaggctgaggcaagagaatcacttgaacccgggaggcagaggttgtggtgagccgagatcgcgccactgcactccagcctgggcaacagagcgagactgtctcaaaaaaaaacaaaaaacaaaaaacaccaggcgtggtagcacccatctgtaatcccagctactccagaggctgaggcaagaggggaggcagaggttgcagtgagccaagatcgtgccactgcactccagcctgggcgacagagcaagactccgtcttggggaaaaacaaaaaaaacctctctctagtatcagtatgaaataatgggttctcatatatacacatatacacaggtttgagtatcccttatctaaaatgcctgaaaccagaagtgtttccaatgttggatttttttggattttgggatatttctgtatacataatgaggtatcatgggggtgagactcaagcctaaacacaaaattgatttgtttcatatataccttaaacatatagcttgaaggtcattttataacaacattttgtgcataaagcaaagttttgactgcatttgacagcattttgatgtggaatttttttcacattttgaagtactttggattttttccttttttttgagacggagtctggctctgtcacccaggctggagtgcagtgacgcgatctctgctcactgcaagctctgcctcctgggttcacgccattctcctgcctcagcctcctgagtagctgagactataggtgcccgccaccacgtccggctaattttttaaatttttttagtagagacggggtttcactgtgttagccaggatggtttcgatctcctgacctcgtgattctgcccgccttggcctcccatagtgctggaattacaggcgtgagccactgtgcctggccggattttttcctttttttagtaaaaagtagagacagggtgaccaggtacagtggctcatgcttgcaatcccagcactttggaggccgaggcaggtggatcttttgaggccaggagttcgagaccagcctggccaacatgatgaaaccctatctctactaaaaatacaaaacattagcgctgggcatagtggcaggcctttgtaatcccagctactcagaaggctgaggcaggagaattgctgctggaatctgggaggcagaggttgcagtgagccgagattgtgcctggatgacagagccagacttcatctcaaaaaaaggaaaatgtagagacagggttttgccatgttgttccagctggtcttgaactcctgggctcaaggcatctgccgcctcagcctcccaaagtgctgggattataggtgtgagtcaccacacctggcccaatttggattttctgatgagggatcttcaagtggtacacacatatgcaaatatagatatagaaaaagatatggatgttacgtgtgtatgcatgcattttatttccttttctgaaagggcctggaagtagtgacaccacctagcagtgagcacacctgacaccagatcttggtttcgcaacaccattctccaataagaggaaccagagctgcttggagacatggctagggcagataaaaaaagatgatgaacctggaacatcgtgtggataccagaagctaataaattgccaaaaaagtaatagagaaccagcttgaaggagctttcaatggccagatctgggacagtttgaaaaacaaataatgataaatagattataacccatggggtaaaataaatatccataagtttatgctgctataaataaatatgggaaagaaaacaattgttttctgcagtgaaactcaagttgataaatagaaaaggaataatggaaacattaggcaaatactacagtatttgttgcaggcaagagttgtctttttttttttttgagatatagtcttgctctgtcgcctgggctgtagtgcagtggcactatcttggctcactgcaacctctgcctcccgggttcaagtgattcttccggctcagcctctcaagtagctgggactacaggcacccaccatcatgcctggctaacttttgtatttttgtagagagggggtttcaccatgttggtcaggctggtcttgaactcttgacctcaggtgatctgcctgccttgacctcccaaagtgctgggattacaggcgtgagccactgtgcccagcaagaattgtctttgtatgctaaaattaatatgtggaattttgattggagatgggatatttacacagtggcttctaagtatcttggcttcgtctctactaaaaatacgaaactagccaggtgtgatggtgcgtgcctgtagtcctagctactcgggaggctgaggcaggagaatggcttgaacccaggaggggaggctgcagtgagccaagatggtgccactgcactccaccctgggtgacggagcaagaatctctcaaaaaaaaaaaaaaaaagtatatagtatatatattagtgggaaaactggtgacatgtgaataagatctgtagagtagttaataaacactattgtttcctggtttcaataattgtactgtgtttatatgttaacatttaggggagcagggtgaagaatatttgaaacttctgtaagtctaaaattatttcagaacttagttttaaaacataagtttattaaagactttaaattttttaaaaaagaactcctaccttcctgtgtatctgtgtgagaccacatccacccccaccccgtcccccatgctgttaactagaacaacatcactgcacattgaatgcagaggcagctatgagaatccagctgtctgctattaagccagacattaaagagatttgtaaaaatataaaacaaggccacttttctcactaaattgttctgttattttggaaaatatttttcataaagaagttatgttaacatggaatgggtttatttttaaatgcattaataattttaaaatttttattttcttttatttatttatttttttttgagatggagtctgcctctgtccacccagtctagagtgcagtggcacgatctcagctcaatgcaacctcctccctcccgggttcgagcagttcttctgcctcagcctcctgagtagctgggactacaggtgtgcaccaccacgcctggctaatttttgtactttttaagtaaagacggggtttcaccatattggccaggctggtcttgaactcctgacctcaggtgatctgcccacctcagcctcccagagtgctgggattataggcgtgagccactgtgcctggcctaaaattttattttaattctgtttctaatatggtgactcttttttttgttgttttttgagacggagtctcactctgtcgccaaggatggagtgcagtggcaccgtgttggctcactgcaacctctgtctcctgggttcaagcaattctcctgcctcagcctcctgagtagttaagattacagatgctcaccaccatgcccggcttgtatttatatttttagtagaaacagggtttcaccatgttggccatggtggtcttgaactcctgacctcaggtgatccacccgcctcagcctcccaaagtgctgggattacaggctcacgtgagccaccgcgcctggcctcttatgtgactcttttagttactgctctctttggggtccttgattttatttatttatttatttagagacagggtcttgctctgtcacccaagctggagtacaatggtgcaatcatagctcactgtgacctcaaactcctgagtccagacactcctcttgcctcagcctcccaagcgggtgtcttccataatcattcatgtcagattattttctctgatttgccaaatttatttctaacctcctggttgctaaccttgccagatatattgtagtataataagcagtttggggtctgatatgttctgtttgtttctgtcatgtaaggagatcagtgtggtttcttttggttctatgttatctaagtctcctcttagaaatagtagcgttcccataccacaccgaggtgtgctcttctcaagcccttgtccatacccttttccattctgacagttaattccaacctctaaggtaatcctataaaatggtatattggaggccaggtggcggtggcttgagtctgtaataccagcactttgggagactgaggcaggcagatcactagatcaggagatcaagaccatcctgaccaacatggtgaaaccccgtttctactaaaagtacaaaaatcagctggtgtggtggtgtgcgcctataatcccagctacttaggaggctgaggcaggagaatctattgaacccgggaggcggagattgcagtggctgagattgtgccactgcactccagcctggcgacagagcaagactccgtctcaaaacaaaacaaaacaaaacaaggtacattggaaataatttcacttctttgtagcatcaaaaatgaaaccttttctgtacccattctgcttttctttagggccttttacccccatttgaggaatttgcagtttggtttgtgtgtgtgtataaattcattaggaaactgaaatggagaggttatatccttgggaagtgcagaataattactgggattgattgataataggaagcattagatagcttggaacgagctcagccatctggtttgcattagggcaggttggagatggtgcaagaccattgctatgtgatttttgccagaaactgaaagtgcattttgtttacagtttagaagacaaatcgtctttcattcacctgtacagttgtaagtagaggacacaggcccactaatctcagaagcttggttgagaaataatttatttggatcattatttgctcttttaaaatacatgaattgtcattagagaatatagctaggctgctactggattagctatacttataacattctcacctctctattatgactaatttagtgtacagagctatgaatttttttttttttttttttttttgagacctagtgtcactctgttgccaggctggagtgcagtggcaccatctcagctcactgcaacctccgcctcccaagttcaagcgattgttctgcctctgtctcctgagtagctgggattacagctgtgtgccaccacacatggctaagttttgtatttttgtatagacagggtttgaccatgttggccaggctggtcttgaactcctgacttcagatgatccgtccgcctcagcctcccaaagtgatgggattacaggcatgagccactgtgcccggcctcaaacttctgggctcaagcgatctacccacctcagcttccctaaatgctggggttacaagtgtgtgccactgcaccccgttgagaccgttctaaggtttaaatcattgctctttccctgtcatgtccacctctcagctcttgtttctctaaagagcaaaatgtggttacccttataggctgctgaattcaaattgcctctggtatttttagtctgattatgagaataatctggtaaatacttggtttatatatgtgctagtgtttttatatgttattcttatggcagacaataattgattaaaagtctttacttatgtaacagaatgttccacgtcatcaccatcggtaaaatgtagttggcattggaattgaaagccacttaccatccttggtgtggtagaaggggagtgtcctggtcattagaattagatgtagatttttttttaaattatttgtttttgagatggagtctcactctgtcacctaggctggagtgcagtggcacgatctcagctcactgcaacctccgcctcccatgttcaagcgattctcctgcctcagcctcttaagtaggtgggactacaggcacgtgctaccacgtccagaaaatttttgtattttttagtagagacggggtttcaccatgttggccaggctggtctcgaactcctgacttcaggtgatccacccgccttggcctaccatagtgctgggattataggcgtgagccactgtgcctggccagaattagacgtagattttaatcatgactttcctatttgttgtgtttcttggacaggtttatactaaataagaaattatgtagtatactaaataatactattttttttgaaatggagtgtctctctgtcacccaggctggagtgcagtggcgggatctcggcttaccgcaacctccgcctcccaggttcaagcaattctcctgtcacagcctcccaaatagctgggactacaggcacacgccactgtgcccagctgattttttgtgtttttagtggagacagggtttcactatgttgacctggctggtctcgaactcctgacctcaagtgatccgcccacctcagccacccaaagtgttgggattacaggcatgagccactgtgcctggctgtatttagtatttctgagtctcagttttttcattcatagaatgggtataatatggacttcataggaatgttctgagaattagatacttggttttttgttgttgctttctttctttccttttcctccctccctctctttcatctctttcttttcttcttctctttctttctttcacagggttttgctttgtcacccaagctagactgcagtggcacaatcatagctcactgaagcctcgacctcctaggtttaattgatcctcctgtctcagcattccaagtagctgggactataggcatgcgccattgtactcagctaatttttaaattttttgtagagacaaggtctccctatattgcccaggttggtctagcatttctgagcttaggctctcctcccgcctccacctcccaaagtgctgaaattacacatgtgaacctaaatactgtttttttggttcttagctctcaccattccgataatcagcattcattcagatgttaatccttctcctgtatcccctctcaccaagcccccaatacataccttgttacttgtcttccttttggagtgcactttctcccaactgtcctcagacttgtgtgatgaatgtatcacttacaacatgttttgtctgggaagaagaggctctcaagtatgtgtgtgtgtacaaatttgagatcatgcttttcagagcattgtgaaggatctctgttcaaaactctgctcccctagtgcctattattattacttccatggtataaaggataaaaagaattttttgtttttctttcatataaaaaatattcctaaggaaagcctacatccgttctactttgcatgaagaaaaacaggatttttaggccgggcgtggtggctcataacctgtaatcccagcactttgtgagatcgaggcaggtggatcacaaggtcaagagatcaaggccatcctggccaacatggtgaaaccttgtctctactaaaaatacaaaaaaattacccaggcattgtggcacgtgcctgtagtcccagctactcaggaggctgaggcaggagaattgcttgaacttgggaggcggaggttgcactgagccaagatcgcacagctgcactccagcctgaagacagagcgagactctgtcttggaaaaaaaaaagaaaaacagaatttttatagatgagtactggagaaggttggaaaaatgtagctaactcctattcctttatttaattatgtacttagattgcttactttcctgttgtttttttttttttcttatttctttcttttgagacggaggttcactgtcgtcacccaggctggagtgcattggtgtgatcttggctcactgcaacctccacctcctgggttcaagtgattctcctgcctcagcctcccaattagcttggattacaggcatgcaccaccacgcccagctaatttttgtatttttagaattttgcatttttagtagagacagttcaagaccattttgccaggctggtcttgaactcctgacctcaggtgatccacccgcctcggccccccaaactgttggggtcacaggcgtgagccaccgtgctcggccactttcctgtttttctttgtgaaagtttggagcagtcattcttacagtgcctagtaataaccaggagagagtagtaaaaatgcagattccttagccccacccaaataaatttaatgtcatgaaatagggcctgggaagctgcattttaatttatttttttctcttaaaaaaagtatgccaggcgcagtgcctcatgcctataatcccagcactttgggaggccgaggtgggcagatcacctgaggtcgggagtttgagatcagcctgaccaacatgaagaaaccctgtctctactaaaaatacaaaattagccgggtatggtggcgcatgcctgtaatcccagctacttgggaggctgaggcaggagaattgcttgaacccgggaggtggaggttgtggtgagctgagattgcaccattgcactccagcctgggcaacaagagcaaaactccatttcaaaaaaaaaaaaaaaagaaataaagtagagattggccaggcgcagtggcaaattaacgctttttctaaatactctcaatttctgtgcttatctttttgcagttcatggaactgcagtggtcagtggcccacactttgagtaacattgctcttcagaaaataaaaatgattgtgtgtggaaactggcaagctggaagctagtttcttctacaagccccaagaagactgattttttcgtctataaaattgagacagttttactgctttgctcatctttatagggatgttatgaggatcacataagatataatgtatgtaaaggctgggagtgatggctcatgcctgtaatcctggcactttgggaggttgaggcgggcggatcacctgaggtcagaagttcgagaccagtctggccaacatggtgaaaccccgtctctactaaaaataaaaaaattagctgggtgtgacggcatgagcctgtaacgtcaggtactcaggaggctgaggcaggagaattgcttgaacctgggaggtggagtttgcagtgagctgagatcacgccgctgcactccatcctgggtgacagagcaagactcagtctaaaaaaaaaaaaaaaaaaaaaaaggatataatgtatgtaaaatacgttgtaaactgaaaaactaatgtaagttatattcttcacatttcttgagcaggtactcttttagcaactaggtatatagagatacatggcagggagcttattattcacatgtatattagccacaaggttgcagtatgcggaattgtttctgtatcctaaaaattttcctagacttgtgcagtccttctctaaactttagtgatatgcatatatatatatacacatatatatacatatatacatatacgtacatacatatatacatatacatatatatacatatgtgtatatatatatatatttttttttttttttgaaatggagtctcgctctgttgcccaggctggagtgcagtggtgtgatctcagctcactgaaacctctgcctcctgggttcaagtgattcttctgcctcgacctccaagtagctgggactacaggcgtgcaccaccacgcccggctaattttttttttttttagtagagatggagtttcaccatattggccaggctggtctcgaactcctaacctcgtgatcctcccatcaatcccaaagtgttgagattacaggcatgagccactgtgtccggccgtattttttaaatatataacttaatgatgtttctttgaaatgtctgagaacctttttttcctctttttttatgtatatatttctgatttttaaaataaatagagatggcccggggtgggaggcacagtggctcactatgttgcccaggctggtcttgaactcctggccttaagtgatcctcctgcgttggccttccagagtgctagggttacaggcatgagccaccaacctgggcctatttttacttttctgacaagttcttgaaggttataatatatatatttttaatggattagaagcaatttggaggcaggcgtccttctcagttaaagttctgagactccttgtatatggatccgtttctgttaatcttagattaccctttcttccgacttactctcagcttgaagtttgctgcctgaagtaactccacacactttctctcctctgcctagctcctctttttagagtatgtttgcaggagacagagacctttaaagccagttcattcaacaagaaatgttttgagtgcctgttatatactggttaggtgaaaaagttaagaaaatgggctgggccccgtggtttatgacttggaggccacgatgggaggatcacttaaggtcaggagttcaagagcagcctcagcaacatagcaagacctgtctctaccaaaaattagccatgtgtggtagcatgcacctgtagtaccagctacttgggaggctgagtccagaggatcacttgagtccaggagttggagattgcagtgaactatgattgtgccacggcactccagcctgggtgacagaaagagaccctgtctctcaaaaataattttttttaagtagataagaaaatgaattttaactaccagtggcagtgagtcgtgcctggaatcttaatgttttgggaggccaaggtgggaggatcacctgaagctgggagtttgagaccagcctgggcaacatagcaagacccaatctctgcaaaaaattttaaagttagctggttgaggtggcacgcacctgtagtcctagctcttcgggaagctaaggtgggaggattgcctaaccctaggagttcaaggttacaggaagttttgattgcaccactgcactccagcctaggtgacagagtgaggccctgtcttttggaagaaaaaggaaagaaaatagtttaactacataccattcatgacttctgggtgctcacagttttctaagggaaatggacaagtaattcagtaataagacacagaaaatgacatgtttccaaaattccttgacaggccgagtgcaagtggctcacacctgtaatcccagcactttgggaggccaaggcaggtggattacttgaggtcaggagttcgagaccagcctggccaacatggtggaaccttgtctctactgaaaatacaaaaattagctgggcgtggtggccacacctgtaatcccagctacttgggagactgaggcaggagaatcgcttgaacctggggcagaggttccagtgagctgagatcgcgccagtgcactccagtctgggcaacagagcaaggctctgtctcaaaaaaaaaaaaaaaaaaaaaaaaaaaagaaaagaaaagaaaattccttgacagcacaaagaaaggaaaaattgcctggaggaatggagatagggatgaccatataatttaccctccaaactaggacgctattaaaggtgaaaggaacattgttaatcatcatgagagaataaactgggacatgttctatacaaactaggacatattattactctattcataaaagtaatgtctatggtctttttttttttttattatttttttttgagatggagtctcactctgttacccaggctggagtggagtggtgcagtctcagctcactgcagcctccacctcctgggttcaagcgattctcctgtctcagcctcccgagcagctgggattacaggctcgtgccactacacctggctaatttttgtatttttagtagagacagggtttcactgtgttggccaggctggtctcgaactcctgacctcaggtgatccacccacctgggtctcccaaagtgccggggttataggcatgagccgcctcgcctcgccttgcatggtctttttttttttttgaggtgaagtcttgcagccacccaggctggagtgcagtggtggaatcatggctcactacagactagatcccccaggctcaagcaatcctcccaccccagcctcctgagtagctggaacaacaggcacactccaccacacctgcctgatttctatttgtatttttagtggaaatggaatcttgctatgttgcccaggctggtcttggactcttgagctcaatcatcctacatacctcggcctcccaaagtgctgggagccactgcaccctatatagtcttaaagtaccaccctccgtcttggatttagcacttcatctgtacctttttactgttgcttgcacaggctaaatgctatcctgtctcaagcaacatccttgctgtgacctctacttgttacctcctctcccagatatttgcacagttcacttctgcccttaattcaggacttgctcaaatgttattttttctgacaggactttcctgaccatacttttaagaatagtctcttcccctaccctaacaccactctctgaccccttttcatgtctaatttttttaatgatacttacaaatacataacatacatatatacccacatacatatgcaatttgattgtttctcttttcttttttggagatagggtcttgccttgtcacctaggctggagtgtagtgatacagtcatggctcacttcagcctttacatagacccaagtgatcctcacgcctcagcctcctgagtagccggggctttgtttatgagacatggtctcgctctgttccccaggctggaatgcaatggcatgatctcggctcactgcagccttgacctcctgagctcaagcgatcctcccacctcagcctcctgggtagctgggaccgcaggtgcatgccaccatcctgggctaatttttctattttttgtagagatggggctttgccatgttgcctaggctggtcttgaactcgtgttttttgtagacatggggttttgccatgttgcccaggctgatcttgaactcttgcccaccttggcctcccaaagtgctgggattacaggtgtaagccaccatgcccccagcctgatttctggatttttaactcaataaagggaatgatgatgtctttattataaatatggactataagaagagaaataagttagattggaaggaaggatatcccgtcactctcccataactcaccaggcagaagaaagaacaaccttataggaagggggaagaattcagaactatctagtttgagaccttgatcctattcttgaagtcagccacattttaacattcttgttactgggcctcttctctatttgagagcaattgcatctccagatttctccagttactatattatccttgaattcactgtcaaattatttgtatttcttacaatactaggtaggtgcttcaaaactgaatgatttcaaaagaatcttcacttgacctcttcaatgagatggaagttcttattgcttccagccttcagaaagaaggtcttgttggattatctaattcagagttttaaaaaacattacgtaggggtaaacaggtcttggacctctggctgattgatgtctcctgtggcagaaggcaaactacaaaggagctcttcttcacatgtaagaatggatgatgatttcagcgcttcttgattataaatatcttaaggactcatgttccaggaccattccagagacatctctctctccttttttacctcccactttctaacttgataaggggactatagtgaatatagtgactaagttttacatattttatcaatgtgaaaagtttatcaggtgccactaatttaattagtgcctacagtagaaaagggcatccgttttctatgaagggacactatatcaaaggcaagttataattacacacacacacatttgagagtctccctctgtcgcccaggctagagtgcagtggcgcgatcttggctcactgcaacctccgcctcccgggttcaagcgattttcctgcctcagcctcccgagtagctgggactccaagtgcgcaccaccacacccagctaaattttgtatttttggtggagacagggtttcactatgttggccaggctggtctcaaactcctgacctcaggtgatccgcctgccttggcctcctaaagtgctgggcattgctggtgtgagccactgcgcccggccaatttatatatatatatatatatatgcatatgcatatgtatatttaagttatgctttataaggaattataaagcatactgtttattcctttttacatacaaaaggaagacatagtagtccaggtttcttatctgatatgttttttccccaaggcaaatagggctgtgatgattaacataatcatttcagtcttcagatgaaaccctatcatctgcatgcaaaaaggaatttaatcccttacaagccaacaagtaaccatatccatagtatctggagggctaggctacttgcatttcatactgctcaattaaatgtcatggactgtccatgttctgccacattactttccagttctgagtggtcaagttaaaggcattcttttttctttctttcttttttttggttagttggtttatttattagagatgggggtctcgctatgttgcccagatcttgaactcttggcctcaagtgatccttccacctcagtttcccaaagtgctgggattacaggtgtgtgctaccgtgctcagtagacatttttagaaaaaggaatccattgtgttcagcttatttgttttaatttttttaatcttaaagttttaaatgtttttagtttttaaattttaaattgaaaatatttaagcatatagaaaaatagagtagtacgagcaacagctgtgtaactaccatcttgttcagcagtgaatattttgccatatttgcttggcacataccaatatgctgttgatatatagcataaacattttttctaaaccacttcaaagtaagttttagactttcacctctaaatacttaagattgctgtggtaggcaaaataatgccccttctcccaagatgtctatactccagcccccataacctgtgaatatgttccgtttcatggcaacagagaattaagatggcagatggaattaaggttgctaatcagttgaccttaaaatgtggaaattattctagattatccaggtgggccaatataatcataagggtcctaaaggaggcagaagagtgtcaaagagttggcagtcagaggagtaggcctgatacttgaagatgaggaaagtggccatgaacccagcagagtagattgtctgtagcagggaacagcaggacaatggattttcctctagagactccagaagaaatgtaggagctgactgggcacggtgactcatgcctgtaatcccagcactttgggaggccaaggcggatgaatcagttgaggccaggagttcgagaccagcctgggcaacatggcaaaaacccatctttacaaaaaatacaaaaattagctgggcgtggtgatgcgcacctgtagtcccagctactcccagtcccagaggctgaggtgggagaatcgcttgagctgcaggaggcagaggttgcagtgagccgagatcatgccactgtactccagcccaggtgacagagccagaccctgtgtaaaaaaaaaatatataaaataagtaggagccatactcataccttgaatttagcctaattagacccattttagacttaatgactttctgaatgaaaggtaatacaatttgtattgtgtttaagccactaaatttgtggtaatttattatagcagccatagaaaactaatagtaggctgggctcacgcccgtaatcccagcactttgggagggggaaggtgggtggatcactagaggtcaggagtttgagacctgcctggccaacataggaaaaccctgtctctactaaaaatacaaaaattagccgggcgtggggacacctgtctgtaatcccagctactcgggaggctgaggtgagagaatcacttgagcccaggaggcagaagttacagtgagctgagatcttgcactccagtctgggcaacagagcaagactctgtctcaaaaacaacaacaacaaaaaaaaaaaacaaaaagaaagctaatgctacagttacgtttcaaaaaaatacggacaatctcctattcaaccacaataccattataaccaacaagattaataataattccctaatattatttaatacttagtccatttgaaaatttacccagttccccatagtatcttttgtagctgtgtttaaaccaagattcaatcaaagattatacattatatttgattatgtctgtaagtctctcttaacctagaacagtctgtatcaccacctctttttttttatatcaacttttttgaagagaccgtgctcattgatttgaaatatgttccacattgtagatttgtcagattgtttccatgttaattgtctcaatgcctgcagtgaaaagtttgatccctacggtaaggtaacagcaagattgttccattgttaagatgtgtttttccttttgcaattagtcgtctgtggagttattttgtttatatgaactgaactagttcttatgaaaataaatgttaaatttccagaccagcatattttataatggcagtataatagactatataacctaaaacacttctgctatttcattacaaaacacctagtaatgctggatgaaatgtaacaactattttttaatttttaaacaaacttttaaaaatgtatagctagttgagcctgaaagaattaaggaaaattctcagggactgcaaatgaaagaggaactgaaaatgagcagtatgcatgttacttaatgctgtggtatttctgggtgctttgcctagtctcagttactgaaaggcttggtttttgtttgtttgtttgtttgttttttgagacggagtcttgctctgtcgcccaggctggagtgcagtggcaagatctcggctcactgcaagctccacctcccgggttcacaccattctcctctctcagcctcccgagtagctgggactacaggtgcccaccaccaagcccagctaatttttttgtatttttagtagagacggggttttaccatgttagccaggacggtctcgatctcctgacctcacgatccgcccgtttcagcctcccaaagtgctgggattacaggtgtgagccaccgtgcctggcctaaaggcttcgttttaatgtccatgagccttaggcctgtatggaacagagttagaaatgcaaatctctatataaagcagggagccttgaaggttcatactcaagagaaaggaagggaccacagaaaattccatctactagtttgaggaaacaaggaaacttctgtgtctcagcttgggctctggctgggggtagatgggaatgtctcctgaaaatttatgtttggactcaagaatatacaataaggaaaggatcaatagggcaaggatagtccctccaacaaatgttgttgggaaaagtggatatccacagcaaaataatgaaattatcttgtactgtacacaaaaatcaacccaaaatggattaaagagttaaacataagacctgaaactataaaactcataagaagaaaacagggaaaaagcattatgacattggtcttggcaatgatttcgtggatatgacatcaaaaacacaggcaacaaaagcaagtggaactgcatcaacctaaaaagcttctgcacagcaaacagcagaatggaaaggcaatctacaaaatgtgaggaaatgtttgtgaaccatatatttgataaggggttaatctccaacatatgtaaggaactcatacaactcagtagcaaaaaatatatgtatattaaaaaataggcgcttcactgccgtccgttgatttatttctccaggaagaaaaatggcatctgttgcagttgatccacaactgagtgtgatgactcgggtggtcaacctgcccttgatgagctccacatatgaccccatgtcctcagcccatgtcagtacaaaggaccagtgtcctacttgaagtctgtgtgtgagatggcagggaagggtgtgaagaccatcacctcggtggccatgaccagtgtgctctgcccatcatccagaagctagagctgcaaattgcagttgccaatatccgtgtctgtaaggggctagacaggattgaggagagactgcctattctgaatcagccatcaactcaggttgttgccaatgccaaaggtgctgtgactggggcaaaagatgctgtgacgactactgtgactggggccaaggattcatcacagggttgatggacaagaccaaaggggtagtgactggcactgtggagaagacccaagtctgtgtcagtggcagcattaacacaagcttaggaagtcagataatgcagctcatgagcagtggcttggaacatgcgctcaccaaatcagagctcttggtaggacagtacctccctctcactggggaagaactagaaaaagaagcaaaaaaagttgaaggatatgatatggttcagaagccaagttgttatgttagactgggatccctgtctaccaagcttcactccctgtctaccaagcttcacttcgtatgagcaggctctcagcagggttaaagaagctaagcaaaaaagccaagagaccatttctcagctccgttcttctgttcacttgattgaatttgccaggaagagtgtgcatagtgccaatcagaaaattcaggatgctcaggataagctctagctctcatgggtggagtggaaaaggaatattggatacgatgatactgatgagtcccactgtgcagagcacatcgagtcacgtactcttgctattgcctgcaacctgacttagcagctccagaccacatgccacggccttctgtccaacatccatgatgaccacagaacatccaaggtcaggccaagcatatgagggtgatggcaggcgacatctactcagtgttctgcaatgctgcctcctttgaggaagtgtctgacagcctccacttctagcaaggggcagctgcagaaaatgaaggaatctttagatgacttgatggatttcttgttaacaacatgcccctcaactggctggtaggtccctttcaccctcaactgactgagtctcagaatgcttaggaccaaagtgcagagatggacaagagcagccaggaggcccagcgatctgagcacaaaactcattaaacttgcccctgtcaccagtgaatgatgcggccagccagttaacacctttcgttatgttgaaattaaccctgctaggcaaccctaaattgggaagcaagtagctagtaaaaaggccctcaattatagttatttccagctggattaagagctttaaagtttctggctttagcagatgatttctgttcacctggtaagaaaagaatgctaggcttgttagagcctagccagaactcacaaaaaattcaagtgcacttatgttctcattctgtggccattgtgttaccctctgttactgtttgtgttgaataaaaacatcttcatgcgggctggggtagaaactggtgtctgctctggtatgatctgagcaggcctctttactgatttatctcatgatgattgcttgtacaacttgattttagttttttatttctcaaataggaatactacctttgaattcaatataattcactgtaagattaaaaaaaaaatggacaaaggacctgaatagacattctccaaagaagacataaaagtggccaagtatatgaaaaattgctcaacattgctaatcatcagagaagtacacatcaaaaccacaatgaaatatcatcacttcacacctgtcaatgtcaagatggctattttttttaagtggcaagggagtgaagaaattggaacccttgcacactgttggtgggaatgcaaaatggtacaagcggccactatggaaaacagtatggaggttccttgacatattaaatatagaactaccagatggtctagcaatcatgcttctagatatttatccaaaataaaatcaggatcccaaagagtgacaacatggatgaagcttgaggacattatgctaagggaaataatacagtcacagaaagataaataactatgtgagtctacttatgtgaggtatctagtcagattcataggttgacagagtcaaatggtggttgccaaaggctgagggggaggagaaattggggagttgctaaacaatgtatgtaaaattaatgtcaaacgggaaaaagctctagagatctgccatacaacactgtacctatagtcaacattaatgtattgtacacttgaaaatttgttaagagggtagatcttgtgttaagtgtttttaccacaataaaacaaaaaaaaacttttttttttttgaggtggagtcttgctctgtcacccaggctgtagtgtagtggcgcgttcccggctcactgcaacctccgcctcctaggttcaagcgattctcctgccgcagcctcctgagtagctgagattataggcgcacaccaccacgcctggctaatttttgtttatttagtagagacgaagtttcactatgttggccaggctggtctcaaactccttcacctcaagcaatccgcctgcgtaggcctcccaaagtgctgggattacaggtgtgagccaccgcacctggccaacaaacaattttttaaaaattaagtatgggcttattaggctgagcgcagtggctcacacctgtaatcccagcattttgggaggctgatgtgggcggatcacttgaggtcaggagttcgagaccaccctcgccaacatagtgatacctggtctctactgaaaatacaaaaattagctgggtatggtggcggatgcctgtaatcccagctactcaggaggctgaggcaggaggatcacttgaacccgggaggtgaaggctgcagtgagccaagtttgtgccactgcattgcagcctgggcaacagagtgagactctgtcctaaaaaggaaaaataattaagtatgggcttatttgtgtgggtttaaattattatcaccagcttggtctgagatccccaaactgggaaatgaatataaaaaaattattcaggaccctgtataatacccttggggtaaccagcggaagcatatgtaaagctactctggaggaacagatccacagtttaagccacacaggattctaacagataaaatcccactgaataacccacttgattgtgacaaggctcataatcaaaagtgacaaaaaataagaaaacagctcatttaccatgaataagagtcacagatacactacctctcaggactagatctccagttcattgactatagaccatagaataagtgcatttaaaaggattaaatacagccaggcatggtagctcatgcctgtaatcccagcactttgggaggccaagccaggcggatcacctgaggtcaggagttcaagaccagcctggccaacatggtgagacctaacctctgctaaaaatacaaaacattagctgggtgaggtggcacatgtctgtaatcccagctactcaggaggctgaggcaggagaatcgcttgaaaccggaaggagggggttgcagtgagccaagatcacgccactgtactgcagcctgggtgaaagagtgaaactgtctcaaaaaaagaaaaaacaaggtcaaatttaaaatatatttggaaggtaatgctgatagagtttacagatagaatgcatgtgggtatgagaaagaggaactaagaatgactccaagtgtttggtttgaatagtggtgtcatttgctaagatgtgtaacagtaggggaagaaacaattttggacataagattataaaatgcctgttagatatctgctatcttgtgaatgtttgtccctccaaaattcatgttgaaatttaattgacattgtaataatattaagaagtgggacctttaagaagtgattaagttgttagggctttaccctcatgggtgggattaatgttgttataaaagggcaccctctctttgccatctgctatgttattagatggcaagaaggtcttcaccacatgccagtaccttgatgttaggcttcccaacttctggaactgtgtgccaataaatagccaataaacttctggtcattataaagtgcccaaagctgggtacggtgacatacacccatagccccagctacctgggatgctgaggtgggaggatcatttgagctcaaggagtttggcaacatggagagactccatctctaaacaaaacaaaacagaacacacacacccacatacccctatataaattacccagtctgggggagggggggggtttgtttgttttttgctttgttttgagatgagtctcgctgttgcccaggccagagtgcagtggcgcgatattggctcactgcaacctctgcctcccgggttcaagcagttctctgcctcagccttctgagtagctgggattacaggcacccaccaccacacctggctaatttttttgtactttcagtagggacggggtttcaccatcttgaccaggctgttcttgaactcctgacctcatgatccacccgcctcggcctcccaaagtgcttgaagtacaggcgttagccaccatgcataatggactaagacaacacccaaatggagatgttaggcaattgactacatgaagagagtttcggaggagaatgacagctaggaatatcaatttgagaattagtatataaatgctatttaaaaccatgggaacacttcatttttacagttagaaggtggaaagatgagtagaaactagtgaagactaagaataaaggatcatgagtgtagaataagacccagagatgtgaagtcccaaaagccaagtgaagaaagcagttcaagaaggaaggaagattgagttgataaaatgctgctgaaagttcaaataagataaggattggtaaataattattggacttggcaacatgaaggtaattagtgacctggaaaaaataatctctttatattgagggaataaaacctgaactgaagtggttttaagccagaagaaagagacaatgagtataggtaactcttgaggaattttgctgtagaagggttcagggacatggggcagtgactggaatacgacaggaagtcatgggaagaattttctaaggtgtaagaaatactataccaagttggtatggtgaggggatgattctcaacactggctaaataatagaactaactggggaatttattaaaggatagctgcatgagttcaatggcagactgattaaatcaaatctttgggaattggaccatggtatcagtatgtttgtttgttttacagttactcagatgattctaatatgcatccaaagttgatctgctttggagcagatcagtcaaattaactcgttatataagttaaacagtatatccaacacagttgaaaattaggaacaatagaaattacacagaatgcagcatagatatattaaaaatggaaaatatgaaaaaaagagatgagacatggacagtagaatgagatggtccaagatatatctcataggagttctagggaagggtagagaaaatggagagtagcaacattcaaagagataatagcagaaaatttcacagaatttctaagtatatgaatcttcaaggaaaaaaaaaatagtgaatcctgaaagaataacactaaagacaaagatcttatgaaagcagccaaatagattactgtgaaggaatgaaaattaggccgggctcagtgattcatgcctgtaatctcagtgctttgggaggcctaaagaggaggatcacttgagttcaggagtgaggctgcagtaagctatgattttaccagtgcgcttcaggctgggtgatagagggagactccatctcaaaaagatgtggtcttttttacttatctacagaagtgtgtctagtttctcagctgtaagcattcagaggtcagggactaaatacaataattaagtacaatgttgcaaaaatactgacattaaaaatagaagttccaggccaggcacagtaggtcagacctgtaatcccagcactttgggaggctgaggcaggcggatcacttgaggccaggagttcaagaccagcctggccaacatggcgaaaccctgtctccactaaaaatacaaaaactagccaggtgtggtggtgcacgtctgtaggctcagttacttgggaggctgaggcacaagaatcacttaaaaccaggaagcagaggttgcagtgagccaggagattgtgccatcgcactccaacctgggtgacagagcaatactccgtcaaaataaaataaaatagctttgactgtatgtaacacactaatcatgactaattcgttggaactaaaaatgagataggactgaaataaaaaataagaatttaatagaaggcataaaagagcaagaagggccaggtgcggtggctcacgcctgtaatcccagcacttggggaggccgcagcaggtggatcacgaggtcagaagttcgagaccagcctggccaacctggtgaaaccccgtctctactaaaaatacaaaaattagccaggagtggtggcggatgcctgtaatcccagctactcgggaggctgaggcagagaattgcttgaacccaggaggcggagattgcagtgagccgagatcgcgcgactgcattccagcctgggcgacagagtgagactccatctcaaaaaaaaaaaaaaaaaaaaaagaacgcaaagaacaagaaggggttggacacggtggctaatgcctgtaatcctagcactttaggaggctgagatgggaggatcacttgaggccaggagttcgagtccagcgtggccaatatggtgaaaccccatctctacaaaaaaaatacaaaaagattagctgggcactggtggcacacacctgtaatcccagctactttggaggctgaggcagaagaatcacttgaacctcggaggcagaggttgcagtgagtcaggttcacaccactgcaccccagcctgggtgacagagtgagactgtctcaaaacaaacatagcaagaaggaagcacagaacaagcaaggtaaatagaacagaagatggtagaaataaaactaaatatgttagtgatcatgagaagtgtaaactagtcagttttttagaaatggtttaatggaaaaacaaattcagataaatactgtcgaaaacataaaggtgtagaaattgaaattaacaacgaaaaaaatgttgtaggtaaatattaaccagaaagttaatgtcaccatactaatataagacaaactttaaggcaaaaaaagttattaagggaacagttttggggcggggggggggcggtagtttatagagatagtgtcttgctctattatccagtggagtacaatggtgcaatcatggtaaactgcagtctcaaacaccagagcttaaacaatccttccacctcagcttcctgagtagctggaactgtggacgcatgccaccatgcctggtaatttttatttatttatttatttatttttttgagatagagtcttgctctgtcacccaggcttgagtgcagtggtgcaattgctcactgcagcctcaacctcccaggctcaagcagtcctcccacctcacccccccttgcagccccccgccaaagtagctggaactgtaggcgtgcactaccacacctggctaattttttatattttataaatgtggggttttgtcatgttgcccaggctggtcttgaactcctgagctcatgggatccacccgtctcagcctcccaaagtgctgggattataggtgtgagccaccaccacgcccagcctaatgttttaaattaatggtagagacaggctatcactattttgcataggctggaatttttttttttttcttttttttactgatacagggtctggctctgttgtccaggcaggagttcagtggcttgatcaggctcactgcagcctcagcctcctgtgcttgagcaattctcattgaactgtcttggcacccttgttgaaaaatcaattgaccgtaaatattagggtgtatttctgagtttttttccattgatcacatatctgtctttaagccagtaccacactattgttatatccattgtagttttcatctcagacactggttttcatctctagaagtttgatttgagtctttttgtacatcttccatttctctgcgtaactttttgaaaatatggaatgcagttacaatattaatatctgttttaaagtcattttaattctaacagaattagttctgggtaaatagatttcttctgattgattattcttctcattaggggtcatgttttcttgcctctttgcaagcctgttaatcttttttttttttattatactttaagttttagggtacatgtgcacattgtgcaggttagttacatatgtatacatgtgccatgctggtgggctgcacccactaactcgtcatctagccttaggtatatctcccaatgctatccctcccccctccccccaccccaccacagtccccagagtgtggtattccctttcgtgtgtccatgtgatctcattgttcaattcccacctatgagtgagaatatacggtgtttggttttttgttcttgcgatagtttactgagaatgatgatttccaatttcatccatgtccctacaaaggatatgaactcatcattttttatggctgcatagtattccaagcctgttaatctttaatcaaattccagatattgtgaattttatatttttgggtgctggattatttttattcctataaatcttgagggttgatttgcaattcagttattgtatttgtcaactttgctttttttttttttttttataatttgttaggccagtacttaaactaagcagtacttagtttagggctaaaaattccctagtgctaaggtaggactttcctgtgcactctacccgataccccataaattgagtttttctaatctggctactaagaacaggcactattcctggccccatgtgagttctgggtagtgcttgctccattcctttcatatgtttttttttcccccagtcttggatagtttcctcagtcacatgtgctgatcagcactctgatatcctcagtatttgaggggatcattttgcagatctctgggcttctgagactttctctgcagctttctctgctgtgatactctgtcctttgaaatctggctgccattatctcattatgttctctgctccatctcttcaactcaggagtttctcaggctgtgcctcaatctccctcccctcctgcatcatgtcctggaaactctcttaaggcaataagccaggccagttgtagagctcacttcatttgcttcttgtcactctgggatcactgtccattgttgcctgatgtccattgttttcaaaacccttgtttttatggtttttgtttgggttttttttttttttttttggtggtggtggtggttcttttaggtgagagggtaaatctctggtctctgttgaatcatcttgaccagaagtggaaattgcagcattggttttaacatcaacaaattgatccctaaatgttgaggtggagaatggataactaattgtatattcctgctgtgggattctacacagcagttaaaacaaatgaagtagagctttatgcagttacttggacaaattttaaatataaaaaattgaaggctgggcatggtgcctcatacctgtaatcctggtgctttgggaagccaaggcaggaggatcgtgtgaggccaggagttcaagactaacctgggcaacatgacaaaaccccatctttacaaataacttttttttttgtaaatgtcgcttctcctctagtggctgaggtaggagggtgcaatgaggccaggaatttgaggctgcagattgctaagatggtgcctgtgaatagccactgcactccagcctgggtaacatagtgagaccccatatattagccaagtgtggtggtgtgcacctgtagtcctagctgcttgggaggctgaggtgggaggattgcttgagcccaggaggtcaaggttacagtgagacatgatcacaccactgcattccagcctgggcaacagagtgagatactgtctcttaaaaaaaaaaatgccaggcacagtggcaaaaattagcctggcatggcagcgtgagcctataatcctagctacttgggaggctgaggcgggaggatcacttgagcccaggaagcggaggttgcagtgagccgacatggtccactgcactccagcctgggcgacagcgagactctgtctcaaaaaaaaaaaaaaaaaaggctgggcgaggtggctcacgcctgtaatcccagcactttgggaggccgaggcgggcagatcacctgaggtcaggagtttaagaccaccctgaccaacatggtgaaaccctgtctctactaaaaatacaaaaaaattagccaggagtggtggcaggcgcctgtaatcccagctactccggaggttgaggtaggagaattgcttgaacccgggaggcggaggctgcagtgagccgagattgtgccattgcactccagcctgggcaacgagtgaaactccatctcatacatacatacatacatacatacataaaattttaaaaaacaaaagcaaaaacaatattggaaagaaaaatgaagaacagtacagaagtgataatttctaaaaatatacaaactatgctatatattattaatgattacatgtatatgcaataaacttatttaatatttatgagaatggaaacaacatctgaaggaggagagagggcgagaaagggttgagagtgaagttacacagtgcttcagatttatctaatgttttgtctcactaaaaataggagaccacatagatgactaacaactagtatctaaaatacataaagaactctcaaaactcaacagtaaaaaggaacagcaaagagctcggttaggaaatgagcaaaagacatgaacagaagtttcacagaagagaattacagatggcaaataaacatgtaaaaagaacatcattagccattagggaaatgaaaattgaaaccacaatgaaatattaccacacacctatccaaatggcttaagtaagaaataatgacaccagccaggtgcagtggcacacacttcaagtcgcttctcctctagtggctgaggtaggaggatggaatgaggccaggaatttgaggctgcagattgttaagatggtgcctatgaatagccactgcactccagcctgggtaacatagtgagaccccatctattaaataacagtaataaaaatgacaccaccaaatgctggtgagggtgtgaaaaacctggatttctcatacattgcatctgggaatatatgatggtatagctactctggaaaacagattggcagtttcttataaaaccgaacattcacttaccatatgactcagcagttgcacacttaggcatttatcccagataaatgaaaacttttctacaaaaactttcccatgaatgttcatagcagctgtattcctaatagccaaaaacggaaaacaactcagatgtccttcagtgagtaaataaaccatggtacatccataccatggaatactactcagcaataaaaaggaataaactgttggtacttgcagccacttcgatgaatctcagtgaaattatcctaagtgaaaaaggccagtcctaaaagttacatactctatgattccaactttataatagtttgaaaagcaaacattttagaaatggagaacagattagtggcttctaggagttaggaatgaatgtggcaggagatgggaggggatagggtagatgttgttataaaacagttaacacgagggctccttgaggtgatggaacggtgctgtttcttaactgtgatgatggatacatgaacttacaaatgtgacaaaattgtgtagaactaagtacatacaaatgaatactaataaaatgggaaatctgaagatctgcttattgtatcaatgttgatatcctgctggtgatatggtactatagttttgcaagatgttaccattgggggaaactagataaagggtacatgagatcttctttatctccatctttttttttctttttttctttttttttttttttttgagacggagtcttcctctgtcacccaggctggagtgcagtggcctgatctcggttcactgcaacctcggcctcctgggttcacgccattctcctgcttcagcttcctgagtagctcagactacaggcacatgccaccacgcccggctaactttttctatttttagtagagacggggtttcaccgtgtcagccaggatggtcttgatcgcctgaccacatgatccgctctcctcggcctcccagagtgctgggattacaggcgtgagccaccgtgcccggcctatctccatctttgaaatattttataataagaacaatctcttcagtgtgcacagtaaaattctctgtgaccatttgagacaaatcagaaaaaatagtggaaacataaaaatgaaaattttctgcttattaatatttacttcaaagtttttagattttaaaaagataaactagaacttatgaaagtatttttttaagaatgtattttcggctgggcccagtggctcacacctgtagtctcagcactttgggaggctgaggcgggtggatcacctgaggtcgggagttcgagaccagcttcaccaacacagagaaaccctgtctctactaaaaatacaaaattagctaggcgtggtggcgcatgcctgtaatcctagctactcgggaggctgaggcaggagaattgcttgaacccaggaggcggaggttgcggtgagccgagatcgcgccattgcactccagcctgggcaacaagagcaaaactccacctaaaaaaaaaataagtattttcagcagggcgcagtggctcatgcctgtaaccccagcactttgggaggccgaggcaggtggatcacctgaggtcaggagttcaagaccagcctggacaacatggtgaaacccccgtctctactaaaaatacaaaaaattagccgggcgtgatggcaggtgcctgtaatcccagctactcaggaggctgaggcaggagaatcgcttgaacctgggaggcggaggtagcagtgagacaagatcgtgccattgcactccagcctgggcaacaagagtgagactccgtctcaaaaaaaaaaaaaaaaaaaaaaagaaagtattttcatttctacttaggattttaaaaccaaaacagctttttgtttgagacagaatctcgctttgtcgccaggtctagggtgcaatggcatgatctcagctcactgcaacctctgcctcccaggttcaagtgattctcctgcctcagcctcccaaccagctgggattacaggcacgcacctgccaccagcccagctaattttttgtgtttttagtagagatggggtctcaccatgttagtcaggctggtttcaaactcctaacctcaagtgatctgcctgctttggcctcccaaaatgctgggattacaggtgtgagccactgcacccagccttcaaaacagttttttaaacttactttttatgtgttaaatactaggactgttgtctccttcattataaatactgataacttttcataagtaacataaccatcttatgatcttttagactattactactttaaacttttaagttacattatataactataggcttcactttcatcatttttgagaattagaggttttccaacctagctaacaatttagatttttctgttctctgatgtgatggaagaacaaagaacaaatataaagggccttgtacattgccttgtgaagaccaggtactcctatatatgttaatttattttgttcaccctcttcattcccctatcctctgtctgcctctcaggatcctcttaagtctttgctgcaaatccaggttttggtttaatgttgtcagaaactttacaagcatgaatgtagagctatttcatttggcattcttgtttcttataggagtccaacagcaagtttaaagttggacatttttctttttctgctctagttgtttgacacaactactctcttccttaaactttcttttttttttttttttttttttttttgagacagggtctcgttctgtcacccaggctggagtgaagtgacctgatctcagttcactgcaacctctgcctcccaggttcaagtgattctcatgcctcagccacctgagtagctgggattacaggcatgcaccaccacacccggcaatttttgtatttttagtagagacaagcttttgccatgctggccaggctgatctcgaactcccagcctcaaatgatctgccatccttggcctcccaaagtgttaggattacaggcgtgagccactgtgtccagcctctgccttcttatatactgcttttcatcctcacatttcagtaaagagaaaattcacccaaaggcaaaagctgaagccaggaaataatccttttctctgaccccaaatctaagtcaccaactcctatcaattctattttcttcctctgaatgtaaaagagaaaatatgcacatggtggctcgcatctgtagttccagctactcaggaggccgaggcatgagagtcgcttgaacccgggggcccaggcttcagtgagccatgattgcaccactgtactccagactggatgacagagtgagactcaaaaaagggggaaaaaaaaagaggcagggcgcgtctctttgcagtgagctgagattgtgccattgcactccagcctgggcaacagagcaaaaactccatctcaaaacaaaaaaaaaggcagagaaaatgagttcatgtaaacatccaattatgtatttttgttatatgcacatctttctattggaatgaaattctggaaaacagtaatctagtcgttttccaaaaatctttactcctaatgtctgactttgacacatagtgtatgattaatatttgtggggtggatggatggatagatgtgcagatacatgaatacacagtacttgcttcttaagatgtctggctctgagaagggtgttgtactgtgtaatagattttggaaatgagctagacctgtgttgtaattccagatttactttctaaagctttgcagttgggatacatctcttcccacctgtgaagtagaaacaatactacctacttagtagcttgttgaaaagatttaagtaagtttcttctccaactggaatggagaaaaaaaatatataagtaagaatacgtgataaagtgtccaatagcatgtttggatttaagtgggtggttaagaaatagtatttgttattattaggatcacagaagaaacaaaaaaagattggttaggcattaaaaggcaatatgcaacattcattttacaaaattttcttttttttgcagaggaatatttatgtgataagttttcagtgaatattatttttacagttttataataggggacataatttaactgtagaatttttttttagtatatttacaaagttgtgcaaccatcacaacagtctgttttagaagaacatttccgatcaccctaaaaagatcacgtgtacccttccgtaatcagttatgttggattttgtttttgcaattttgttgtggtaaaatatatgtaacatgaaatttaccatcttaaccatttgtaagtatataattcagtggatttaagtacattcacattgttttgcaaccatcaccactatctacttgcagaactttttcttcatcccagagactctgttcccattaaacaatcacccctcactccccacccctaccttagctggaaacctctattctactgtgtttttttttttgtttgttttgtttttggggttttttgtttgtttttgttgttgttgtttttgagataagggcatcttactctgttgcctaggctagtcttcaactcctgacactcaagcattcctcccacaccagcctcccaagtagctagaattataggcacttgccaccatgctcagccctctattatactttctatctctaggtacctcatatatgtggaaccatacaatatttatccttttgtgtctggtttattttactcgcataatgttttcaaagttcgtccattttacattggattttgagggaggcatggttgtgagtgcataaagttgaggtttatagattagtaaagacaaagagtagccgtggatagattggtcagaattctcaagctatctattaggaaagacttacctcagacattcaggtatctgggttctggtttctcacaacctctgatgggtcagtttctttcttgaatcattaatgtatagtaaggggaaattatttgacttactttcagctgtttgtataattgtcaattcaaggagccaaggtaatgatggcaccccaaactctagctctaggttattgaattttgttgttttgtcatatactatcagtgcacgtgaatatatctcaaaacttagaatactgtagtatatcaacttaaatgtgtatatcttgctatgtgtacttaagagacagggtcttgctctgtcacccaggctggagtagagtggcgcaatcatagctcactgcagcctcaaactcctgggctcaaatgatcttcccacttcagtcaccatgccttttttttttaacttttttaggctgggtgcagtggctcacgcctgtaatcccagcactttgggaggccaaggtgggcggatcacttgaggtcaggagttcaagactagcctggccaacatggagaaacctcgtctctactaaaaatacaaaaattagccgagtatggtggcgaacacctgtaatctcagctacttggaaggctgaggcatgagaatcacttgaacctgggaggcttgcagtgagccgaggctgtgccactgcactccagcctgggtgacagactgtctaaaaaaaaaaaaaaaaaaacaaatttttttttagagatgagtctcccaggatggtctcaaactctcagcctccaatgatcctcttgtgtcactgggattacacacacaagccactgccttactgtgtacttttctaaagtatagacatacctcagagattttgtatgttccattccagaccaccacaataaagcaaatattgcaataaagcaagtcacacaaattttttggtttcccagtgtatataaaagttatgtttaggccagacgcagtggctcacgcctgtaatccaagcactctggaaggctgaggcgggaggattgcttgaagtcaggagtttgagaccagcctggtcaacatggtgaaaccttgtctctactaaaaatacaaaaagtagctgggcatggtggtacgcgcctgtaatcccagctactcaggaggctgaggcagtagaatcgcttgaactcaggaggcagaggttgtaatgaaccgagatcacgccactccactccagcctggacgacagagcaagagtctgtctcaaaaaaataataataataataaaataaaagttatgtttacattatgctgtagtctattaagtgcaataggattatgtctaagaaaacaatgaatacatcttaaataaaaaacactttcttgctaaaaagtactaacaatcatctgagccttcagcaagtcattatcttttagctggtagagtgtcttgcctccatgtggatgactgctcacccattagtgtggtggttgctgaaggttggggtaacctggcaatttttttttttttttgagattacaggcatgagccactgcgcctgcccaacctggcagtttcttaaaataagatgatgaagtttgccacatggattgactctcctttcatgaaagattttcatatagcatgcggtactgtttaataccattttatccacagtagaactgctttcaacattggtgtcatttctttcaaaccctgctgctttgtcaactcaagtttatggaatattctaaatcttctggtgtcatttcaacagtgttcacagcatcttaccaggagtagattccatctcaagaaaccactttctttgctcatccataagaagcaactccttatccattcaaatttttgttttttgtttgttttttaaagagactcagttgtggtctgtcacccaagctggagtgcagtggcatgatcgtagctcattgtagcctcaaactcctgggctcatgcgatcccctcacctcactctcctgagtgaggtgcatgccaccgtgcccaactaatttttttttttattttctgtagagatagggtctcactttgttgtccaggttggtctcgaactcctgggctcaagtgatcctcctgtctcagcctcccaaagtgctgggattacagtgctgggatcccagctgtgccttgcccaggctcccttctaattgtagttttcttgctgtttctaccacttttgcagtcatttcctccattgaaaccttgaacctgtcaaaggtcatgtatgaaagttataatcaacttctttcaaattcctgttagtgttgatagttttaggccgggcgtggtggctcatgcctgtaatcccagcaatttgggaagccgaggcaggcagatcacctgaggtcgggagtgcgagaccagcctgaccaacatggagaaaccctttctctactaaaaatacaaaattagctgggcctggggtggcacatgcctgtaatcccagctactcgggagactgaggcaggagaattgcttgaacctggaaggtggaggtgagctgagatcgcaccattgcactccagcctgggcaacaagagcaaaactccgtcttaaaaaaaagaaaaagaaaagaaaaatgttaatagttttacttcctcctgcaatggtaaataatttccaggaggttttttaaatttttatttttatagagacagggtcttggctgggcgtggtggtcatgcctgtaatcccagcactttgggaggctgaggtgggcggatcacgaggtcaggagttcgagaccatcctggctgacacggtgaaaccccatctctatagcaaaaatacaaaaaattagctgggcgtggtggtgggcgtttgtaatcccagctgcacggaaggctgaggcaggagaatggcatgaacccaggaggtggaggttgcagtgaactgaggttgtgccactgcactccagactgggcaacagagtgagactctgtctcaaaaacaaacaaaaaacaaccaaaaaaaaacataaaaaaaaagagagagagacagggtcttactgtgttgcccaggccagtctcaaactcctgggctcaagtgatcctcccacgttggcctcgaaagcactggaattacttttgtgagccaccatgcttggcctgaaatatattaatatttcttttttcttttttttttttttttttttggagactgagttttgctctcgttgcccaggctggagcgcagtggcatgatcttggctcactgccacctccccctcccaggttcaggctattctcctgcctcaccctcccatgtagctgggattacgggcatgtgctgccaagcctaattttgtatttttagtagagacggggtttcaccatgttggtcagactggtctcgaactcttgaccttaggtgatccacctgcctcggcttcccaaagtgctgggattacaggcgtgagcccccatgcccagcaatatttcttacatagtaagacttgaaagttaaaattactccttgattcatggtctgtagagtggatgtgttagccacatgaaaacaacattaatctccttgttcatctccatcagagctcttggtgactgggtgcattgtcaatgagcagtaatattttgaaagggatcttttttctgagcagtagatctcagccatgagcttaaaatattcagtaaaccatactgtaaacagatgtgctgtcatccagacgtcgttgttccattgagagagtgcaggcagagtagatttagcctaattcttaccttttttctaagtgatggagtcttgctatgttgtccaggctggagtgcagtggctattcacaggtgcaatcatagtgctctacagcctcaaaatcctgagctcaggcaactctgctgccttagcctcccacatagccgagactactggtgtgcactactatgcccagtttatttaacataattcttaagggccttagaattgttggaatggtaaatgatcactgacttcaatttaaagtcaccagccatattagcctctaacaagagagtcagcctgtcttttgaagctttggagcctggtattgacatctctctatgaaagtcttctagtagaaggctattttatctacattgaaaatgtgctgttcacatgggcttatagatgaaaacagtagacactgagtactccaaaaaggggaggaatggagtgggagataagggttgaaaaactacccattgggtactatgttagctatttgggtgatgagttcaatagaagcccaaaccccagcattatgcagtatatccatttaataaatctacacatgtatcccttaaatctaaaataaaaattagaaaattttaaaaagggaaaaaaatgtactgttaatgtgtcacttttgtgggttatctcagctagatcttatggataacttgcgttagcttctacatcaggacttggctactgctgtaccttgtactttggtgttatggcgtgacttcttaaacctcatgaaccagcctctgctagtttccagcttttcttttgcagcttcctcatttctcccagccttcacagaattgaagagagttagggcctgattctgaattacgctttggcttaaaggaatgctgtggctggtttgatcttgccagtgcactaaaactttctccatattgccagtaaggcctttgcactttgccattatttgtgtgtgcattggaatagcacttttaatttccttcaggaacttttcctttgcattcacaacttggctaacttttttttttttgagatggagtcttgctcttgtcgcctaggctggagtgcagtggtgcgatcttggctcactgaaacctctgcctcccgggttcaagtgatcctcctgcctcagcctcccaaatagctgggattacaggcatgtgccacaacacccgactaatttttgtatttttagtagagacggggtttcaccatgttggccaggctggtctcgaactcctgacctcaagtgatcagcccgccttggcttcccaaagtgctgagattacaggcgtgagccactgtgcctggccttgttttcctttaacaaagtatctgcaaagcacaataaagtgaaatgcaataaaatgaggcatggctgtactttttgcgtctaggcgtataatcagttgagtggcagacttttcctactctgcccaacttaccatggtatgtccagttactgctctcacttatatagtgttgattgaactactaaagacattgttaactatagagttagggtagtggtctatagcactccactttctagtccctccatctgaagatatttttcagaggtaaattgggaggtgaagtgtgataaaaatgttctaaagttgattataatgatagttgcacagctctgaatatactaaacatcattgaattgtacactttacataggtgaattgtatgatatgtgaattatatctcagtaaagctattcttttttttttattattttactttaagttctgggatacatgcacagaacctgaaggtttattacataggtatacatgtgccatggtggtttgcagcagctatcaacccgtcatctaggttttaagccccacatgtattagatatttgtcctaatgctctccttccttttgcctcctaccccccaacagacccaggtgtgtgatgttcccccttcctgtgtccatgtgttctcattgttcaactcccacttacgagtgaaaacaggcagtgtttggttttctgttcctttgttagtttgctgagattgatgggttccagcttcatccatttaaactgcaaaggacatgaactcattctttttttatggctgctaaagctattctttaaaaagggagggaattaagaagcattaacccaaaattcagaagtttgggttgtgacttttatctctaaaaggtgtatttctgcctataatcccaagtgctttgagaggctgacgcaggaggatcatttgagcccaggagttccagaccagcctgggcaacatagtgagaccttgtcctacaaaaaactaaaaaattagcccagtgtggtggcacgcgtctctagctactcaggaggctgaggtgtggaggattgttggagccctagagtttgaagctgcaataagctatgattgtgccacttgcaccctagcctgggtgatagagtgagaccctgtctctcaaaaataaaaataaaaaggccgggcgcggtggctcacgcctgtaatcccagcactttgggaggccgaggcgggcggatcacgaggtcaggagatcgagaccatcccggctaaaacagtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaataaataaataaaataaaataaaataaaaataaaaacaggccgggcacagtggctaatgcctgtgatcccagcacttcaggaggccgaggcagacagatcacaaggtcaagagattgagaccatcctggccaacatggtgaaaccctgtctctactaaaaatacaaaaattagctggacgtggtggcacacacccatagtcccagctacttgggaggctgaggcaggagaattgctttgaacctgggaggcagaggttgcagtgagctgagatctcaccactccactccagcctggcaacagaacaagagtccatctcaaataaatacataaatacaaatataataaagggtgtgtgtttcattttttggtcttgttttgtttttgttttgagacagtttcactctgtcacccaggctggaatgcagtggtgtgatcttggcacactgcaacctccaccttgcaggttcaagtgattctcatgcctcagcctctcaggtagctgggactacatgaaagctccaccatgcctaattttagtatttttagtgcagacagggtttcaccatgttggccaggctggtctcgaactcctgatctcaagtgatctacccacctcagcctcccaaagtgctgggattacaagcgtgagccactgcacccggcccctgtttcgttttatttatttttcattgcaactggaaaagaatctttttaatttaattcattcattcattcgttgattctttgagatggagtctcactctgtcgcccaggctggagtgcagtggcgagatctcagctcactgcagcctctgccttctgggttcaagcaattctttgcctcagcttcccaagtagcagggattacaggcgcccgccaccacgcccagctaagtttttatatttttagtagagatggggtttcaccatcttagccaggctggtcttgaactcctgacctcgtgatccaccctcctcggcctcccaaaatgctgggattataggtgtgagccaccacgcccagccctggaatagaaaaaaattttaagtactccatttttacaaatgaaattgaaacttgggaaggtaaaataacttactaaatatttgacctggttaacataagtagcaattttaaactgtgtttctttgacttaaaagattttcttactattttatctttgctgtttcctaccaggacaacaaacctggatttgaaagtgttggagaaaatctaaatctgaatttgcatttagattttttttttgttgtttcctggagagagagcctcgctgtatcgccctagctggagttcagtggtacgatcaggctcagtgcagcctcaacctcctgggctcaagcaatcctcccaccttagcctcccaagtagctgggactacaggcatgtgccaccatgcctgacaaatttttaatttttttgtagagatggggtctcaccattttgcccaggctggtcttgaactcctgggctcaagccatcctcccacctcagcctctggaggagctgacaatacaagttgagccaccatgtccggcctacatttagattttgttagtgtaaaaaaaatcaaagtgaaaagggaagataatgattaattagcttgtcgttaacactttttcttcatgagtaaagaaaaaaatagtgcttcttatcaggctaagcacctgagttcttcattttaaaaagcatcttaaatgtcttcagattttgaatctgctaaccctggtgacatgcagtttacctatataacaaacctgcacatgtacccttgaacataaaataaaagccaaaaaaaaaaaaagattttcaatctgtatccatgtagaattaagggcacgtgtcaacaggccttgcttatgtagatttaagtttacttaaattgctgggttgaatgcccagaaatctcctttaatataaatgttctaggacaatatcaggtaggacatagcttagttaactttgaactttgtgtgtgtgtgtgtgtgtgtgtgtgtgtgtgtgtgtatgtgtgagagagagattcttgttaataacttcaccattccacctttttaaaaatggactatttaagggactttattctgatcttacttgtatttttctttccataggatggatagaatgacagaagatgctcttcgcttgaatctgttgaagcggagcttggacccagcagatgagcgagatgatgtcctggcaaagcgactcaaaatggaggggcatgaggccatggaacgtctgaaaatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggaggtatggctcagttcagctgcctccagggatagggtcgtctcataaagcctgtgaaaatggaatgaattccaatgagaggagggtgtttttcatcctaaagattcttaaaagaagatatatcatcgagtttgaccataaattcattttatttccaaatgaaaccaggtgcctcaaaaactgcttagcctacagagaatcgtagttcttactcttaagagaaaaaatggtcatttctagataaagggggcactagagagctgataggccaaatggaagtgagttaatatataccttcattctaatcttcatggccgtcttaggaggagaaaaatagtctttttgtcagataattccaggagttttaggatgtatttattgtggagtcccagcttttattacatccaaaaacatgggcctagcttttcttgtgtcagaaagcaaattatcttcatgtggtaagtctctgcattcttgctgtatctgtaccacttcccccagctcccccatatacatatacattcacttgtacatgtatgttactctctctttcactcacacatgcaacatgttttcccaggcctttttttctggtgtctttcaaggttgagtacttgaaactgtagagcacacagtaaggagaggtacctggaactggccaatggttgagtctccctgtgcagtgaatcatagtatagataaccctagttggggttttttttttctttttgttttttatgagtttttttggtgcttttttttttttttttgaggcaaggtctcgctctgttgcctaggctggcgtgtagtgagtggcctgataccctggattcaagcgatcttcccccctcaaccccaacccacaccccaccccccttgagtagctgggactacaggcacatcccaccatgcctgtctaatttttgtatttttatagaaacaggtttttgccatattacccaggctggtctcgaattcctgagctcaagtggtcctccctcctcagcctcctaaagtgccggattatggacatgcaccacagcatccagccagttttttttttttttttttttttaagatagggtctcactttgtcacacagtcttgagtgcagtagcatgatcatagctcattgtaaccaccaactcctgggctcaagttatcttcgcgccctagcctcccaagtagctgggactacaggtgtgcatcatcacacccagctaatttttgaatacttttgtagagacagagtctcactatgttgcccaggctggtctcaaactctcagcctcaagtgatcttcccacattggcctcccaaagtgctgggactactgttgtgagccaccacacccagcttataacccaagttgtgtgtgtgtgtgtgtgatggagtttcactctttttgcccaggctgagtgcaatggtacgatctaggctcactgcaccctccacctcctgggttcaagtgattctcttgcctctctactcccctaagtagctgagattacaggcgcgtgcctgcacacccagctagttttgtatttttagtagagatggggtttcaccatggtagcccggctggtctcgaactcctgacctcaggtgatctgcccacctctgcctcccaaagtgctgggattataggcatgagccatcacacccagccaaccctagcttttaaaacattcagtttaggctgggtgcggtggctcacgcctgtaatcccagcactttgagaggccgaggcgggtggatcatgaggcgggtggatcacgaggtcaggagatcgagaccatcctggctaacaccgtgaaaccccgtctctactaaaaatacaaaaaatttgccaggcatggtggcaggtgcctgtagtccccgctacttgggaggctgaggcaggagaatggtgtgaacccgggaggtggaggttgcagtgagccgcgattgctccactgcactccagcctgggcgacagagcgagacttcgtctgaaaaaaaaaaaaaaagtcagtttataaatagttcagaaacagctgatagctgtgagaattagtcttcagtgttgagttgccctccaaatgaccttgctgagtttgttgtaggactcatccaaagcagaatctctaagaagctggactggtggagaatgaagaagaaagaaatggttataactttacacatgttactttctctaccttttgatgtctacttactggtcttgtcccaggattattttttaaaaccatgctccataagcaaacattattcttggtagtaacattaaaaactcttagtaagcggtggctcacacctgtaatcccagcactttgaggccgaggcgggtggatcacctgaggtcaggagtttgagaccagcctggccaacatggtgaaaccttgtctctactaaaaatatgaaaaaattagccaggtgtggtggcacacacctgtgttcctagctacttgagaggctgaagcgtgagaattgcttgaacccagatggtagaggttgcagtgagctgagatcgtgccactgcactccaacctgggcaacagagtgagactcttgtctccattttaaaaaaaagcaaaaacaaccacaaaaaaacctcttaggaaacctcaggcagattccctagaggtcctggaagaggagaaaaatacttgtaagttataggtagtgccagcagaatattatataagtaggttcatttttagattgtttgcaagaaaaggatatgggtgaatgagatcatgaacctgagcaacctacttggcttttataatctctcttacccttctggagcaagtaacttatcccacttcattggggagaaagagttaaagaaatgttaggtggattcttcacattccaaattggaacttttaaatgcatttttctttcctttccttctctttccctttcctgacaaggtctcactctgttgccctggctggagtgcagtgtggcatgatgtccgttcactgcaacctccacctcccaggctcaagcaatcctcgctccttagccacccaagtagctgggactataggcgtgtgcccctgtacccagctaattgttttgtatttttagtagagacgaggtttcgctgtgtcacccaggctggtctctaactcctggactcaagtgatctgcccgcctttgcctcctaaagtgctgggaatacaggcatgagccaccatgccgggcccaacatttttcatagaaactttgttaacactctttttttttttcctgttttcagtcctgctcctgtagacattttgataagatcttattaatggtattggaattgtattatattgcagatagatacagtatatgttaaaaagtcagacttcctgaaaacccaactttttttttttttttttttttttttaaaggcagagtctcgctctgttgcccaggctggagtaaagtggcgcaatcttggctcgctgcaacctccgtctcctgggttcaagcgattctcctgcctcagcctcctgagtagctgggactacatgctggctaatttttgtatttttagtagagatggggtttcgccatgttggccagatggtctcgatctgctgaccttgtgattcacccgccttggcctcccaaagtgccgggattatgggcgtgagccaccacacctagccaaacccaacaatttttttaaaaatgttattttggggtgatttttaaaaatcatttaaagagatgaggtgttgctgtgttgcccaggctgacgtacattggctgttcacaagcactgtcatagtgcactatttcctcaaattcctgggctcaagcagtcctccccacttggcttcctgagtagctgggactattaggcatgggccgctgtacccaacatggggtgatcttttgaaacacaatcctctggaagcttgggactccagatatactgacagctatttccacttagccccgagatgtataagaatgaacaaaactgctgggcacagtggctcacgcctgtaatcccagcactttgggaggccgaggcgggaggatcatctgaggtcaggagttcgagaccagcctggccaacatggtgaaaccctgtctctactaaaaatacaaaaattagccaggcgtggtggcgggtgcctgtaatcctagctacttggaaggctgaggcaggagaatcgcttgaacccaggaggtagagttgtagtgagcagagattgcaccactgcactccagcctgggtgacagaccaagaccttgtctcaaaaaaaaaacaaacaaaaaaacaaaaaaaaaaagcaaaaccgatagattcccagcaaggagaaccatagtttctttgatagtgataaaaagaggaaagggctgggtgcagtggtgcatgcctgtattcccagcactttgggaggccaaagtgggagaattgcttgagggcaagaatttgagctctgtctgggcaacatagtggtacctcatctctaccaagaaaaaatgaaagaatttgaaagcagaaggcaagagaagttcttaacataatagccatgtcataatagcctaaatatcttattttgccatcagttgggcaagttacgatacctgtgaaataaggtatgtatgaaaccaacactactaatgttttagaattctagagagacacagcagttgtctgcttagttgtttttactactgggataaggattaggagctttatagcttctgagaatatgccagactaagtcacaagtgatgtcacaccaagtgggtcttttaataatatctctctaataggtaggagttcatacttaactaccccaaatattgtaaattatatatatgtttaggaaaagagcaaaataatttctctcttggaatgtttaacaaatgaggccagaatcctagttcattagttttttaaaattaagaaatgaggcagggcatggtggctcacgcctgtaatctcagcactttgggaggccaaggcaggagaatcacttgagcctagaagtttaagaccagccttagtaacataaggagaccccttctctacaaaaaatttaaaaactagctactcaggaggctgaggtgggaggatcgcttgggcctaggagattgagactgcagtgagccacaaatgattgcaccactgcactccttcctgggtgacagagtgagaccctgtctcaaaaaacaaaagaaaaaataaatacaagaaaagaggctggacgcggtggctcatgcctgtaatcccagctctttgggaggctgaggcgggcggatcacgaggtcaggagtttgagaccagtctggccaacatagtgaaaccccgtctctaaatacaaaaattagccgggtgtggtggcgggcacatgtaatcccagcaactcaggaggcaggagaatcacttaaacctgagaggaggttgcagtgcgccgagattgcaccattgccctccagccccggtgacagtgcaagactccgactcaaaagaaaaacagagaggctttggctttgccttatctgtgctatctacctaataccggtgtgtttatatctgggaataaaataatcatttaaagttgttctcagatataacttcctgataaatggcatacagttcccaaatctccatccagtaatatctctgtcttggtactgggcagttcctaagcagttaagtggcactcatttgagcaaggaagaattccttaccttagaaataatctgtaatgtatatatccagccaggaccagaatagaaagagcttctaaatgaaaaatcttccagattccaaaattaccggtgttttattttttatttatttttaatttttttgagacagagttttgctctgtcacccaggctggagtgtagtggtgcaatctcggctcattgcaacctccacctcccaggttcatgtgattcttgtgcttcagcctcctgagtagctgggattacaggcgtatactaccatgcccggctaatttttgtatttttagtagagacagggtttctccacgttggccaggctggtctcaaacttttggcctcaagtgatctgcccacccaaaatgacccatgttaatcatagagggggagtataaaggaatatagaaatgagaagtaaatcacgctttaaaaatgaattcaggccgggcacagtcgctcatgcctgtaatctcaacactttgggaggccaaggcaggcagatcacgaggtcaggagtttgagaccagcctggccaaaacggtgaaaccccgtctctactaaaaatacaaaaaaaaattagccaggcgcggtgccgggtacctgtaatcccagctactgaggctgaggcaggagaatcacttgaacccaggagacggaggttccagtgagccgagatcgcgccattgcactccagcctgggcgacagagccagaatccatctcaaaaaaaagaatgcagacactttattcaggcctgttactcctcatatttggggttagagaatgaaaggctcttttctccctctagtggctttttctgtatttctaccttctcagcttgctgtgtctgtggccagcaatctagacaaatttaatagttcacaagatagtcattcttacctttctatcctcctattctatttccttacctaagtttggttgattttagcaactcagatttaccctgttaggaaattgcttattccagtgatcggggttccctgttcaaaagtatccatgtcctggctgggcatggtggctcacacctgtaattccaacactttgggtggctgaggcagcaggatcacttgaacccaggaattcaagactagcctgggcagcatagcaagacccccaccccttacaaaaaaataaaaaattagccaggcacagtggtgtgcacctgtagtcccagctactcaggaggctgaggcggggggaatctcttggggccaggagtttgagaatgtagcaagcaccactacactccagcctgggcaatagagtgagaccctgtctcaaaaaaaaaaaaaaaaaaaaaaaaaaaaaaaaattccatgtgccaacagcaactaggacaagaaaccctgagaagtggacagctagcgatctgtgatcattaagggtttaagttgattgtttaaggccaaaggggaggccaaggcgggagggtcgcttaagaccagcttgggcaacatagtaagaccctgtctctacaaaaagtacaaaaattagccgggcgtagcggcacatgcctgtagtcccagttactcaggaggctgaggtgggaggatcgcttgagctcaggaggtcaaggctgcagtgagctgtgatcgggccactggactccagcctgggtgacagagtgagaccctgtctcaagagggaaaaaaaaaaggaccaaagaacaattgccctcgacctatatactaccaactacgctgacaatctcaaggaaagtaggatctgggaatgtatctttgaaattagaggagaattagaagatacagtcacggatttgggaacctgaggcagttagagtttccggaattcttgttacctaggtcttaagcagtatgtgccattttttatcatcttacacaaataagcatgatgcttttaaggctaaccccagaatgacctaaatgagagttatctagtaaataggattaggagtaagaggagtcagtgcaggagatttagatttcaaagtaatttctagactctttttgaggtaagatgctggataaaactctggtaagtagatgcaagttcaatatatttggttctggaggtttaatccttttctgtaaggctgtagacaatattcttggcactattccctcaaattattaatacttccttcttttgtgtactcttcagtacctactcttgacaggatagactattcttttttttttttttttttgagacgggaacctcgctctgttgcccaggctggagtgcagtggtgcaatcttggctcactgcaacctctgcctcccaggttcaagagattctcctgcctcagcttcctgagtagctgggactacaggtgcgcgccgccatgcgcagctaattttttatttttagtagagacggggtttcaccatgtcggtcaggctggtctcgaactcctgaccccaggtgttccacccgcctcggtctcccaaagtgctaggattacaggagtgagccaccgcacccggccccccttggatttttttaattcagcatagaagttttcttaacttttgttggaaatagcttattttttccctttcttgtctagtgagccagagcgaggaaggctaactccctcaccagacatcattgttttgtctgacaatgaggcttccagtccccgttccagttccagaatggaagaaagactcaaagcagccaacttagagatgtttaaggtaaaaagaaagaaaaatttctttcttcttgttatgctccttctattttatttaattcctcaagagatttagttctgttttttgactatttactctttggatataaatacccattgatgaaaactttatagtaactcttgacttcaagggctttcaaaaggaactattagaagcaagtggagacgacagtttgaaaagcatatatgtaggccattatactcagtgttatttatctttggaaaatgaaaacaaaagttcataattaagtcatataaagtaaactcttggctgtaaggatactttctgcactctaacctaagtaactgaatatgaagggattcctaagtttttatgtatatctagaggaaatgtggctttaagagatttaggaacattattttaaaagaagacaatgtttctctttagtcattcttctttttgccaggaatctggctgattagcatttatacgtggtctgtcctttaattctgtaagcatttctttgagtacctactgaatgccaggcactgtgccagactccagtgatacaaagataatcctattgccacttctgcttcttgtggaagatgaaggtttcagagctaagaagtaaagattgtctcttgcaggaaggaattctgggtaccttgctgccatagctgaaagtcttcttgtttccttaggggaaaggcattgaggagcggcagcagcttatcaagcagctgagggatgagctacgattggaagaagcccgactggtcctgttaaagaaactgagacagagtcagctacagaaagagaatgtggtccagaaggtaatgtgccctagaaataagggactaagggaaaggaaagaaaaactggtttgagagtaggttcccccaggtaggttcagttgggtggctcatttcttctctgggtccgtagttttttagtctgtagtagtagtgattttttttttaatcttaggccttaagaaaaccttgactcccagccaggtgcggtggctcacgcctgtaactccagcactttgggaggccgaggcgggtggatcacgaggtcaggagatcgagagcatcctggctaacatggtgaaaccccatctctactaaaaatacaaaaaattagccggtcatggtggcgggcgcctgtagtcccagctactcgggaggctgaggcaggagaatggcgtgaacccgggaggtggagcttgcagtgagccgagatcaggccactgcactccagcctgggcgacagagcaagactctgtctcaaaaaaaaaaaaaaaaaagaaaaccttgactccctttttctggtttttcctcctgattgacaagaacctcacactgaccaggaatttttaaagtctagaaatgtaccaaatttccacctgtgattattggccacagtcttattttctcttccctctcccagactccagttgtacagaatgcagcatctattgttcagccatctcctgcccatgtgggacagcagggcctatctaagcttccctctcggcctggggcccaaggggttgaacctcaaaatttgagaacattacaggtatgtgacccatagtgggatcttagtgttggagggccgtgtctaatcctgtctctgtttttgggcttttgtgaagattatagaagaacctggccatgatagaggtgttattactactgattgttctgttggcccattatggcatgatttagtcttcagtagaaggatgagtaactttcatgtttccactgtagtttttcttgtctagagaatgcttccagcttctctagagaaggggtagatagttttctatctaaccctataggattagatagtttataccaaaaaaagccaaggacttcccagccactaatcagggtttacaatgatggtagatttatcccatagaccattaaatgaaattaccaagtctggctgtgttcctgtgtttctacttagctatgtattataggcagtgttttcccttttgcattttgtgctgtattatacacagcgtacaacctgtgattagttcttttcctcttcttcccctccagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccggtaagagagagctgagccctaatgtggaaacagagaaatccctttgtttgctttgcttgtcgaaagggccataggttttaagtttttatacatagataaactctaggacaaaaatggttattttggtagggatttaattgagagcagtcccaaaagtagaagctttgaggaattatattaaaatagtagtggaggagagaggttatacagcagagcagcagtaagctaaaaatctgcctagaagagagtgatctagggaataagaagcacaaggatgtgtgacagaaagcaaaatcttatttctgtctcttttttgtttgtttgtttgtttgttttttgagctggaatctcactgtgttgcccaggctagagtgcagtggcatgatcttggctcactgcaacctctgcctcctgggttcaaggaatttccagctaattttgtgtatttttcgtagagacagagtttgaccatgttggccaggctggtctcaaactcctcacctcaagtgatctgcctacctcggcctcccaaagtgctgagattataggcgtgagccaccacgcgtggcctttatttctctcttagcaatgttagctcatggtcatcatcattctcctttcctatgtgtcagagttctttttcaataaataagttgaccacctcctatttttggagaagctaagtagtccaaaccaggatcagacagtgtcctctgccaagaacgtaagaattggccctttctcctgcataccatgattgaccgcattctcaatctatttcagcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggtaaggctgtttcttctaatcaatctatttaagcaagtggttgccaagcctgattgacataggcagagtatcagagggtactgtacaatattaaataacttctccttcctgttaccaaaccacctccctcccttctttacagctgtttgggagcaacatgttagaagcggagtgtgtgtgtgtgtgtgtgtgtgtgtgtgtgtgtgtgtgtgttttgtttgagatgcagtctcgctctgttgcccaggctggagtgcagtggcacaatctcagttcactgcaacctctgcctcctgagttcaagcaattctcctgcctcagcctcccacgtagctgggactacaggcacgtggcaccacacccggttaatttttgtatttttagtagagacggggtttcatcatgttggccaggctggtctcgaactcctgacatcaggtgatctgcccacctcggcttcctaaagtgctaggattacaggcatgagccactgtaccccgtcagccggccggggccagcctgcctatgtatctatctatctatctaatctatcatctatctaatctatctattctattctatctaatctatcatctatctttcggcttgtttttttttcccttcagcaggtcagctatcattgaggcttgatatttttatttggattttatctatcttgtgtgttttttgtaggacagtaagttctcacttaacatcatcaatagtttcttagaaactgtgactttaagtgaaacaactacggtgaagggggtcctcaaataacatcattttattataacattagtaaaaaaaaaaagattgtttttgttgtatgttgtttcacttaaatcatagtctctgagaacctgtcaacaacattgaggactgactgtattttgtttagttcttttaaatggtggctagcatgatgcttgcataatttgataaatagaacttctcttttcttttttttttttttgttttttttttttgtttttttgagacagggtctgaccctgttgtccaggcttgagtgcagtggtgtgatctcagctctctgcagccttgacctcccaggctcaagccatcctcccatttcagcctcctgagtaactgggaccactggtatgcaccaccatgccagtttttttctttgttggtttttttttttttttttttttttttttttttgagacagagtcttactctgtcacccaggctggagtacagtggcatgatcttagctggctgactacctctgcctcttggtttcaagcaattctttttttttttttgagatggaatcttgctctgttgcccaggctagagagtgcaatggcatgatctcagctcactgcaacctccacctcctgggttcaagcaatattcctgcctcagcctcctgagtagctgggattacaggtgcctgccaccacacctggccaatttttgtgtttttcttagagacggggtttcacaatgttggtcaggctggtctcgaactcctgacctcaggtgatccacctgcctcggcttcccaaagtgctgtggttacaggcatgagccactgtgcccggcgcaagcaattcttttgtctcagcttccaaagtagctggaattacagatgtgtgccatcacacctagctaattatttctgtttttagtagagatagggttttgctatgtgggccaggctggtctcaaactcctggcctcaagtgatctgcctgcctcagcctcccaaagtgttgggatcacaggtgtgagccaccatgcctggcctggaacttctgtttttaatgtgagtgtttttgcaacattgtactgaattactgtgtttagtcttctgtgaatgcttacagttgagaaacacacacttacatagataactaagaaagaccttataaaaagctgtaaaccaatactaaaccatactatagagtattaacaacatacagtctagactaactgaagttattaaacttgaatttctaaacaggtagacttctgggaaagcctgccagtaaagtgcccagaggagtcagtattagctataaatagatcacaaagtgaataattcagacactgataactatttaaaactataaatgtatatgacagggataagtacagtctttggtaaggagatattaagaagcaaaagtattggttgagttagagtcctttgactttgaattgacacagtattttcttctcagtgtgatacagtagaaaatcaggaaacatcccagctttatcagttagaagctacctttgttgttgttgttgttgtttgagactgagtcttgttctgttacccaggctggagtgcactggcacaatttcggctcactgcaacctctacttcccaggttcaagcgattctcctgcctcagcctcctgagtagctgggattacaggcgcgtgccaccacgcccgcctaatttttttgtatttttagtaaagacgggttttcactatgttggtcaggctgttcttgaactcctgacctcgttagccgtccacctcagcctcccaaagtgctgggactgtaggggtgagccaccgcacccagccagaagctacatttcttcgacttctgtcctcatttgtaaatgaggatggtactgtctgaattccctaaagtgatactgttataatcagatgaaataaaagtattttgtaaattatagaatatcctttttgtaaagtctctttctttaattcaacagaataaactcctggaaaagatctatttgattaagagaaacagaggagataggaaatgtaaagccactgactatttttgttggtatctaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggtaagaattctgactgctcactggccacctgtcccagtttgttttttccaaagggtcgcgccttctagtttgcaggagtggttcatgtgatccctacaggtccacaggttccctttttgtctccttatcattgtgtcctatttccatttgagcgagtattctgattaagaacatggtaaaatataatggctgaggttaacagaaagggacagaaagcttgggactcttggcttttccatagcactctattctcatcttcattttttcctaaaacaaataatagattttggtgggaggaatttatatttgtgctataaatctctttgaaacagttatttgcagtgcgtgtttgataagaaatgacgaaagaaagagtgaattatgaagtagcccagtgaagagtagtggttctagagtatgtgaacatctcatgtagcagttataggatgagaatatcttagagaaggaaaaatgtgttgggaaactcagatccttttcttcctatttcccactccacccatcagagtcccttgtttgagtagcatcatggactttttggaagatcgggtaggcaggagtcaaaaataaaaccccatttatgctctaggactggtggtaaaaaataaataaataaaaatttttaaaaagagaaaagaaaaagtgataaaataaaaccccagtaattcatcagccttaattatatcagttggttcatcacctccagccaacttcttagagccagctttcctggagaaagagaggaggatcccttgatcattgaagcaagttagctgcttatacccagaaatctcagtgtaccacccccaccaaactcttttgccttttccatattccaccaactagccaacaacattagaggtaagaacacctccaggttttctggttaggaaattgggtgggccaggtgcagtgattcatgcctgtaatcccagcactttggggaggctaaggtgagaggattgcttgagcccaggagtgccagaccagcctgggcaacaaagtcagattgtgtctctgtttaaaaaaaaaaaaaaaaaaggaaattgggtattgggtgctgtcctgctcaatcacctgatgtgatgactcccaacaggaaattgaacagcgattacagcagcaggcagccctctcccccactacggctccagctgtgtccagtgtcagtaaacaagagaccatcatgagacatcatacgcttcggcaggtaaggaactttttgcctgatcctgatttctttagaagatttatcagccatttatcacaatttgtcctttctattgtgggaaatcatagtcttcttctgtactcccttatctttgcccccgcttaacattctatcatatcaaagttgtatccactgtctcctcatcattgcaggctccacagccccagagcagcctccagcgtggcatacccacatctgcccgctccatgctttcaaactttgcacaggcaccccagttgtctgtgccaggtggcctccttggtatgccaggtaagaaggattaatctgaaaatgtttctcatgggtcagctgttagttagtatacagttctgtagcagcccctttaagggaattgttcctttactttctgttctttctttagggcatacactctcactcttctgttactcagcaaatgtttgctaaattcatattaagtgccacccacaatgcactagggttttggtggtgaaaatgacccagatcctaccattatcaatttaacttttaatatcccttcagtagacatgtggttattgatctcttttggccgggacagcagggttaactgttctgtttgaatgatccagggatgcttctgcacaatctgcagcctcaaaatcaaagctgatttaatgattctatctctctgtcttattcatcttcctctcaccactgtttcacttgtctctcccataccatcagaagcatgttcattattcttggtaggaccgaaatttcaggaagtccccttttcctaaagcttaggaatatgagtggggattgaaataaagttgctgtgcagggcgcggtggctcacacctgtaatcccagcactttgagaggccgaggcaggcgaatcacttgagatcaggagttcaagaccaggctgaccaacatggtgaaaccctgtctctactaaaaatacaaaaaattggctgggcgtggtggctcatgcctataatcccagcactttgggaggccaaagcgagtggattacctgaggtcaggagttcaagaccaccctggccaacatgatgaaaccccatctctactgaaaatacaaaaaattagcccggcgtggtggctggtgcctgtaatcccagctactcgggaggctgaggcaggagaatcgcttgaacttgggaggtggggcttgcagtgagctgagattgtgccactgcacctccagcctgggcaacgagcgaaattctgtctcagataaataagcaaacaaaattaattggctgggtgcagtgggtcatgcctgtaatcccagcactttgggaggctgaggccgttggatcatttgaggtcaggagttcaagactagcctggccaacatggtgaaaccccatctctactaaaaatacaaaaaatagccgggcagtagtggcacgcgcctataattccagctactctggaggctgaggcaggagaattgcttgagtctgggaggcagaggtgagcggagatcacaccactgcactccagcctgggtgacagaatgagactgcatctcaaaaaagaaaaagaaagttgctgttgaaataaagctaaccaagtgtgaccagatactggtaaattctgcttcctttccatctccaactctgcagcccgagggtagagtggaagggaatgttatttcctcttttaatacctgccctccacttttgtctcctgggtccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaaacctgaaaaagagaaaaaaaagccctagccatggatattgtgaaactgtgttatgtcattttgtaatgtgcccgtttgtgtatgatccgtgcaaaagggtttctggggaaggggagggggtagggaggcagggctgtggagggtgggtaggggagtgggccgggcccagcacactgagactggcagctgctccaaccccatccctccttagagatgccacctcccccaccacccacccctaatttgtgccttgcctccccaccctggagtagtccctccgggtcaccagcactgccttggcagagcccactccctaccctaacctgcccaccctccctatcccccagcattaggttgatactgtggggaagtgctgggggctgggaggtagccgaggaatggggcagttcccgggggcatcgaaaccaagtattattatgaattgtaattgtatttgcactgtttttttcctctgattgcatcagcatatatacaatatacctatataacaaaattcagtgtcaagctttcttatgcaagggatttcccccaccccacctcctcaaaaaagaaagaacctagtcttatgggcctttgagggtggattgtcaggggatgatagaaaggattttaataagtcatcctgaggaaatttcacctagtgagagccacatccatctgcacagccttaggctgcgtgaaccgaggtgaggctgagctcctgtgaaagccaagacctcctggtccaggactttgtagagtaaaaagaaccaccaacacaaaaggggttgagggggctacaatctggagacctggggtctcctactaacttgctatatgatctttggtagagttaattttctgagtatcaattttcttatctgtgaagtgaagagggggatcatctggccaccaagtttaaaattctatacttctcacctgccaaaaccaaaaaacaacttgaggtgaggaaagtgttgggcccagaaaccagggaggaactgaaagtgactcgcgttgaagtggttatgtgtatgacaatgctcttggagaactgccagtcctctatggttacccttgatttgggagaggcagcagagtcatgtccagggcatcagaccagtgacatctttgcctttatgcctctagtcatctgagggcggggactaggcctcaagccccatctcacagccaaccacagagcccttaagggtggttgacaattgaatgccccaggttggtgctttagttatttactccctttgtgagctacaggatgtgtaacttttcccccatcttggtgataaaataggagagcgcagacacagcccacattttgtctcctttcctcagatttcatctgaaccccgctaaaggcagctgtttcacagtctgtctccttcaggggcccaatttccccacagcctgggctgagtactcctactctcttctttaggttctgggctgataaagcctggagagggtacagggtgatgggtgaagccctggtgaaggtgaaaggatagattggggttggggggtggggagcagggaggtgggatggggaatggccttccctgaatagggtgggtgggaggggaacaagacccttttgcacaactctctttaagtttcctttatttcttttttaactcattctgattttctgcattgtgtttgggaaataaaatgaaaaaactaagaccaatagaaactggttttcaaaaaggcaaatacactcccatctgtttcagatgctgctgagcatttcagcagtgacagattcaaataataagctaatttttggagaaaggattaaaagaaaaaaaaactttgtaatatttatcacttgcaagctatgtttaataaagaaaggaatggtttctaaaa

SEQ ID NO: 64 - DNA, 293802 bp, Homo sapiens; identical to SEQ ID NO: 27

SEQ ID NO: 65 - DNA, 90159 bp, Homo sapiens
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggtaagtgtgatttctcttctgtttttccaggtttggggctagaaggaaatgctcttaacctgaagtgatcctttctaggtagcgttagtggctcttacgttcatgctgatcgccagttttctgtacatgttttaggtctctggaagattccgctgatttttctttctcactttatggcaatgggatttccttaaattggttaaggtcatgattgcctaagagtgtgagcacttttccaccgcgtgtctgtggctgctacacgcgccctgtgcattccgggcggcagtgtgtttcggcccatgatttatttaagttactgccgccttctaaaacccattcgggatccgctttgtttgcagaagcgtctttgctgaggactagcatagctccctgccgggcggctccgctgggagatgttctctgagctctctgggtggtgacactaggtcagggtgcaacaacctgcatgggttttctgcccagggccgcccatgggaaggtcctggtggagcacatttgctgctttcacaagattggagtaactctggtgctcaggatcagggccaagtaaagggtcgctcagtcattgccgtcaagctttcgtctttccaggaacctgaagtctctattggagactttgtcccttggggttgcttaaaggagttgcaggggtcagaggagaagaaggaattgggcatttgggcagcatgctgagtgtctaaggcagggcccctggggctgcagggccagcccatgctgcacagaggtgaggccagtgccgagctgggaggccccgagggctgttctctggcccggaggatgcagggtggggctcgggccctctcttgctgaggatggacacgttcgctgacagtggccagcctgtttggggaacctgtttcaaggggcctactatgttggataatgaacgggtattgaagtatgggtggggtcactgggagggactagggagtggttaaagaaaaatctgcttccacaggaagccccaggagccagtttcgaggccggtgcagaccccaggagcaaacccctctgagcacaggggagtctgctgtgctggatggggaggcagggctgtggccccggctgactggcttctctccccacatacagctcaccccggcgaggaccacagggtgctagagctgcagggtgctcagagctcacggggatggtggatgctcaacctgggatcccccagctccccagggtcccattcttaatgctgtaaaaaacaaccgaaatggctttaaaatcaaagttacattgctcctaagcaaaactatattgaaaactgagtgggtggccgttgatgacattactgggacttctgaggtttttgttgggctaaagataatggaagagatttttggtcagaagccactgatgcagtagtttcctggttttcaaaatgagcaaccaggggctctgagatgcggaattccttgcccaggccagggagcgagtgcctgagatggcagtgaaatccttccccattgaaggagagcagacaagccagtgacggaggatcccaaataactcacatctcgttgggaaaactgctttgggctcactaagactctaccaatgaaccgagaaagaagggaggtggaccgtggggcgggggcatcggttccgtgaccggaataccggggctggccgccctgctcaggccacctcctgggggtggagggcgctgaaggaggggacctgtatgctcttctttctgaagtgggcttgtagctgaggatgaaagcctgggtggggaggcgtggcttttacaaagatcaggatgtaggaacagctgcctgtctggacttctttgtttagggggtttcttgctacccagaggtttagttctctcctttcctcactcatggtcgagagaagccaggaagcagacactgagtggagcagagggcttgggaaggaattccatgttggggtgaagtgaggctgtcctggcttttcctatccaggcattggagggtgtggctacagcacctttctgggaggtggctggggaagcctctagaatgttagcccttggccccgctctttccctgcttggcagggagcgtgttccaccccactatagttgtggcccacaggtgaggggacatgtggcaaatgtccaaacctggggtctgaatgatatttttgatacgaggtaggcacctttctgaaaaattgtctttacttcacacttcattttatttctaaagcattcaggactcagcaaattgcactgactttatcatcagtgccttttgtgatttcctatcctagaacttaatacgtccccgatgagaaagtaggaagaagctcctctcttcagtcgattgttgatttatggttccaatgaggctgctcatcctgaccttagtttcaggaacggaacccatagacctggatgcctaaagccagcttgaaacaagaccgccttctttggaagctttggaagctggcagtgactttttgccagcgaggtttcatttgtttccttgctcagagtgttcagacaactggatcaagcgtagtcttcaccagcggttgatatcacctcccacttatatgtgaaattccatgtttaggacttaaaattcaccggcaagtcgtgaatactattgcgtgacacttccttgcaggcgcagtaacagctttagcaaaaatttttatttgaaagttcagttttgtcactgctctttttggaagaagctgaaaatctgctatctcttgggggaaggattgcaggcggtttccatctgacagggatgttgtgtaccaggcagcttttccaccctgacttacgggagcaaacttttcatggtgtcctggctgcagcaagcaggcagtaaaaaacacatcactgctacataaatagctgacgatttgaggagggacctgacatttaaagaaaatcctattagctctagctaagaaaatgaaagccgcaaaccctccaaattttaaagtgggggagctttaaagtttcctactaattcagacagccatgaactagacaagaatggttatcttcattctcccgtttctagatacagcttctctgtttccactgtaaaacttcagtggaattcagtgtaaaaattcagtgcaaagaaaggacaatcctattctttaaataaaacatgttgcttgccccctctaatgtgtggtcatgaatgtcttatttccagggagtattccacaggtcctgattttgcagagatattcccttcaacaattcactttgttaattttgaaaaatataatttttaatacattctggtcttatagtccattttgggaaagagatgaaattttgagggctgggcactgtggctcatctctgtaatcccagcactttgggaggctgaggtgggcggatcgcttgagcccaggagtttgagacaagcctgggcaacatagggagaccttgtctctacaaaagcgttttaaaaaattaaccaggcatggtggcatgtgcctgtaatctcagctacgaggctgagttgggaggatcacttgagcctgggaggttgaggctgcagtgagccgtgactatgccactgcacttcagcgcctgggcgacagaaccagaccctgtttcagaaaaaaaaaaaaaaaaaaagaaaagaaattttgagttagcacgttcatcctggtctgtttttgaaaaggcagtttggttttctttcctctagagggaggtgtatctctgcgagcttcagaaaaatctctgaagtggtgcctggagtctcccagggtggagtttcagggtttgtagtaactcagtgatgaccatctcagcagagcttgcgggcagttttaggactgatatttcaatacatgattgtcattattatatttattgtggctgttcataataacggaagtgtacatacgttagagctttgtttttcttctctgctcaggtgtaagtgtattgagatgaaattgtgccatcaaaggaggcatctttgttcccaaacaattgcattacaagggtattcagcaaataagacattttataggaagcattttacccatatctaattacagaggtttaaatgaacagtcgggtgcttgagaaccaaagtaggtttgcatattcatgccattgcgtatccctgtagaattaccggattttagaactgtaagggtgctcgtgacatgtcctttgatactttcccctaataatggacaatgggttttaacatacttttaaaaattcacacaagctatgattatgaatgtctcgtcttgaatatttattaatacaaatatatattactgactctcagatttatgtctgttcgcttgagataaccagcattaagactctgagggagacaattctagctcagagcaaaacaaacaaacaaacaaacaaacaaaaaaaacaaaaacctaaccctttggttggtctttgtgttctcatgtttacttaagtttaacaagacctattgtgcatcatggccttgagccctgaggttcagggaggggatatatccctaatgctaaatgacgagttgatgggtccagcacaccaacatggcacatgtatacatatgtaacaaacctgcatgttgtgcacatgtaccctaaaacttaaagtataataataataaaataataaaaaaagagaatacattcttggggaatattaaaaaaatgactaagacatagccccctctcttctggttggcaaacatataatttctgtttggctaattgaaatatcaaaaaaactactaccttggtggatggtttctccacgccctttatgcttcagatgaagaaagagagctcagagaggtatgcccagtgacagggccacagagctagtagcagaattgtctgatgtttccaatatgcagacatcttggaatctggacatttcaagggggacaagcctttaagagtgtattttagggtgccatgtggagaaaggtactcttcccattcccagtcttccttggagtagcctcttttaagttgattcagcagaggagtaactgttgcttaaaaaaatctggaaagaaaaaggagagaagaaaaaaacaaatacgaaaagttctgccaaaccttctcccaaaggcaaattgttagtcttgtaggggtctggctgcattcagcatagtatgatcctactgttctcctgaagtttaaactcatgaattacagagaaacatttgagaattgcaagtggccagggaaaagtacaatgggaaatgtttctgtaaaaccccctgtgtgtgctatacattaggttttcaggaacccagagcatcaggaattggtcactggaaggaagagctcatggctcggtttaatttcaaaattaaaaattgaacagcagctggagttgactcagatctcaagggaaaccattccaggaaactggtttttcacttctggaatcttcattagttgattcagcagcccagggccggtacccagagttagcgccaactcagctaaacccacagccggcccggcggtgcaccagggtgctctgtttctaactggggctgcagaaaacccatcattcatcagagcccagggcaacagatggaagagagcagtcgcaggactatggcctgttcgagcaacaggcaaggagccttcttttacacaaaagggaggctgggagagattggccgaccattgctgacagaggcagtaaggaagtagaatttcccaggttactgcaataaatccagcatggatgatattttatcagatgttccaacttgatttttgaaaaggtttctgttttcaagaatgattttatcttctctacttgattataaattagactagaaaacagacaaaatatctaacttttctctttacaaagagagcacctttcagccactttaatcatttacagtggaacaccacagttttggaaaggtcagtagcaccttagttcattgccaagaaggaaaagacaggaataagtgccaagctccaatttggatccagcagcgtcacgtggcaaggagttggaatggagtgggcatttgtgcaatatttcttgaagcattttctaatgcacctttcttctttaatgttgaaatggaactagtctctgcctgatgtttataattagcagtataagtgcagacaaaatcttgtctggctgccgtatatttcagaatgtggaatgtgttttacatttgcatggtggcgtctagcttttcaaatcacaccagatatggaactttctgcctcatggttattatctgcaatgctaggaatatgttttaaagtaattttttcaaatatctgggtaattaatctggagtttcttaattgcctttgtaatgggaaggagacccacctctgaggagcttggcctaagcctggctgcaggtcggcatattcttacaggtgctctcattcacagagggagggcattggtaggggatgtccaggccttctctttctgcattgctttgttataatccacaagttgcagaacaggtgttgctttgttagattttaccaggaagagttgaagatctcgaatccgctactccatatctaacaaggacccccgtaagtgacaaaggaccccagtaggtgacaaaggaggtctagttaccctgcctgatgagaagagttttaaaatgttgctatcacaggatacacattcagtttgagtcaaacagattattgttctagagtattttcatagaatagaaattcaaaggccaggtgtagtggctcatgcctataatcccagcacattgggaggccagggcaggaggatcccttgagcccaagagtttgagaccagcctgggcaatatagtgagatattgtctctaccaaaattcaaaaaaaattagccaggcgtggtggcgcacacctgtagtcctagctacttgggaggctgaggtgggaggattgcttgatctcaggaagttgaagctgcagtaagctctgatcatgccactgcattccaacctggacaacagagctatactctgtctcaaaaaaaaaaaaaaaaaaaagggaaaaaagaaagaaatgtgaaatccaagttgttaaataaacagtaaaaaaacaaaatttgctatatttctttggaggtttcttggagctcttccaaaacattttcttttgaggattctcctttgggtctttcaaacaccaagagcatattaaattccactctcctcctaccctaattgcaggacttaataaatcctttcttagcttcctccctgaggaaaagaacggggactcctttcccaggattcgtgcaaaaagagagagaaagagtgagaaaaagagaaagaaatggggcgctccttcttgcagtctaggaatgggcgtggcaaaggcaagggtggatgagtgcctcaaatttactgaaatttgactttctatttcacagtcagtgtgcacggctctcccactgtggtctttgactatttccactgctcccattttaaacaggacaattaggaactaacagaagtcccagaacttgataggagggacaggctgattttaaaaagcagtgcttggagaaaaccaaataaatgacttcaaaatggaagctctggatttatttgagtctttgttttcaaactatttccttgtgtgcatgcgtgtgtgtctctttcttaaaaaagatttccagacatggaaaatgaaaaaggttttgagtaggctaaatgaaaactaatttacagaattgcaaaatagcttgggaaatcatattcattggaatatgattgaatatgatttcaggttgaagggccatgtagggcaatctttctgatgaaaggtatccttttaaatttcaaagggatagaaactaaacggaaaaaggcacctcaaatcctttttagaatgaggcagagtaaacaaaaagatgaataatcctaaacagaaagatgagaatgaaaatgtgatgaatgtctcttattgaatctgtttcctttaggacacagaatctaggatgaaggaacagaccccttccagcccaaggatctcaagcagccaattctgagtctttttttcatatttgaaagaatgatagtagacagccgacttccattgacatagaatctgtggtgtgtcaccaccaaggaagtctattttttccccaaaaggcatggggagtttccttgagatctgggccaaatctggcacagcctctagggtttcccggggttcttcccatgagctttggaaatgctaacttgggttagggttctggttctatgttgtttttatctatgtagctttgaacaatcactttgccttgctggggtttcaatttctcagctataaaatggagggaaatcagccatcggatggttgggaggagggcgtgaaatcccacccacaagacagaagcccaggaaacgttaccagcactctcctctctccttcctccgggagggtggtgtcggggaatgagcgcggatggctgcctcattccctcttgttgaagagggcgggtggtcatctggtgagatggtgtttgacatcttttaataatctaaatgaaaaagttctccaaaatttgctgccagggaatttcgtttttttataaatggagactccaggacatgacaaacaatagaagagagttaattgcaaacgaaaatatcagcaaatattcaacagctgggctaggagcccacgagccacaagacctgcttcccgcatgatggcaggaaagtgtgtggggccaaaggcgtttttcccacctgggaattcagctcagtcaaaccatatgggttctgaatcatcagtggagcctggataacgcattgtcctacaggcattatctcccgtccttttcagagctggaagggctcctttccttctcttccctcccctcctcttccctcaatatctggatatattctggataaaataattcctgtgcacagtgtatttatcccattactttgtgttccaatgggaagtatctccactgagggggctactcctccaaagattcacatcttgaaaataaaaatctttacatatgattttcaatgaactaaaagttcattttactcagaatggttgaagtaagtgagtgatgtcttagacttcccggattttattttgtaactatttagattgtattgagcactctggaagatgagaaatgtaattttggaattgctccagagtgagcccactcaatgctttatatgtgacagaatcagtggattcaaaggctttcactgtgtgaggtatgggaatgattaagaaaaccattagcaaaacctgctcaaggcataattcacttgtgctctttgtcaatgctccctgcacaggtgtctgcagctcttcccatcccagactcaacagtgaggagacagctctcatcttatcatgtcctattttttccacctggattacaaagccgaatgctttacaaagagcctctataatactcttgtgttctcattcacaaacaaaaataccacttaaaatcatgcctcttgaacatggattaaacatttaaagtaatcgaactggatcttccagaagatttgcattaaaatttttaattgaagcagtgatgcttaaacttttggggggtgaggagtggcacaactgccttttagaatcacatacaaacatggacccttatctccagaaaaaccctcatccatagatgcaattttgcactcaactgtgggaggatcatagactctttgaatctgttgatcccgtattaaaacattgatctggaccagttacaataatacaggttgttttggaaagaacaggccattttcttagaaagaatctagcaggaagcttacctttgctaaaaaaaaattgacgctcaagcttgatagaacgaatcaagaatagcacatataaaatgtacttttatattattctgaagtgtatatcattatttaattgaggtcatacaaaaaattagatattgcaattgctttttttttttatttgaagaaacactcaggaatgggtctaacagactgtagggaagaaaggtagagcttggtggaaaagtctggaaggttcccagggttgcatgggcttgagggattcctagagagtgaaggggcaaagttggggctgtggcacggtgggggtagggtcaacctaagtggagggaggagaacaggcagtccagcctgtcgggggtccctgagccctgctgtgctgcgaccgggctaaagcttgggagcattatcaaaccacagcacaagcactggagactgctcttctacattgtgttaacatatatccatgtccaaaaggcagtgaccattgcaagggaaaaaaaatcgggctgagcttttgcaatactgccgctatcaccactcattgctgtcactttgttgcagaaaaatatctgttctgttgataactggcctcctgagcatcattagaacagcattcctttctcactgttgatgcatttccaagagactgctgtattgacaggtggttctattttagctgctgagatcatggcttcaagttctcagaatctgaatcacagggtacatttgtttcatcacaggtggtactttttgttgactttctttggaaatccaaagccacatgggtcctggtgttcattcccttgtttgtggcttcatctgtctccatctcaccaatttttggcgggtcaggcctagggcccacactgtgttccgtcttcctcatagctgggccgcaagatttggactccagcttctccctctgggcctgacctcaggcaggaggaatttcacggcaaatccacgggactgagcttcaggtttcctttgcacccacttagctcctgtccttgactggcagcctcaatcactctctgtggctctccctgtacctttgctaagtggtccatctggacactagtctgctgctccattcatggcaaagttacatcactcatcagccggacagactctcctctgctatcaatcttcaggtggcaaggctgagaacattagatcatcctcatccctgatttcattagctgtatggggaaaatggaattcctgtgctacacaacagacaaccatgaagacttgcagagcccatgggggcacctgtggagagaggaagattaagatagagatacaaaagctcaggccttgggtggagccgattccaaagctcagaggatactagtcaaggcagaagccatgtttgcaccaggtctgaatgttcatattagattctttcccactttcatgagactctgatcttctttgccaaaccctaacattttgcatgacatatactcttttcttatttctttccaaatcttatttagaagtaagggcaaacattgtgttatttgaatacagcggcatgtagacacactttaggatgtttagttgtactgttttttcctagtagctcttaaactctatcacacctcaaaaaagagatgctgcacttacatcattcctgttaaattgatggctacattttaggggtagttacccatgcttttaaaacctggcaaatgatatttcctgtcctcatttctattttaattgtggtaaaaaccatataacataaaacatactatcttgactatatttaagtgtacagtacagcagtgttaactatacgcaccttgtgctacaacaaatatctataactttttgatcttgcaaaacagaagctctatacctatgggacagtaactacaactgcctccctcctgacagcccatggccaacaccattctaggttctttttctaagactttgactactttaaataccttcacataaatggaattataaagtaatgcatttgtcttttagtgactggcttatttcacttagcataatatcctcaagattcatccatgttgtagtagataaaaggatttcattcttttataaagctgaataatattccttgtatgtggcatgtataagacttagtataatacagtaggccgtgcacagtggctcacgcctgtaatcccagcacttaggaaggctaaggtggaaggatctcttgagcccaggagttcaagaccagcctgggcaacatggcaaaaccctgtctctactaaaaatacaaagcttagctgggtggggtggtgtgtgcctgcagtcccatttactcaggaggctgagaaggaaggattgcttgggcctgggaggttgaggctgcagtgagctgtgatcgtgacactgcactccagtctgggtgacagagggagaccctgtctcaaaaaaaaaaaattacagtataagtggtgtaataacagtgcaaagtcctaggagaactgtaggaatagcagttaatgaatttaacaaatatttattatacacctacaatgatacagacaggcattttgccatactctgtgctcagagtgtggctgagcttcacagtcctggaagactctttgtttatgataaagcagccttggaaatctataatcaatttcataattgcaaaaaattccattgtgtgtgtatatatacatatatatacttaaccaaggaagaaaaaaacctgtgcactaaaaactataaaacactgttgaaatgaattaatttctttattcatctcatctattgatggacttttaagttgtttccatcttttggatattacaaataatgctgaaatgaacatgggtgtgcacatatatctttgagatcctgttttcacttcttttggatatacccaaaagtgggatagatgaattatatgataattctgttttcagttttttgaggaacattcatacgatggaggctagcctttccccactgtgtagctttgttgaagctcaaagatcatatacatgaggttttatttctgggctctctattctgttccattggttcatatgtctgtctttaagtcagcatcatattgatttcattacaccattttgtaatatgttttgaaattataagtgtgaggtctcaagctttgctattttccaccccttcattctgttaatgtggtgtatcacattgattggttttcatacgttgaaacatccttgcattctagaaataagttccacttggttagagtgtataatccttttaatgtgctgttgatttggtcagctagtattgtgttgagaatttttgcatcagtgttcatcagggatattggtctgtatttttcttttcaatattggccttataaaaatgagtttgggggtgttcctttgtctttaatttttttgagaaaagtttgagaaggattagtgttaattcttccttaagtgtttggaagaattttccaggagagacatctggtcctgggttttttgttttttttttatggaaggtttttgattaccgattcaaccccatactaattttaagtctgttcagaattttttttattgcttcatgattcagtcttggtggattgtatatttcaagcaaatatctattttttttctaggttatccagtttcttggtgtgctattttcctcacttcttacagatctcatgtagtcttgtcagtctttccaaagtcttgtataaacaatttcacgtgcctgatttgctctcatttccccttgctttcttcagggaattgccaaattattcctgatgcaggggatataaaaccaatctgtaagcatttggagttttagaattataagatgaaaaaagtcacatttcaaaatctgacatatacttgatacccagaaagatgtttttgattttcattcacactgatgctgaatgcctttacatgctgtaatctgtgaaacagacttctttttaaccttcaaaccctaacagtgaaatgatgatgaaaactcaatctccctagattatatgtatttcagtttcttaagtcaaatggaatttctaatttaactgtagtctacactatatcatttccaatatcaaataattcttcctgaaactcaatataagaaaaaatgacaatattaactagtgtcatgaaagttcatgctgataatgagattgagtctggtccttcccctgggcttctccggggaaatgtcagtcgtctacccattctaattctctcacttggtcacagggaggcagtgagctccaccatcaagggacatgggtcccacttacagttaatggagtccgagagagcagatatttgcaaacccagtgatctgggctcagtggaggcctgggcaggtggagatgcctttggttgctgcttcagaggagtaagagcttagcaaaattagacatggagaggaatagcccatgaaatgtgtttggggaattctgggttaaatcaagtacagcaggtttctttactttatttttcagaactgctatatattaaggtatattgtaactgttccagaaggaggcttggtattcagcactttccaaactgcgttgctcatggaatgcctgtttttccccttagaacatcgaatggaatgggtgttccatgaaatgtgctttgggaaatgctgatgaatgaaacgttgctggagaatggtagttagagttcacttaccatccattccgcgtcaggcatttaccaaacaggctaccacatgctcctcacagagggctggaagagaggcatggctatcattgttctgtgttatagaggaggaaatggaggctttgagcaagtataccacctgcctgaggtagggtatggtggatccaggatccagatttatctgattccaagcaccttgtctttccccaacatctctggctccttttctgattcctaaaaagcccaaattcaggctggtgaacttgattgaaaagttgctatggaatcgtggggttttcatggagaaataaaaatgttcttcttatcctctcatcttatgaaccctcagtgtggcaggtgctattgagcaccaaggtgtctgaatagttgtgcaccttggccacttattctctgcacccccattttttcctgtaagcatgaggatcagcatctacctctaaggataatgtaaagataaataacacacattatgaaaaattatgaaaaactgcaatgatcacatagtagatgctgaataacttttgataacatggcacccaaaacagcggtttaataacatcctagcctacctgtgtcgccaatggccttgttccccagtactgttacccaaacctctgaaaagggaacccctgaccagagagctcctaactggggaacccctggccagtctgggtaagaagagtcactgacatgcacatcattgcaaaatgaaaatgagcttctcgttcaaatgttttaagaattccaagatagcaacatcaaagcatcaaactgagcatggggcccttcagagcacagggtcctgtgggcagccccgtctgtggtctaagaaaaagttaaaggaaaccagaatcctgcattaaggagaggagaaaaaagatgctgtcctggcaaggggacttcagcctagacagaaagaccctagctctctggaggggtcttaagggagaccccagcccccaagctgatctcttagattggagattggagagtgaagaggctgtcacaagatcttgtggtaggaagaaaaggtgttggcaggggaaaggtctgatggcgcacgctactgagctgaagtgaatgtgaacttggctggtggggcatcatgtgtgcggcccccagaggcgcgtgggtatgggagactctgcatcagggcagttagcctccaggtctggcttcacagtcttactaattaaatcaccccaggctcattccactgtgagattggaggttggcatatggcagattttccttggaggaaaagtgctaaatattaatagagaatatggacaaggcttgacatggtcccagctgctgtggttgggttgcatttggtgtaatttgggcaaagcccgttctctccataaactgaaactttcctctgaggttcttttaaacatgacttacaaacttaagctgggtgtcaaaacctgatgccttgtgcctatgagtgcttttactcctgacccatttccattctgctctttgcttaggaatatgctatttccaaattgctgcgtacatcacttagggaggaaaagaaggtttaattgcatagctttttagctgtggccaaagtaatagtcactagattcaaaaattctcatttatatgtttaatcaaaactatctttcataatggataaatttttcattcattagtaatttgaaaaagaaagagaatattttcagattgtggagaaactactatgaatgcctattttctaaaaatgtaattgtgttctttgaactatgtttaagaatgtccagagaggagagtgagcagtgccattacaggtgacctatgttctgctaacaagaagaggtctgaggtccctttagacagagagctctgcctattcacttctcacttacctattctttaccttcctcccaccttcccaccttgcctcctcccttcctccctccctccttccctctctccctccctccctccctctctctctttctttctctctttctttctttccttctctctttctttctttccttctctcctctttgtttttcttctgcttctttctcttcttctccttccttccttccatccttccttccttccctccttccctccctctcgccttcctttctttcccttcctttccttccttcacttcttccttccttcccttctttcacttcttccttccttcccttcccttccttcacttcttccttccttcccttctttcacttcttccttccttcccttcccttaccttccttctcttctcccttcccttcccttctcttcccttcccttctccttccttccttccctccctccctccttccttccttttatatatgcatatatgtgcgcatgtatgtatctgtatagatttttatctatctatctatctatctatctatctatctatctatcatctatctaactgtctatcatccatccttttgctgctggttcaaagaatgaatcagatacaaagtcttcttggaagtctaaaaaggacgtagaaagcatgggattttgagagattttgcataatgagagtcaaaaactgatcattccctttgccctgttttctcttttaggttcatatttggtgcttagacaaattcaaaatgaggaaacatcggcacttgcccttagtggccgtcttttgcctctttctctcaggctttcctacaactcatgcccagcagcagcaagcaggtaagagccagaaacgtccttgattttgtaaaaaggaatatcattctttgattttagatcttagacatcaggcactgacatagagcttagatatgttcttaaggtagctaagccatttattataggatagtcagataggatagttctaggatttataggccttttcagatactctttatccagtgagagatgacctatttttattaaaacttgggtttggtatcttggaattggcttgaaaatgatttgtttttacattggatgtgaacggaaagtttgtatctcaaatgttttaccacctgaagggactttccacatttctggcattggctggtctctgagcacataaagtagggagaagtcaatgattgagagtaaaaactattttccctgaaaaatacaaagatcaccctctctctctaactccagatgcaggaaggcatttttcatctaggatccttgaatctttaagatttctgtttcccaaaacgaattaaaagcatgggttctaattaactctattaagaatttgatttcagagttttagaaaagtgggaaatgcttcatgcattgcaagctggaaaggactcaggtgggtctccctctccttgacccagagagcttggcctctgagggattcttcctccaggccaggttgctcttagatggagggaagtctagtgtcacttcaatggaagaagaacgtgggttggggcatcaggtcagcctgaggtaagtagagtccagcagcaagcctggctcacagctgcagaagggcacctcctggggccactgacagcctgataccctgagctcccacccttgagggagaactgggttcatctggaaatgagatagataatgtttgacatctatggagacttttctggctctgaaaaatatgcagtaactaatagagtacagtttgttcatgctcaaaaaatctggaaaaaataagtcttttcccttctctacatttacacaagtcctcctcgcttaaagaacatgtatttattatatttatttttcacgcaaattacccaaagcattgggggttagtgaatggaaaatagcaatttttacttttccttttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagcagtatagtgtaaaccaaatttgtttaggaaggctttgcattgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacaggtaatggcaacgccaccaagctacgccctgccctgctgttcttgggagatgagcttggcaactgctggccttaaagcaacagctaggatggcgggtgggccagggaagagatgagtgttcacaggtttaaaaacaaaggtttgatttggaatattcttccatagtcttctccccaagtagggcattcacctacatacaagaagagtctttttttaaacaactaatattttcagtctaaaaaaacccacattctaatattatgatcccacaaaatacctctgccttccttagaaaagaaagcctcagagtggtgaggtgtgcatctgatcaaactcctctatttggtgttgggatctgtttcctttaaggaaagctccctgttggagagtgcgtgaactgagacgggagcgagggcatctgtttttgtgtccagtggactagcagagagcttctctcttctactttacggagttaatttaagagtgttggtagaatcggaattacaagaaacctcagctatgatccagtctagattgattttggaaaaaatttagtcctgaatggttagtgacagccggagctggaggctgtgcatttgggctgtgggtctggtcttcttatttcttctccatgcggtaatcatggctgtgcccacagagactcttctaattctaatggagttgatgagaaccactctggaagtattgagagcacacggacattgcatcgatgtgtcatgtgcagttgcatgtacagagctaattggccgacaggttatttaaccagttaagcctgttagctctccttccagggctaagtgcctaaatggccaatggggaaggaatttgacaagtacaatttcaaactctaccataccacagcaactgtaatgagtgcccagagcttactcatcagcgatgggcagagcagagggacctccccttgttagaaaatgagtccatgcagccatttgatagttggtagcagagaattctgggtggaatgagcaggaaatgagagaggaatccagggggagagttgagctccagaaaggagacacacatgttctctgagatggagggaaggcatgagaaaaggggctgtgtttccaagatattcaggtggataagaggcacattgagagagttcaagttgagttgacatccatcatctcaataaaggagggaagcagtggggcttgggggcttggagggattgaagttatttttgatcagctgctatagggatgtgaagaggggtcacaaaacattcaggaagcaactgctgatttgaagtggcatccagttgctatcagagattacaagtcagtgggtgtctccattagtgtggatccctgcctttctgcagatatctcaggcactcccaggatcaaaggagttcccagaactggaacttgcaaagagggaacaatagagaggacagaagaaaattttctcagtaaggaaatccagagtggtagctagtaaattcctgaaacagcctgccatggtgtcctagctgcatggggagctaatgagagctggaatgggccaggagacctctgaagagccagaggatgagaggccaggtctcggaaggagagtcctggagacagctgagtgtgcaagttggagacgctgctggtgtgtagacagggagacctctgagggccaatcgcggggctggaggagtttccaatggtgctcagtgtggtcctcagatgtgtaggaactatagagagccagccactgcagaaaccagagagggtggtgctcacaaaggttgtccatacagaccttaaagtctggagatgaccacagagtctgcagtgtgaacgcaggctgaacataatgtaactaaatcatgtaggaatgttggagactctcttctgtgtatttagtaggcatgaggaagtggataattctttgaatcaaaaaagaatgagtgggcaaccacatggcataggggaactgatcataggaagcaagatttatgaacagatttttctcctacacttttaaaaatggttaccaccaagatggccactgggacaggaggtaggaggtgaggtgactgatggagagtcagtctcttgtgaatacacatggatggtggggcaggaaaaagagagttgaggcttggaggcacacatcactctacaggaccacatcggagggacagcagaagaattgcaagattgcaatcagaatgctggagcagttgcagagaagcagtaccagatgtcagtttttcataacaaggattcagaaagcaggagctgaagagagatgacccaacatcagcagaaaggaactagctgtcttgagcaggcagaacttgatgaagaagagggtttcagaactagccagctccagggtgtttcagaagtttgttcataaaatggttttcccagtggttactcctgatttcagctttaacggggctggcagtgctgatgcccttacctgtgggtctgcttctccataggaaagagtgagaggcagttcaaacactgcaaagtgttccctgcttccaaatgacaggcctcacccctggcattaccacacaggcatcagtcctgccaaatgacaggaaaagctgggtgtctccaagagcaccccaaaccaaacactcaggttaccaggaaatgacaagagggtatctacaatgaactgcactcctcgctacgatagtctcagtatcattaattccctgatccatcacatttcggaatatcgggataataacaaagacctaccaaaaaatagtgaaaggggctcacgcctataatcccagcactttgggaggctgagacgggaggatcatctgaggtcaggagtttgagaccagcctggtcaacatggtgaaaccccgtctctaccaaaaatacaaaaattagccaggtgtggtggtgggcgtctgtaatcccgggaggctgaggcaggagaatcgcttgaatccaggaggtggaggttgcagtgagccaaatttgtgacactgcactccagtctgggtgacaagagtgaaactctgtctaaaacaaacaaacaaacaaacaaacaaacaaacaaacaaacaaacagtgaaagggaccagtagagaaatggaacatcttttattgacgttttgttatactcacaaaaatagctgagtttgcctttatgtttaaccattatgtaatggacaaacaatgagattaccatagtgaatgctaaatgaaactaccaacatcgtgtgtttccacacagatgataaaacctttgtttttatgccaagaaagcatctctgtcttctagtgtccaagccactagcagcaccagggcagaaaattaatccattcatgtgtcttttctaattaacatcactctgcagttcctcctagtaccacgtcccgctgcatgttccacggcaaaaacataggataataatcttaggaagaacagtacatctctgcttatagttttttggaaagccagttagaagagcattatagagattgctaattagttagggctgcctcttcttactacctgtctgctgggtaacttccccatagagtgttcttgattataaaacacacatatgtgtaaaatatgaacgatcaccactgttgtcaatgaactctactcaaataatcaatctctaatggttgtgtttttaaaaatccctctgtcattctttaaaaaaatgaatatacctgagatataaaacctttattttaaaacaaaagctaaaggtgacagggaggattttggcatcagctttcttttctctgtaaaggatgaagatttttaaaatttgtaaaatatatatacaattttgtgttttacataggaaacaagaatgggaacttgtttttcttaatgaaaggaggcatcacatgagctaagaaaggcattgtgcccacaccagtgagctcgggaaaagagcttccagggatgtcaaaggaaactgtgaattttccttggacactgtaaaacttttctgtagaaaacaccacagaggatgtgatacataaagcatagaagcagaaaaccagacaattttaaagcttttaaattgtgcatagatctgattccttgtaacattaacattggtcattggtccgccttgctgtacacaagcacacatggcccctgtgtgcccttgaggcttcagctctcttgaataacaaagcatgcccttgtatgtcccattattgtgtgtgtaagaggataatgttgttattcagtgatgacaaattatccaacgtgtttctatgactggccactgtagatgttcagtcttttacaagagaatgttcaaggattttccctcagggtccatttatcttatttgcatgactataaatttcaacccaaaagtaagttacaaatggagaagaaatagtgttatcctgcgacttagggatcatttttaaaagcttgactgtattgatcatatttaatccttcttttaaacgtcttgatatgctgaggaagtggcaaatccttccgtgtcctttgaggtcattggtttaggcctgggaaatgttgaggaattttgtggaatttgtggagcctctgtattatgcaatgatgtaggccatttctatggccttctgtgtaattcacaccccctggcaccacactctcttgaagatccttcaggaatcttatattttggctgaacagtggcaaatgctttgggccctaatcaagggcctagtcttatataaaacttttgtgtggcaattactaaaaacacaagatcttaattactgtagcacaacaattatcctactcattgtatcttataagaaggattgtgatagcaatgttgccaggttaatatatttccctatgcaaagaattaatctgcaaatatattgttaggaactttcttgtatattaggaagggaagagggcagttccgaacctggcaatctctgtttcagttcacacaatgagaagagcttgggtaagaatgtaatttcactagagcagaactcttcaattttgtgagacaagctttggatccttttctacagtgagaacaaaaacaattttgttggcacaaggaaacattaattttaaatataaaatgttcactgtcattgaaaagatcagagatcagagtgaatggtcttacctataatattaccatcatttaaaaatgataccctgagtgtagttttctggaatcccagaatataaatagataagctcaagctcacatataatctcttcttgtccctaacacatactcaagttatcaaaaacatcgactagaataattgtgctcctccttgagtttaaatcagccaaatttaaacattcgaactgatgctgtgaaatctctggccctgacttttagatttctcgatccctattcctccctcagggctgctatataaccccgttctcagcatcaggttgggaattctctgtttgccattatgggggagagaagaggtcttggtcagctgtttttctgccctttgtataaccccaggctaattctaatcagggtttattcgatgctcatggtccttctaggtaactagtttaggatgtcataaaaacaaggttggataattatgtcatgaccggtttcatatcactctgcttaacattgttctgcattaagtgactgaatatagaggcaatgacaaaataaatgaacaaaacatcctgcccaatcccagacctgcatttgagttttatgcaactaaacatcatttgagaaaaaagaacaacaaaaatttcatcaaagtattttttacatgaaaactttaaatgtagtttgagttctgattcacgaagttgcatgtacaaggtcattttggtttttaaagaaaagagaagaaacaatagtttctgaaggcatccagcaacatactgggttgaggaatcaccaaatcgtgactctgttttgtagctgtggatttgtataaaaaattattctaatcatttgaggaggcaggagaaatgaccaaaaattagaaatcatctctaaagttttggtaacctactcattgattttccctggtaggtttggtagtggacaattcatgctactacttttccctccaaatttagtggaaatttctagaatatgtacccaagattgtcccctcagaaaagtgaatatgatgtttggaaatttaactatgaggatggcacaaatgaaaaattgctataaatgtcccttttttacaccatgatttctaagaggttgcctcttatccattcagaatgcagaactgaaagagaatttcacattccttcatcaacatgtgttttgtttgcccatatttcgtgtttcttattggtttccaaagaaacatgtcagaacactgaataatgcatgtggtcacttgttctaatgctttcacattttttgcatttctttcttttaaagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaaggtatgtatcctcttctcaccatctgtgtgggagtggggtgttgtgtgtgttggtttacatagacgtaaggtgggtaccagcatgattcgccacgggagaagctgtaagtacccacagtccagtccttccctgatgagctgggtcctggatgtcatgtttgtgatgtcatgtgtgcggaaaaactaaagaccaatgagtgagtgaaagctcttacgagagtatgagttgctgagaaagcgtgcttttaaggctaattcaacaaacctgttgctttgagattattaaacatcaccgtattaactacttataatccagtcttcctaaaaatgggcttgaggggctcattacagttctgagaaagttactccaggactatggcattgagctctaaaagtcagtgttagaagtgtgctcatagacagagtatctttccaaaagcaaagatggagtgagggtgtctcctcaaagtcattttgtgctagggtgctgagagttatacttctgaaggtaagaaataacagtgtaatcacttgatgaaatatttatgaagttttttttttcttgtgcttgtgaagtgtaggagtaattctcctgagtggcaatattaggatacaagctcaaatggagggcctttggcaaaacagccaattggagtggtttaaaaaacaaaaaaaccaaccaagtcacataacaaatatgcacttaacaaacataggaggtatggtgggggcatcaggatgcatagcctcctctaccttttgaactgttttctgagacatcagtcacttttcagacctatcaatttcattacctaggtcaggccaataggatgccatttggtaaatcagggacacagtggcccccaacagtttccagaaacacccaactcacttccagtgttgcttacacactgggatgctctaatgagattagtccttgactataagaccttattcttcattttccttccagagtatgggctcaatgaaaattggtgaatggataccgaggctcctataagactctgattatcatctgcaaccaatcatctaaattttcttgggtgaaataacacattgttacaactcttatttgctaactttataaataaagtctgggtctacaagataaatattgtaataagatactgctttacccattgtatcaattacaattgatcaagggaggttttcctttgataaaggagtgaaaataatttaaaaataaccattttggagaatatgccattgtatgaaattaagagtagaagattttaaagtcttaattaaaaacatcactatctatttatttaaggagctgacctctacttaatagtgccttgctaatcattagttctagttgctgcattcatgtaaaggcaacacaccacatttccttacaagggttacaaaattcacactgagttagattgaacttgcctcaaatgattttaaaccacagcttttgttgtaataaaaattacaggtagaaagctcaggctatggcatctctacttaatctgtgcattggaactgtgaccaggtgatgtagcaagaaaagtatatgtgagtgttgccttctggagaaggctgtgtctggcatttatttaagtttgaaaggtcaattctgtgtggcttagcttttgctgcatacagttttccagcttttcctctcacttgatgggaccataaaattggcccaaatcctccagatgagctaatagagagactagaattttgaaaataatgttctgaatgcaaatggacattgagaagcaatggaaacagtgtacaggactacatgcccggtgcctggagctgctcatgctcattccatcatggtgccgttttgtgactctggcaattaagaaaacaatcaagtgaaaatttatgacctgctgaggtttctctgagcttgcatactattggtgtgcatcccaaagtatagaagcccagagatttccctatgttttgcagacaccgacgatgcaacatggctgtagatgggaaagctggtctctggtcttgggtcttctgtggacctgccatgtgatcctgggcaggtcatgcaacctctctgggtttcgatttcttgaatttatgacaaaggagttgcaccagatgaagatatgtctgtaccaggagaagtttcaactttttaatgaaaatgggcagcacatgacccttgtttcagattttccctagccaagtagagtttcaaccccttgattacaaacatcatgtttaatatcaatgattaacttgtaaatattcaacaaatatccttgactatctggcatgtgccagacactatgccaagcactagagatatggtgctgtttaatgagacagatgtggctgctcgtctgttacaggataatggggaaagagacaataataatataaactagtgaccaggcaaaatattctgagcatgataagttgcattggggcattcaacagggctgtgataggaagactggggaagggaattttagatcaggtggatggaaggccctgagaaggtgtggaaccgaaggcagatgagcatgcggagagcagggggaagagtggtccaggcagaaggaagagcaggaggggtggccctgcaacaagaaggcacttagtcccttcccagaactgtcagaaggcagtgtagctggagcacactggacagggagcctgaggttcagactccctggatgcatggaagctggagaagcagctgctgtagggggatgagaagccacagggagtggagcctgtgggttgggagccaatggcagaggaaggtaggctgtgggttagtggtgggggcaggggctctcctctgagggcttctattttctcagagacagatgaggaggccttggaggcagtggcagagggctgagcagagagcacagccatgagacagtcattctggaggacaggacagccaacttcccaaggaggcatgggaggatggtgggcaggcacaggtctcctgatgggggtctggagttccgagcgtggcatgcaggtaccttgttgtgtggtcttctccaggaatgtccactgcttgggtgatgcatgaggaagactgtgggcctgatggaggctttcaggagagtctgatggaggtgcagggatgaggcatggaggaaaacagagagaggcgtgggaggagggctgaagagggttgtgccatgttggtgaggagtagcaggaccttcaagttcatctcccaacaaggcagtgaagtcaggccctgcagagccacattaaagagataagacagctgtgtttgggttgatatttatgtcaagtggaaggaaatgcgtatgcatccctgacgtggctcacagaagagtcagctgtgagaatcccaaggtttttatcactgggtcagaggagattcatggtgcagcccccagagaaatgaaatgattctgcaaagcctaggtgaattgcgtcagagtcatgaagcaaacataggaattcagttattcttccagttactcaatatttttcagtgtttactatatttggctaagcatggttctaggcatatcatctgtcatgagctcccatgacttgaataaaaatcaaacgtaaatgacctcttacctaatcaaaggggactctgggacagagcctctgggaaccagaggtgcatttcagggttcccagagctgaatccttgttgggtgcaaggagactaggccacttgtttcattagatctagaaggtattccttcccgctggctcatcgggagaacttttagtgatgcagtggtagggggagggaaaacgtgggagggtaggggatgatatttatcttctcccaccccaagagttgtgccattgctggtacttataaagaagaatataacaatctgggccacttggtataggagcaagtagcttctcaggtcattgttatatgagtatttgtctatttttctgtcatgtgtgatatacatagtaaatacatgagtggtagattcatggtatagcatatatggaatttatatgtgtctatatacgtgtatgtgtgtatctatatacatatatattctctctaatggtacaaaggtataagtcttctagagatctacacattagttttatctgcaaagatattttaaatcaaaatgaaggggtagcccagagagacagcatgttctaaattaaatgaaggaaggaaagcccagaatggatgttcataacaatgaccatgaaatattgagaaaaggttcaatgatgttctgcacacattgttacaccagtaggcaactgtgttattgtattaaggacgttggtgcataacatgttacccttctcttagaacatagaccttgtcttgatgctacaggtgagcacccagatgaggcactgctgtcttcatttggcatgtatcagcgattctcaccccaggcatcacgctcccagcttctggtccaaacaactagaaatgaactgcatttcaaaaatgtgttctaggctggatgtggtggctcacccttgtaatcccagcactgtgggaggctgaggcaggtggatcactcaaggtcaggagtttgagaccagcctgaccagcatggtgaaaccccatctctaccaaacaaaacaaaacaaaacaaaaattagccgggcgtggtcgtgcatacctgtaatcccaactactcaggaggctgaggtgggagaatcgcttgaacccaggaagcggaggttgcagtgagctgagatcatgccactgcactccagcctgggtgatagagtgagattctgtcctaaaataaaaataaaaataaaaatatgttctagaaggtagctctgattcttagaaagttcttccttaccttcatcccaaactttgtttcctttgtctgcttttacaaaatcaacttgccatgcaatctatctgatggaatacagtaacagaggactcttttgcaaaacagtccatctcaggtttaatcatttatgttcctctacttcttggaatctctgtcaggtttttgggttaggtgttgtggtcttaacagagttcatggttcttgcaatatgggcagggtgcctgcacatggatacagcagttcacagtcactgtgagacagttatcttattgagatgtttttgctttatggtttgcctttaagttatcactgtcatattacttaggatctttaaaaacaggttttttgttttttttttggagatgaaatctcactctatcacccaggctggagtgcagtggtgcaatcccggcttactggaacctcctccttccaggttcaagtgattctcatgcctcatcctcctgagtagctgggattacaggtgtctgcccccacgctcggctaatttttgtatttttagtagtgatggggtttccccttgttggccaggctggtcttgagctcctgaactcagatgatccacctgcctcagcctcccaaagtgctgggattacaggcgtgagccactgtgcctggccaaaacgcaggtctcttaagtgaaaaatgtttgcggcacttgctggctttgatgctgatttcctttttatacgttttatgttaagtaattctttcgtctgtcaaatgaagacagggaatatagaactgaagagaacagggatgtgcaggctctttcagcttttgcacttgacaatgagcattttgaaatgaagactgtgaggcaaagggttctctgagcagacatcagtggtttctttaattattcaagcaatgacttcactctggccaagttgtgtatttacggcagaagagaacttattgaattttcagtgacagcatacaaaacaggtggctactaaaactaaatttgtttttgtgcaactattttgtaaaaagtactgactgggcagggtggaaggtgagccagctttcctccagcaggtggggaggcaaccataacttatgtgttcattaggacaaattccctttggggtggccctgtggtcacgttggccacagtaaatgagggtgtcctttaaatggagttagctttgttgaaagtcattgttgattgtgcttggtaaggccattctaattgccttataatgttgccacctacagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaaggtatggtggtgatggcttcagacacacaatggggtggtctccaggcagggcctttaagaacaaaacaaaatgaagtgtgtttgtgtttagctaagagacaacaaatgatgaaaacagcagcaacgaacatgatttattccaggtttccttttgcactgggttcaggattgtatggtttacaatgtcatgcaatgaaatttcatataagaaccatatgatttaaaccacaggaccatgggccaccacctgtctttgaagcttctggccgaggaggtcacatctcagttcttatcgcttgtcagatccctgtgttcttctgtttctactggtgatttctgtccagtctcctcctcatcaccaggatgtagctttcctttcctgagttgtccatctacttctaaacagccccagtctgagctgtttagggcacagtgtcctcagcttttaatccctctcttctctctcgttaagggattaccctcaatgggaaagcatattgaatggctaagtgtggagttcaaacctagtggttcttcaaatccctcatttaatatgattgccagtggagagttatttttaaagacattatacagatctatgagctaatgagttgaagaaatacaattcactgcccttaatgaagagaagatgagcatcacagaatgatgctttcccaccttgcagactcgatcactagaggattgcctgatgcaggcatgacccatgctgcctggatgcatgctttctcttcacactccctggtcttctatatccatctctttctctctcttttaaaatttttcttaaaacttttaatccacactttcatagccaaagttcaacttaggatacaattagttgtgaggtctaaattacagtagggcatcagggaagaaataaaaaataaaattttaaaggcacatggtaaatgtgttgggtcaaatacactattttgagaattatactttttattcttgatgtgtataagtttggccaagcctagcaactagtctccttctattttgctgtgtatttacggtcccatcatctcactttgggggaattcccctgttggatgattgcctagcaagactgtgacttcctaataggagaagagtcccagtggagaatgacaaacggggaagtctgaagaagacttcaatatgagaccagcctacttttgctattttttttagccttaaggaactcgttttctcaggttagtgagggctaactgcttctgagctatggatggaagaccctctgtttgtgggtagaggtgagccccagaggatccagccaggcaaacttaaacctggctgggatgagtgatatggactgatgcagcaccttcatagtattcatttttagggaaggagtgtttggtttcaaggattctgatcacttttgttgtctgtaaacattctaactttgatgttgtagctctctttgagccaacttggttttgtaaactcggctaccaatatgtctcacaaacaccagccaccaccagaggaaaatatgcagccatctgccatattttacaagatggacatgctttgccatgctgactttctctgtgttctaaatgttggcatgtgtgcacgtgttgtaggcacacatgataaaactctccgtggttgtgtatgtctcacttttttttctgtgcttcactgcagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccaggtaaacctcccctgttgccgggaactccctctccttcctcagacaccaccctggagggtagtttgccagtctgaactcaagagcactgtggactgtacaaagacaattggctcccttccattgaaatagtttgaatggggacttgagacactgtaccagcaaggctggactctgtctaaagggtgttcacgaaggaaagtctagaacatccagcttatgttctgtccattttgcctcaccctttattcagaaggattttttttcctctaatgactgtgaggattctggagttcgaatccagatttggggatcatggggtggagggagacagagagagatttttcttacatgaatatgccttgggattatttaaacgttgaaattgtatttttacatgatttttaaatgttcaacatctgctgtatctagaaaattatttgttataaaacaaacaaagggtgcatcttcatgcaatggtaaaatggtttctaggggaaggctaacttattattattattgcaaattattatggtggtaagatatggttgtatcagatctaccagtctgctaacatcacacagatgaatggcaagactaaaccaattgaaacctaatcaaaatagttctaagaactgttttaactgagaatgttatttacattacacattgcggtgccatagggcctgtcatctgtgtttcctattgtctcattacaacagattgggaagcattgacaaggagcctgacccacacagcagtaatgggcactattgtgggtcttggcccgtaacctcaaatttaatgatttgatcattcaattacagcagattcatggcaacccagttatctttgagtggttgacccatatcagccccccctttttttttctagagattgagatcaatttttttaagcaaaggtatattaagggccatgttttcaatacttttatttgtaacagtttgaaactgctgtctgttttcctggagcgattgccacctgatgtaagaacacaacccagtggggcttttccctggcttgctttattgaagaagcatgatgctagatgggataggctgttctagttactagctttgcaaatatgcactgatttgaaataggacattttcaagacaagtggtatgaatttgggttttctcttctcttgctggcacagtggtcatcagatgagtttcaccaactcctgttgtcaaatggtgctgggctgaagtcgctttggttcctgttatgctctcgtccctcattgtatcctaatctaccttcattgcagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccaggtatggtagagaaatgctagttgctctgccactcagttctctaatgcatgagttgagggtaggctgctggccactggtccttagatagaagccctccttgagtttacaggaaaggtggaaaattaatcacctgctggtttcagcaggaacaatagaatatgagatgtccctccttactttgattctctagctgctctctcaggagaatgagggtgagtatttttaagggcattagattatttcatagtaagacatgttataaagatttagatatcagtggttaaaatccttttttaaaaacagtttttatggtatgcataataaaagccatatcatatggttacattgtacctaaaacagccttcatcttcatattcacccaatgcctttatattgttataattccttcattacattcattaaaaattaaaggagtagaagaggtagataactttccaccataaactctgcattaaaatcccccaactgctaattgacactgccatgacttttcatttaacccctttaatttagtgataaaaatgcagtgaagagagtaatttcccctgtatgccttttgatgaaaaatgaagactccagagcctctcctttgattactgggcccattggccgttggcttgggatggtaactccgacatctgggttccgtttcctcccattaacccacttgtgacttgcagcaactcaattgaaacctcccatcgataaaatgctagtggttgtgcaggtgctgccatctcatgtctctcctcccatcccaagttttttcttgaatacatctttgaaagctaacaatactcttcaagcattgaaaagttccaaaataaaaggggtccctatattggtgtattagtttcccattgctgttataacaaagtaacacaaatttagtggccaaaaacaaaacaggccgggtgcggtggctcacacctgtaatcccagcactctgggaggccaaggcgggcccattgcctgaggtcaggagttggagaccagcctgaccaacatggtgaaaccctgtctctaccaaaaatacaaaaattagctgggtgtggtggcgggtgcctgtaatcccagctactctggaggctgaggcagaagaatcacttgaacccgggaggcggaggttgcagtgagctgagattgcgccactgcactctagcctgggcgacaagagcgaaattctgtccaccccccgacccctccactgcaaaacaaaaacaaaaacaaaaacaaaaatccttattatctgacagttttgaaggctggaaattggaaaccagtgttgctaagctaaaatcaaggtgtcaacaggctgtgttctttctgcaggttctaagggattcttcatctgctcaccttttccagcctccaggggctgcctgcattccttgcctcctggccccatcctccatcctcattgccagcagcttggcactttctctcctctctgacttctgtttccatccttacatcttctctctaactctgaccctcttaccccctcttataaggacacttgtgattgattacattgggcccacctggctaattccagggtaatccccccatccccaaatccttacctgaatcacatctgcaaagtccttttctcaagttcggggatttggacttggacatccctgtgatgctcttatgcagcccacctcgttgatatgaaattgctgctctgatgtcctgtgtgagttaccaggctgtcctcctcccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtacgcagggaactctttgcatcctcactcagtgtcattgtctggggctacttgtctggactgtgggccacaaggtgttctcaattttgcttttcctgccatgtgaagtgaaaactaaaattacaggaaaatttaggaacccacatgccctttttggcctcgatgggcagaaatggcagaggttcaaggggggagatgctaagattcatgttttggggcaaattaaattctccaaaagggacatatgtgcagcttggaattcaggactccttaactttgcatgaaagcttctgtctagatatccaaagggaggggccgtctaactgataacgcctgttgcgtatcagtcctgcgacccctggtaggtttggtcagcagccttctgtgaggcaggaaggagtctgaccagggacactctgcaagctgggacatagactctgaaatattggtatctccagagccaaggtgtgaagataattttgactttgcttggtgctgagaagtgtcttaactggcaggaaggccacctggctcttatgaccatagtttattctattttctttttcctgttccctctttctaggcctggtacaataaactaaaaaatggtgggagccctggtgctgagaaggaaggaggaaagatatatctacctctcaataaatgtcctccaagggccactctcccgggtcactcgggtggggggggttcacagtggcgaaggaggcagatgcggccttgctccctcatatgcactcacttgcctgctcttccaagaggagagaaaagaaggaaagttggggaggagcggaggaaggagtaaaagcaagtgaaaggaaatcactgcaggatacagtgggtgatgagggaggtgaggatgattatttgggtgcaactgagaggggcttggtttctcctcgctggtgcctggggaagagagcagtgtggcccaccaggtttctgtgggatgttcctgagcatttatgatcaggtaaatttgggcaacagtgggataaacaaagtgaaagaggctttctttcttcctaactaaggcgctttgtgtgtctccaacacaagaaaggaaatgcaacatttccaaaatgtatctgcctgcaggaggcctctgtgatgctgtgtcttggccccagattgccgaggatggactttgggaatattgtcacagtgcgggtgcagcttctgttgtcaggaacgtacatttccacaacgctgtggctctttgcccactcactctcctgcgctccagaacagcctccctctttcccccttctccccattcggaggcttctctcacacctctcctgacccacctgactctcagctggtaatcttgagtcctatttctccaagaaaatgcaagtaaacccaaagagagctgtccccggccacgtcatcccgtggttccttgggtggcctgtctccgcttcctcagctccctttcctctcacctgctcagtggcaccatctgcagttccctttcttgctcttgtgtcaccctttctccactgtgctggatggttccatccatgataaaatgcattgcttcttctctcttaaacaccctctctgatgcgccacttcccctgccagcagcacctgtctcctaaagacttatctatactctaaagttcctttcctcccatcctctctgagcccaccctactttgtcattcacccttgctcctcccccaagtgctccagttgaggtcactccatctgacaaggtccctgtctctggcgaagcccagtggctgaccctcgggtccctgagcagcacctgatgcagtgcaggtcacgtccttcccaagtaccatcctcgctggtgctgatgaggctcttctgattctgcctccgtcgggtttttcatcctttgctccccttctctttgatgtgtaaacactgaaatgcccaggactcccacttcttggacttttaacagtggtgattggtgttaggatcccctgcctgtgaatccatgacaaactgggcggtggctcatgaacgctaagaatttggtgacgatgaaggtgaagccatgctcacatttgtttcgcaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccaggtgagatgggggcgtcggaggttctccttggagcattttccatatgaaaaataacaggctcaaaggccatggtactcataataaattaaattaaaataaaggttgtatgcccttacctttatggtttttattttgagacagggtctggctctgtcgtccaggctggagtgcagtggcatgatcataactcattttaacctctgccttctgggatccagccaacctcccacttcagcctcctcagtagctaggactacaggttcataccaccacgcccggctaattttttgtattttttgtggagacggggtttcaccatgttggccaggctggtctcaagcccctgagctcaagtgatccacctgctgcggcctcccaaagtgctgggattacaggcctgagacaccgcgcccagcacctttatgttcttcatgcccaccagccagaccccaccaggacacacctgcgactgaacaagttgggtctattgctcatggcatccagggagaatgcataccgtggcaaagcatgagggcatctccataggagggtggccggaaggactggggggacttgagctagtggcaggtcattttgtggaaggcttaaagaaatggaactgtggcctggattggatgttgtcaagacgtggaggtgattctgtagctgtatcttaagtcttacctagaagcaggatggccttggtatagattggtagagaagagcagtcactcttattaaccaggacagggagtgtttttgtcctttttgtggtttgcaccatgtttttctttttgtctgtgttcagatagggttacaatgtggtctcattttcatcttgccccattgtgatcacagagtagccttgtctgttgtgggggtcctgtgagatcatgtgtgctcaacaggagaaccccaaggccatgtgtgctggaccagctccccaatgcgggggctgattctctctttcttaaacagctccatcacaagagctgctcagcttccactatgctgcatttacaccgtaaattgcccaattgtgtatgaggcaaagggcaggttgaaatgtgtggagtagcaacatacaagtttaataaaatagcatctgaggagtacctaaaattctaactaataggaaaatgtggctcatctttctcaggatcttttgattaattttattgttaaaaatgcactaggctgggcgtggtggctcacgcctgtaatcccagcactttgggaggccgaggtgggctgatcatgaggccaggagttcgagaccagcctggtcaatatggtgaaaccccatctctactcaaaatacaaaaattagctgggtgtggtggcacacacctgtagtcccagctactcgggaggctgaggcagatgaatcacttgaacctgggaggcagaggttgcagtgagccgagattgcgccactgcactccagcctgggcgacagagcaagactccatctaaaaaaaaaaaaaaaaattaaaccagttatttaatagaattaaatatttttaaaaatgcgctaatgtaaagaaaatgagtcagggtgggtgggggaagctgggcatggcggctcatgcctataattctagcactttgggaggctgaggcaggaggatcacttgggcccaggagttcaagaccagcctgggcaacacagtgagaccctcatccaaaaaattaaaaaaaaaaattttaatgaaatttaaaaaataaaggcacaggcatggtggttcatgtctgtagttccagctacttggaggataaggagggaggattgcttgagcctgggaggtcaaggctgcagtgagctgtgactgtgcaactgcactccagcctgggagatagaaagagaccatgtctcagaaaaaaaaaaaagaaagaaaaggaaatagaggaataatagtgaaaaataaaaacttcatataaatgctagagatgtgtgagcaaaaaggaaatacgagggcacaaatgcctggggagcattaatgtgaccccttggatatggcactgtgttatacgtaccctgcccccatgggctgagattgcgcagcatgctgggatggtgttgggctcctcaggggtctcacttgctaagtgatggccttggacaaggcgagaacctttggcctcagctgtttctcttcttgtacaacaaagatatagatcccagtggccttggtctcttctggtagcaacagttcatgattctgtagattacggtagcccaagattgatttctaaatgctccttacattttagaaatcagtagtaacccagaccacaatgccaaaatttaaatagagtaaattcagaaagacacgttttggataacttcaaatatttcaaggagcagaaattgttttggtgtaaaaggtccaatttttaacggctaatttcaaaaagcccgagatacaaacaacacaggcatcttgggatataatcttaaggttgattaggattatggtgcaaggtgcacaccaaacctgggtgagggctacttacacactgaatgtttccctttttcttctttgatctgcagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccaggtatgcaccgtgtgacccatgactacagagtgtgacatcaacattttttttttagttaaaaaagtaatcagtagtcatttttaataattttcttctctctgggttgtttcttcagataatattagaaattaaatactggaaaagtagttccattgaaattgcagaaggaagcatattattgatcttccatcactcctgagactaatcatagccccattgaaaggttctgcagtgttgcactgagataattacaaactcattggctctcagaataggatggcatctttgaaatcagccagtccatgccccactgaatgtgactttgaagttggcccatgcctactggccagatgcccaatatagtccaggtcccctcattccttggcctggtgggaccatcagggagcaccttcctggaagacttgcagtcgtccacctcagcttctaccccgtgctcctggttctcgtctttggggctgcaaaagcaaagtggatctctccaccagcccatatttttctttgtccctcctccaagtaatcgccatgtagacatctgaagcaaaccattagggttggttcttcaaaggggagcagtatgcctgtttccctagctcactgctccctaccaggctgcctgtggcacatctcacatccctcacactgtctctcatcctttctcctctctattccagtctcagttgcttaattataatcaagaaattaccctccacaccactgatattcagccagctcctacaaagctctcagaccatcatccaaaggttaaggggcctcttcctattttccaatctgtttctcctagtccttccttgctttgcacctcacacacatctcttcacttccaggaactatttaaaattcttgaccacaaaggaaacttctagtggcatttcctaaaacacttgagatcacaaatgtcaaagccaggtccctattgaattcttgtcacaatgccattttgcacgggataactgaagttctctgtcactgagttttcacagagtgtgacatcaaataatttttctcctttcctttttgtttagaggatttatcattcatcttcttgtatttagcatgtttgggagctgcaaattcaggaactacaggctaaagaggcatggatttgagtgaaggtttcactgtgaataaattattaggaatgtcttatttcagttatttaattttaccttttgtgtatttatgttctgggtctggaaacctaatctctccttattttcactttaatcacttctagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaaggtaactcccattatgtgcatattttccatcctttcctgttgacatttgtgcctctttagctgtctggtccctggtgctgacctctggagtccttaggcatttggttgcttcatacatttacttatacccactgggactggtcctgacacccacctcaccactacctagggcgttcttccaagacaagagtagaagtctatcatattttgcttttataagatttacttttctcccctattccttaatccctcaaacaattcagatttattgattcctgtgtctaattatagatttattagatcaagtatttgagatcagaatatttgattttcaagtgcttttaatttaaagcacaaacttggggtgcatctaaacaccagtggtgtatcatcacaccaaagttaattaacaccaccaacaaagctgactttttaaaatagcttactatttggcacctaacagctaccctcatttctctctgtgagaggggtggatagaattgcttctcaaagctcacacacacaggatctcattttgcacttgagtgcgatgccctggtcctctgcctgggttgtccctactgctggtataagtagagttcgtctcctcagccccagctgagaactcatcacctgcatttctcctttccagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtctgtggggccagttggttcaggtgctccctgggaaatttccaaatttttactggaaaggaggaagcccttcccccaagttaaatcctcttcatgtttcactggattgttagtgtctatatggaaaatcccttagttattaactgatctaatgtcatgtactgtcttcctcattttggtagtcttacgtaagctctaaaagaatcctggaaatcagtagtttaacttgaatgagttgaatttgtgattgatttatgtttaattatagtccagtcaggtacgttctccactttcatttctctgtgtgtatgtgtgcatgcatgcatgtgtgtatatacatgcatatatattgtgtagacacacacaccatgtgagtttgctagggatcatcatgaagtactacagcctggcgggcttttggaacagacatttattttctcacagtcttggaggcttgacatcctcgaggtgtcggcagggctgtttctcctgagtcttctctgcttggcttgtaggcaggggtcttctccctgtgtctccacatggctttctctctgtgcatgtctgtgtccaaatctcctcttctaaaaggacatcagtcatactagattaaggttcactctaaagatctcattaaccttaattacctctttaaagaccctatctccaaatacagtcccattcttacggtactggggtttaggacttaacatacaaattttgaggggacacaatttagcccataacacatgcacacatgcacacacgcacacacacccacagacatgcacccacacacatgcacgcacatgcacccatacacatgcacacacatacgcacccacacacatgtacacccacacacccacacatgcacacacacgtgcacacacatgcacacacaatgcacccatacacacacatatgtacccacacacatgcacacacatgcacgcacacatgcatgcacacatatgcatatgattcgcagaaactacatcttagaaatatgagaatgagataaaaattgtttttattgtcattgctgcttgtcttttttaaaataaattaagcactcaaatatactcctccattttaagtgcaatatcaaagtcttgtgaacatgggtaatcattcctcaacttgggccctcagtttccttaagtgtaaaatgaagggcttgagacagcgagtctctcagttttctatcagcagtctgcaacactcctttttagttttcctgggatttgacagctctcttatctgcaggtggtcattcattttactgatggagcagacggagatctggctgatttacacagagcatctgagaacctccgccaagaaggtaggtgccaaggctttctaaatatgagaagtaaaccctggtgaggcggggtgtactgctctgctggagagaaacctctctgctaatgcagcgccccaagggagcagcgttgtcttgggagactcttcctcccagcgttgtggcccttcatcacctgcttggagctgtgggatggagctaacaaaaattccttctgtacttagacagctttactgttgtgttgtggctgttcaggtggtagaatgttcagaaagcatgatgcttttgcaaaagatcatgacgtattgattcatttaacttcatcacataaactaggaattagttactaataaaaatacattgctctatttttggtttgcagttatcacagttcaacatttaataacactacacccaaataatacaaagaaaataatgtaagcaatgacgtaccaaacataaggtgacagccatgcctattatcagatgtgatctttgactattcacttgctttggcgtttggtagcactgactatcagaaagtggatgccattacagaagtgtaatttatcctaagaactttctatttattagcttacttttcccaagcaatggagatgaggctgctattatctgattttggaggtgttagtatttcaatacttcccacagcatactcgtgttacagagggcctgagtttgagaactcatgcatgaatacacttcatggatgccacttcctatatttttagtaataggtttagttattgacataccggaaacaattattcagcagagtccaaagtttgagtatttcaacaattcagagtagccagtaaacttgattaaatatatttaagttaaaagctaaattttacactgaagttttctttaaaaatgtagtcaggaaaaaaggacattgcattttccacatgcctaggtgagctgtattaaatgtgtctttctttgcaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgtgagttttttttatgtctttatacacagaccagtgtagataccacaccttttggcatttcaagagaatgaagttaattatcagcaggtgaatggaggtggggggggggccttggtagatagttaaatttatttaattcacttgggaactgccttgttgccataacacatgtgaatctggaaatggagatagcaaatcgctggaaatccagcgagctggaaggggatcctgggcgcgctgaggttgtggccttagcattttctctgctcccttagcaacggcctcttttaacaccattgcagggatgcaaaccatcgagattgtccatcctccaattggaaactgtgtcaagagcatctgaaatcttgcatgataaaaacaacatgcaggaaaagaaaggctgtttctgggtggagaagtgctttaattgccctccctagtttccctctgtgtcaatgaagctccctctgaggcttcctcattctccccagggccagcctctctcagctggaggtgtgacctcctgggtttagactggggatggagcttttggaagatgtggggctgagctgcgaactcagagattctttgatggtagcaacagtggactgtggctatgagaatgggaggaatggaccttcctttcttccatacttctttgcagggttagaatcaggatttttttcctagtggaagtaggttgagttagctcacaaatctgggatatgggagaaagggaaagctcttggaagctcgttggaagaaagtgcatgtgcccaccattagtttagcagatggaaatgtatttgggcatgccctttcccacataaggtcaggggccagatgggatgagaatgtagagggtgtctgtgtgacctggagttgagaagcttttggctccgaggccaggaccacttgtgcctgctcccaccatggctgctctggaagcctctttctgggctggtaccatatcccatgactctcaccctggttccaaggaagggtggtcatggatatctgttctggaaccaccttcagtcttggccatctgccatttgcttggctttgcactttggaactggaacatatgtaagttatagttaagatctgatgatggaaacttctagaaataaggtccagcctgcagtgatattgtggataagatctattttactttggttgttctttactttcctattggtgacctcccatctgcaccccgaccgccaggagctgggccctcctgacttcgctggcaatttctatcatatcgtcagtcgtccagcaaatgtcacctggagggacttcatctcacaccgtgaaacccccacacatccgattttgacccttaaagcgcatttatgattttctgctgggcatttcttgagatctgaacatttggtttctcttcctttcggtaggacaacattgccgagaaagcttgctgtggggttccctgcaagtgctctgggcagaggggagaccgcgggcccatcggcagcatcgggccaaaggtacggtggctttacccttgcccacgcctgagatgaggtgtcagaagcccgacattactttggtggggtaatttctctaacagaagagtgtggagatgaaggaggagacgagagaccatttcttatgttagaaggaggagctctgaggggcagacctgcgtgctgttctgctggggcctgttccagtgaagatggttcaggcgggaccctccttttgcacaggataaggggatctgtgctttaacagcttggtccttcatttcataaaataatgttaaaggcagctggcgtccctgacagcagcctggctgcgaatggcagctggaactcatagcatttgctctgagtcagtaggaactaacaggctttcttggcagagcaggagccttagagatcctgatagagagaatcgtgacatggtgtactgaggggaaaagcagtaacagggaaagccatgctgagttttagtgctgctctgccaaatgaagggggaccacagggattcttactgtagagcaaagaagaccacgggattaaacagaggacccgattactttgtttcagggtattcctggagaagacggctaccgaggctatcctggtgatgagggtggacccgtaagtaaaaattgttttagtccctaaaatttcaccccctccttgatccttacccattgggattgcattgtggatttcatcatttgttcagttgctgatggctttccctttgggagaaaaattaatttatacttttcttaacaactttgcctggatgtctaagtacgataattgaagtatgacaaatgtgggcatgaagggtgggatttgttcttactctgtttcagaaggagggattaattggtttctgagccagagggacaccgaatttgcacacccagtatctactagattaagacatgcaagtagagatgggagtgagctgaggggcagggacacagcaggagacctcaccagggctttaggggttaccccgttaagggtagtccctggaggggatgttgctggatcagatcatcagtatccgagggtcttggggatggacagaccccagtagcagggtccatgggagcaatgcccaagacagacacctgtctggggagctttgggaccctagatcaaggtccagccctgggataggggacagaggggctcacgaggaacagtgtggtcaccagggcccagccggcagggctcggctagagaactgggaatcaagcatcacttggaggagctgtcagcccggtgggtcttcccgggattcagcacccacagagacacagtgctgggggccacccacccttgccccacagggcagtgctgtctgcgctgctaccctcccagatctcattcccttcagggaaactgcaggttccaggccaggcctcatgcaggggcccaagaggctccctggctcacgtagcctcgatcggcgttccccatggtgaaatctgctttctgctgcatgctgttcacagtaccctttacgctgctgcaagcccggcagagaaagggtgatgaagggctccagcttgcaaaatgcctttgtctctcacaacagggtgagcgtggtccgcctggtgtgaacggcactcaaggtttccagggctgcccgggccagagaggagtaaaggtgaggcgtgggtgatggggttgctagcgtggggaggggtcaggtgactcgcagtttctccagatgctgccagggagggaggcgctggtccaggcttcttgacctcagcattcagcagcccgtgacctctcattggaaggcagttctgagcagggtgggttcaggagcaggggctgcagctggtggggagcctgagaatggagaaatagtttcctgtggaaacatgaagaagccaggaaaccctcacaaggagagaacatgggccagggcggagggtaggctggtgcccacggccccggccctggaccgtgggagcagtcagggaagggagtggagtgagaggacagcaggtgggttgaaggctggtgaacttgcttctctgtttgctgaagtttgaaggcaggtgctgaagggaagggctgcaaagttacaaagtcagctccttgccctgggttttggggtccacccccgccggcccagggagccaagaccacccaagcattcagttctagttttagttttaaaacatcgcacgtggtggtgagagaggaatccaaaggggtaggactctaatattacattttcagacactgcaacattcaaatggggtggagtgggggaacagcccttggcctcttctgcccgagggaccagccctgcaggaaaagctaatgcttcccctatcgccttgccttctagggctctcggggattcccaggagagaaggtatgcaagcttggttttgttttacaaatggaaaactctcccagtatttctcatttcttcctttgccagaatagctttctatacttacctgtccgccttattccctcttagggcgaagtaggagaaattggactggatggtctggatggtgaagatgtaagtgattttactctaagtccaaactgcttttggttctgaagattccagaaactaacaactcagtctgtgatagaaattgcagcaggtgtgacctttaatccttgtctttggcagggagacaaaggattgcctggttcttctggagagaaagggaatcctggaagaagggtaggtgtatttccacggtggtgctattatggaaagaatatcaacatttcatttagggaatagttattttctttcctcatatacatcaagcccgcttcctccaggcagccttccctgacctcccctgtgagtgcacccattacatcccctctcagctctgacacattacagtacattttcttgtttcgagatcacatcccatagggcagggactgagtttgttttgttataaataaatctccagtgcctggcacaaagtgggtccccaataaatattcatggatttactaaacgaatgaaaaatatgtggaagtgaatttgccttcatggtgaatgagtaaattgtaaacattgttctagttaagatttatgagttgaagaatgtgatttttagggtgagataaaaatggaaacatctagtttttagcatccacttgtgctttttctttagggtgataaaggacctcgaggagagaaaggagaaagaggagatgttgggattcgaggggacccggtaaagatttctttattgacgatttcagacctgagcctggggaagagggttgttgggaaagggggatgaaaggaagaattctacttttgaaattgctttaaaacacgttgataaaatatgtgctttgtctttttcttgcagtttgggggtttggggagatgtgttggttctcttgctaaccagataatcatttgcaagtcctgttatacaaatatctgagaagtttccaaaaatgtggtatcagggcacttcaaatttgcttttggaaaagagaagagtttgcagcttttctcattttgtgtctctgtaaaacgtttaagcaaatgagcagtacaagctagcctcttcttccagtccatcctgcctctgtggccaaggataagcaggagtgagcctggggcatcctcctccctggggaagaacgattgcacctgtttggggctaagagtgctttgctgatcccgtgattgggtttcgtaagacctgcatggatgttacctggatgggttgtggccgaagggcttgtccctcgaagccttgcatgcaggtccttgctaatatttccctgaccatccagtccagtggcagctgctttccttccatatgtggctcatttccctttcccatgttgctttcagggtaacccaggacaagacagccaggagagaggacccaaaggagaaaccggtgacctcggccccatggtaaggtgctgcacattcctagactctccctgtactgagggcaagagaaaggacacacttctcggctcatcagcagccacagaggccaaagacgtggcctttaacactgcaacgtagcctaagattagcagcagagtccccgtgaaggaagtctccgtggggaaccagagtgacccttgccaagtggggcttctcagcagaatctgtgcctcttagatatttacggaaggtgcttgttaagccaaaggcttgtagaggtgggagtgtactgaagtccggtgcatcctgcaaagtgtgcaactgtcctgcagacgggctcttcctctgtgaatcgacccctttccctgcaatgtcttgtgcagcatttcagagctagacattcttctctgcagatgagaatctcatgctaattttccccacaccagggtgtcccagggagagatggagtacctggaggacctggagaaactgggaagaatgtgagtgccattagggctttggggggctctgtgacaattcttagtgccataagatctgcccaacatgacctggtgcatggttagtccacagctctgcagtgagtgaatgtaaaaggatttctgaaacggttgttactccaatctattttcattcttataatttccctggtgcttcatctcttctctctccccaattcttgctctccccaaaaacatactgaacagatacttttaaaaataatatctttgctactttcaaatatcgggccaggtttgatccaactaaatatttaagagacccaaatggaaatcctaatactgggggagggagggaataaggggcaagagggctgagggagttgtggatttgttgtttttgtaattatctgtgggtttttggggggatgctgtaagtgaaataaaaaaactagatttcttctttttctggcgtattgcatcttgcaatttcaagacatttcagaaatgtctgtagcagaatagctccttgtatgcctaatcctcagtcttgttgaataaatgctaaagtcaaagtgatgtgaatgatctttctgaagccaaccaaaagcttccaaggtcctcgggcacagacagcatctgccttgtagctgggagaagaccagtggtgtagaagtttgtaacctctcagaggaaattcaggatgctggtgggtgcctaggggaggtctctgctcagaaatgaacagagcacaaaggctgcaagctggggctgggtgctgggaactgggccctcagccacgccctgaggggcagtggctcgttcggcccggcacttgggccagtagagttcgctggggtgaggggctttcaaaaggagcgactcaccaaaatcaaattgatggactatgggcatcattttgctttgaaaattcagaagaaaatagaaattttgaaaatatcattttaaaatgtttgagcactatttatttatttatttttaataaattgtaaagacctggatcaactgcttggaagtgagcattatttttgaataatgctatataatgaaaaagaagctatataatgaaaaagaagaaatactcatcaaatgttacaatgggctattacaactcagcgtgtgagcagagccaaaacttggtttcatgaaatgacttaaaattgagtagttcatacaattaatttcaattctacacacaaggtagaaactggatttgaattcggtttcagtcacgggctcttgaggactcagttcttccttttgtggtctaatggcctgctatcccttcccttaggaccacagtgccaggctcaggccaagctgaaatgtgtccctcccactgggcttcagcatgcctacatcccctttctagagtctccgcaggcggcctctggcctgagcaatgtatcactgagtgctgctggactctcatggaactctagcatgtctcttttgggaggggccaggccagattgttggtttgtagaggagaacagtgtccccttgtctcaaattttccatggaaggtggccaagatcttccgctgaagcaggtggcattacagcgaataatggcaaactggtcaccgcagatcactgggctggtccattggaagtggagagtgaggttcctaggttgatgtagcagatgactgagccccacaacagagctagtcggtcacagcctctgcaacaccaaccctaactttgcaaagaccgcctgggacattcataaagtcccaccccaaacctttctactgctgaggaaacaattttgaggtggaaattaatggattacttgtgaagtaagcccacatgtttgaactaaaggtcacctctggagcatccaggaagatgttgccaagtcgtgagccctacctaagtacacgagacgtttaggtgcacatgtgtgtgcttcagatattttacttaaccgagtgtgtgttgtgtttggccgggatcacttggagaacctgggactcccttccattataattaatgtatttcatgacttctcagtacagttgggaaggtggaagaaaaatagacaggttgacattcccttttcacattcctcatttgaaactggctgggatcgtgcagccaaaaggagtcattattttgcttggcaggtctgcagtaattctcaaaacttccattgggtgattaacaggagcagcaaggaagcaaaacttcacccggatgagggtggaggaagggtgtctgtgtgtgcgagtttccccagggctgatgaggtgtggtttctggttcttggcacgatgtgggtgcttgggaagattcccctgagtaaccgcagaataagagggtgaagtctgaaagagctctaggccccatgcccagcgtcccatgctccccctcacagtttgtgggactttttcttccacagggtggctttggccgaaggggaccccccggagctaaggtgagcctcatgcagtgccccctggagactctcttcaaacagcccagatgccgcccagcccaggagtgaaaaacactctctcctgtgaacccaaagcttcggagacagataccaatcaatttagaaagttgatttcgccaaggttaaagacatgcccgtgacacagcctcagaaggccctgatgacacctgcccaaggtgttcggggcacagcttggttttacacattttagggagacatgagacatcaatcaatatgtgtgagatgtacattggttcggtccagaaaggtgggacaactcgaggcaggggaggaggcttccaggtcataggtagataagagacaaaaggttgcattcttttgagtctctgattagcctttcactgaatacacagtttaccagaacagtcacctatgccttagttaggcttagtgaaaaacagggcgaaggaagcaattggatatgcctttgtctcccatgagcagagggatgactttcagttctgtctgtcctttgtccacaaggaatttccctgtgggcagaatgtgagggaggtattcagcttaaaaaaaaaaaaatctggccaggacggtggctgatgcctgtaatcccagcactctgggaggctgagacaggcggatcacctgaggttgggagttcgagactagcctgaccaatatggagaaaccccgtctctactaaaaatacaaaatagccaggcgtggtggtgcatgcttgtaagcttgtaattccagctactcaggagcctgaggcaagagaatcacttgaacccgggaggcagaggttgcagtgagccaagatcatgccattgcactccagcctgggcaactagagtgaaactccatctcaaaaaaaaaaaaaaaaattctttgtagctatcttatttaagaatagaatgggaggcagctctgtctgatgcagttcccagcttgacttttccctttggcttagcgattttggggttctgagatttatttttctttcatcctccttgggctgttctggctcccgaggctctgtcagccgtctccttaaacagcctcttctgcagagtctagagaaaatggtgcccagtggggacttggggtccaagtgcaggaaacatgactgaggcagtagtgtcccgggcgggcgcctcttccagaacgtgctcacctatctggccatcagcaacccgcaacttcccggtgtctcggtcctctgctttaggtctaaatgatccctgtttcacaaagctgtccgaggagaggtgaggcaagagtgaggaacaattgtagaagtgcagggagacagctggctcctgtgctcagtgtctcacctggggttaccgctttgatcatctgttacctctggaagagctgagttttccctggttgctttccaagtccctggcccagaaatgactgtagagcaaagagctgacattgacaggaaccatcctgactcctccctgcatcttctcttatttcaaagggcaacaagggcggtcctggccagccgggctttgagggagagcaggggaccagaggtgcacaggtgagtgcttccgtgtgtgactgtgtgccctctgatatttcacaaatcatttaaaaaatgattgggtggcatttatatccggaaagttaaccattttaaagtgaacaatccagtggcatttggtacttccacaatgctgtgcaatcatcacctctatctaggttcaaaacacagtctcgaaggagacctgtacccattagcagtcactccccatcaccctccaccccgagtccctggaaaccactaatctctctctctttatggatttgcccactatggatattttgtataaatggaatcatttactaggcagctttgtgtgtgtggcttgacggagcatcatgttcttgagcttcatccacattgcagcatgtagaagcacttcattcctttacatgatggaaggatactctgttgtgtggctacagcacactttgtttatccactcattggttgatggagatttaggttgttgccatcttctggcaattgtgaatgatgcttctgtgaagattctcctacacgtttttgtctgaatgcttgttgcttgtatacattttaagctcacttgcctattcacgatctggattgaggcagctgctactgcagctaagacaggataattgtgggttttggtggccgtttttggccagcagaagtgaggttccaggccctgtgggatgggcagatgccatgcagaggcttctcatggaaagtcacctcattagcactcacgatggtcttttccttcctcagggcccagctggtcctgctggtcctccagggctgataggagaacaaggcatttctggacctcgggtaagcctgtcctaataccagccccctctctagctgaacagagggcacattgccaagcaggctgagagagtttctcggatgatgctattgtagacagacctccctttagctctcctctttggcaacaaaaaccccagatttaacctcaggccttgcagtgactggctacttcaccccaagaaagtaagagtttccttttttggtgctccatgggcctctaagtctcaattctgctccttccaagtgtccctgggtggaaatcaggggatatgcctcaggatggaatcctggaaaatctaaatctaccaaaatgcttagattctgcaaggtgtttcccctttggtccctggagatagccccttgtgcttatgtattttgtatagtgagtgcctcaagttcacccatgagttcagcacagaagatggcccttaaacttgctgtgactgcagatgttatcttgcaaagcagctatcagcaatgatgagcagagacacactgtcattgctgggctaggatcaggtgtcacggaattacgtattcgggtttccctcatggctgagatgatattgagggaggcatcctatcatttattaccaaaaaatgactaataaactggtaacgagctcaatatgttgctacataaatgtacaaaaatattttatggtggaagcaggcaagaacttgcttagaaagtccttctctagcttgaaagctgataaatacatatctttagacgtttttaaaaaacatttacttaacttgtaattaatcaacaatttaagatggtatagatgcaaagctattcaaatagttatccagtagctccagaaacatttattaatttgcactttttcaccatctcttttatgttatttgtgggttgcgtagactgtaccacattttaagagttaatttcatccatcagtttattcattcacctaacaggctttaacatgcccatatgtaccaggtgctcactgtgagggtgtgaaaagggaggcagaataaagtcacataaaatctgggagcttgccgtcctgtcaggaacctaggatatgtacattaataactgcaacatgcattaatttgtgaaaactggcactgagaggtaatactcatgttttaaatttgtgcatgccatttctgtgcatgtttatatttgagtccgtagccccgtgctcagagctgagtgcttgggatttgcaggtgggacaggttccatgcccctggcgggctctgacttccatgcaggggagagtcaggtttcagagaccaatttgcctggacggttggccacttcactgacacattcctcccctcctgctccagggaagcggaggtgccgctggtgctcctggagaacgaggcagaaccggtccactgggaagaaaggtttgtctttagaaaggtagagctttcctgaggacagggaccagccaggcacacatgcccctctccctctttggtcagtctgtctgtccctcctcttcagtactactggttcccactccagcctcccctgttgatcgcggcttggccagtggaatcattgtcccccaacaatccccaccataattcccaccaccatccctgccaccaaccatctctgctcagagggctggctttctcctggccacagccctccatcagctgccaggttttctgctcctctcttgcttggcttgtgccaatagtgcagcaccctctgagccatcagagcagccgggcagtgcttggtacagtttcagtataatatggaacgagcagtctttaaacatgggcagtgcacgcacagtggctcagctaatcacatttagatcatccaagagccccgaccctgactgtcctggataacagcaagtctgctgtatgaaggctgcctgagaacctcctttctatcagctttgagataaattacaatttgtcataaccagtccgaaaagactgcatgttctctgtaaaagaaatgagttcctgtgaatccacgatggtctctgcctggagagtgttttggggttttatgctgggctcaatgcccaccgccttccgtgccttcttctcccagttgttactctctcttctcatcagcccgtcccccatgccacgctggtgaaaaggacaaacaaaaccctcctggattcttttccaggagtttgcacatgaatgttgcaatttagaaaatcattccaccgaaatctcaaaggtgaagtcagcatgttgcagcacccttacctagagcaaaagcatggcttggcatcacactgtaagccagccccaggccacagggtctcagccatgtttctcatgtctagggtgagcccggagagccaggaccaaaaggaggaatcgggaaccggggccctcgtggggagacggtaaggtcacagcgcgcttggggtcaggctgtcgctgactctttgctggaaggtgcaggaagccaggagagggttccaaataaagatgagccttgcttcttgtattattggggatacggctggaaatactgaaacttgctcatctgcggcaaattaatttaacaagttttattttattggcaggggtagagaggtggggcgggccgtggggagagacattttttcccctgtgtttttcctgatacaagagaatgtagaggctaatgaagcttaaactaccttcatcttaggtcccgcaaatgctttgcaagcataactagatgaagcttttctgcaaagaagtaaatgtcatttgggttaaaatggaattggatttgattaggtctcagtccagatggaaacaatttcttttgaatgagacatcttaggaatagaaattattacctcagtaactcgttttttaaatgctatttaaaaatgccccaaaaactcaccaacaataattttgtgatgtacatttctacgttacaaaagaataaagaaatctacggtccattgtgactttttccaaaaggagtcatggcacctaacactgtataaaaggaccaggttgatctgactgttttaattccaagcatcaaaatatttttctgtctttcatttttgtcttttcaactaactgaagtttaaaaacgaatctgtttgtattacttttaatctcagaagcacagggaaaaaatcagacttcaaaccattgaaggaaatctcttcctgattctgtttctagtaatttgggtcaacagatctctagttgttgatatctgttgaaaactgtaaattaactaagtggcaattcctacatatgttagagatagtaatgtacaattcacacacgttcttctgattcttctgattcataattaatgacgtccagttctgaatgctcctcatgagagagcaacaggaacagatctgagcatgctggggggaggtgttggaaaggagggggtctaggggtgatgacttggaaggaagggaagggatatggggagggggaatatgacctgggcctgagagatggagttcagtgttttggttttgaagtagaatcaaagacttacggatgcatagaatcaaagtaaccatcaagattcctgtcaattctaagattcttggggttgacgagtctttgattctacatccaaacagaatctttaccaaaagcaaccagcagttctttctatgttagtccgccagtgccattttgctacgggagtcctttgagcccaccgcctacagaaatggtcttgttcacacttggaagataggacaggagcaggaagtgtgcctactcctgtaccttagtctgcaaacatttcaggagctcaaggatccacttctcaggggcagcggcagggcagagacggtggttatggtgtgccaggcatggcgacctacagtcacatctctttcccactcttagggagatgacgggagagacggagttggcagtgaaggacgcagaggcaaaaaagtacgtatctgctgaggattatccaagcgtccttgctgccaggaggctccaaggacaacttctgatgtgttgtgttttaaaagaattatttctttaaaaattgtctttgtatttgagtgagtgttttcgtttgatgactcagcagacatttctttctttcaaggtcaatttattttagatgaatttaaattagaaccaagtattaaataatctatttttcctttatagggagaaagaggattccctggatacccaggaccaaaggtaaataatccctggtcggtgaagcatcatcatgattttgggatggctctggtatgtccatggactgagaatcagaatatcttggcattagtcttgggtcagccactcagttaactgggctaccctgagaaagacccttccttccctaaaatactctctcatctgtcaagtggaggtcataatacgtacttgtcctggtgtttatgagatttaaataaaatatgctgcaatcaaagtactctgtaagctgtgaaatgctataacctacatgatagtatcattactgattaattaaattaagaccatctgcaaataccacaaatatagtagtaacccactggaaaagtgaatcaaaactaaccacttggctgcccgggaaaagtgtgacccacacgtctcctggatgtcttaccccacggaccctcagtgagatcttctgttccaaagcttactgtgccacttctcggctttcttcccagggtaacccaggtgaacctgggctaaatggaacaacaggacccaaaggcatcagaggccgaagggtaagtttgcgtgggccttggctgcaggtgaggaatgagaacgtatgtctcaatgtgattaactgctgaggctttgacaattatccttcacttgcaccctggccagggatagcacagggtggaaggaagggaatcctgagccccagaccaatgtcctcagggtgccaccatggctgtggtccatggctctcctcctgtaggtgtattcctcttcctccaactcacctccagggtcgccagcccagctcactccaggcacagcacccacctgcagtctcgaatctcattatgggtgactgggaagtctgtgcagtcactttgggccatgcccacccagacggccaggcaatgggagtgaatgaggcatggcaactgcttctgaagcctctaggcttgcaagcgagccaggccaaggccatgggctcctcagactactggtgctgagattcctcttccttaagctacttttagccctgatagctcttttctttttattctttgtgtgtgtgtgtgtgtgacaaggtctcactctgttgccaaggtctcagtctgtcatctgggcggagtgcagtggtgccatcttggctcactgcaacctccatctcctgggatcaagcgatcctcccacctcagcctcccaaagtgctgggattacatgcatgagacaccacacctggccagattattcttcaatggatgtttactcaccctcttaaaatggcagagtcttcaattagcaaattgtggcctagatctgtgtaaaggttgctaacagttattttcagcctgaaatgtagtttaaaaagaaacataattatcttattaatttgatcagtgaagacagtcaaactagatcatttaatatcccaaagagctttaaaacattggatgattatctacactgaacgcattagctaattcactgtctgttacctattctcctgggagtccttagtaatcatattagtggttcttgggaaagcacctgtcttaccttagcctggcagagaacacaatatacaacacctctatagttggtgggggactcccattggctttgttgaggttgcttgtccctaaacttgaatttaagagacattttagctcccttaaagtgagagatttttcgtggtgatggagtcccttgggttagatcacttttaccgtaccttccaactataggagccttaaattctccactttctgacacagttgaacaatgtttgttctgctccctctagggaaattcgggacctccagggatagttggacagaagggagaccctggctacccaggaccagctgtaagtatttatccagttctgacccggccacctggggctgggtgctttacacgtggtccctgaaaacttcccaccatctgctttgctcacaagaaaatgtgctctctttgtatttgcttggttgtcaaaccgcctctctgacatcatgatgcagcaaagagattttgaattttagagtaacaagaaactttaaaaaaataggtttcatgggatatcctgtcatctagggagtattgtaatttgcctttatagtttcctggcataggtgcatttgaggtttgtgtagaggagaaaccaaagaggggaaatctaaataccttttgcttgcatcttgtagaagcagtgtaattatgccaggccttggtttgacaatgcttcctgtggtctatgaaatccccaagggagctcctgatttgtggttaaatcccactagtcatgctgccaccaggagccaggagggcatcctcccacagcccttccaaacctctttattgctaatacctttgttttcttatttgaatttctccatatattgtccctcaatattgaaattggtgagtttcaaaaaataatggaaaagataattcaggagttggaaaatcattcctagaaggaaaggttcagggcttagtttggttgaattagggaaaagaaagctggtcaggtgggtctgattgctgtctttaagtaggtgaagtgttggggggagcacattaagccagttcctgcagaagaccaagcaggcagaaatagcctcctggaaagacaactaatggcccatgagatgcctgctgggctgtcagggtggtgaggtttaggcatgggacactgagggaagccacgagtcagtccctagagctcctcggggtggaattcagctgggatgctttagacacggagggagccagggcagctcaatgatctctcactgccccttcggcaggggacagcgtatcaagcgtgtgaaagggagctcttttctcaagagaagcagaatctagacccaggttcactcgtgggctttacatggattggtggtgagcttcctggtttcagaacatgagactatttcaaaggccaaatgacctcccagggaaacacatttgctccagaatcttctcttttttgctttgcaagggataagatcaggtttagagggagaggctgtaaacaatcaaggttatccaggggcccctttgtcttgctctgtgtatttctgggggccaaagcctgtttattcgaattccccatctgctgtgcctctcacctttcgttccttggttttacagggtcccaagggcaacaggggcgactccatcgatgtaagttgcatgtgtccagaatgactcattaacctcatgagcctttgatttgctctctttacatattcttttattttcttttaaagcaatgtgccctcatccaaagcatcaaagataaatgccgtaagtacatgattttctgttgtctcacaatgcatatttttacattcgaaattctcacatggtagagtagtctctcaccctttcttctctttgcttcttttctagcttgctgttacggtaagttgattttggtgactttctcctaaggaaaggaagcctcccttttgtagtaagtacagtttgtctttaaccctccaccctctactttccacagggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcaggtctgtgctctgtgcgtgctgttggcatctccctttcttctggggctctgagaaggttctcagacacgtccatgctcctttgtggcttcatgtcccatagctcctaaaacgtccccaatgaggccatctgcctgagaacttctcttgtgaggtctccaggacaacctcgtggctccagcactacagggacgcctacatgcttgtagcactgcccccaggtccctcctcacatgttgacagctcttgccggttagtgatgctagtgttggtgacactctctatctactaacaaggtggtgtgacttgtttgctttattcatgaggacctggacgtttgcatccttcctgtctcctcccaagatggccccctgtgcacactctgagctgtgtcttactgtgtactgggcatttgcttcccataactggctggtgaggtttgtatcatcagtctcacctcatggataggaagatcctgctgttagtgaggtgctcgtgagaggctaggaccctagtccattagactctgaaacccatgtgctgatgatacccattccagtctccactctgtcccaatcggccctgaaggtgaatatccagggtggccctggaggcctgtagtctctcagtgaggtccccaaaactatgccgactcagcacccccaatctacaccacaccactgtgcaaagctttcttcagtgaggccccaagggtcagcccacggagaggccaagtgtcgcttgtaattctattaaataactggtttaattgtgtgttttttttttttttttttttttttttttttttttttttttttttttttttttttttttttttgagacagagtcttgctctgtcacccaggctggagtgcaatggcgtgatctcggctcactgcaacctccaccttccagttttaagtgattctcctgcttcagcctcctgagtagctgggattacaggcactcgccaccatgcctggctaatttttgtatttttctttcttttttttttttttagtagagacgggggtttcaccatattggtcagactggtctcgaactcctgaccacgtgatctgcctgcctcggcctcccaaagtgctggggttacaggcgtaagccaccgcacccagacaactagtttaattcttacatcaattaatatttattcagtgcagttctggcgatactgttcaagacagatgggtgatgggtaggaaggagtccacccgggagtcaggaggccttggcctggttccacactccccccacccatttaaagtaatgtgcacgccacttagcgtccctgcgtctcagatttttcacctgtaaattgagactggggcaggatgattgctaatgtctttccttccacattggatattctatgcttttaccacagcctgtgtcggcgaaagacattgggtcatcactgccattcctcagggcttgttctgccgaacacaggatgatttgtgcatagagcgctgggcttgggaattcagtgttgaagttgggctaccggccatgtgctcttgatggggggattcattcacataagtctgtccttgtgtgggctgagggacccagaaccacgtgagtttcttagcatggtttcaacgagatcaaaaaattgttcattcattaattatttgctcattcattcattcaaactagctatttgttaaatgaataattactaatcgtgtgccaggtacggcgatagacaggactctttgcacccactgggagtgattttgttacttgctttaaccacacctgagagggtggggaagggatggagctcccatattgttgctaaaaataacgataagattaagttcctactatttgccagaggatacaccagttactaacatttattatctaatttaaccctccaaatgacaccattaggaaggtattaccccccattttacagctgaaaaaaactgaaacccatttgaacgggatatgaactccagctcaccctagtagaataaaacctatgtctttctattatactcagagcctaaccccacccccaaatgagaagatattcccaatactgccctattgggaagttaatctattttattgatgtagctttgatttactcctctgccatattttcagatattactgatcatgtacgcccctaccaaaattgttcttttgtttaaaccagatcaataacacagcagtggggcatgcgcttgtcctgcctgcagggagagacctcacagacttcctggagaatgtcctcacgtgtcatgtttgcttgggtaagctgtttctctaacaggaagatctgctcagctgcaattgcaaaacataatatccatgggagagtgagagaataatgatgatctgtaaaaagagcttgagttcaattgattcacaaagcctcgtatttaccagagtaaatactactgcagcagtttctatattaaaaatggacctcccaaaacagagcttctctttgatggcggataattcattttataggtaacaaaggaggaggcagtttctgcttaagttttgacattagaatctagaatgaaaacattggcactagtgactttctagaacatatttcttcaaagagtggcagagaagtaatataatttttcatttcttttaaaaatgccagcacatggtatgctacaaagattttaggttagtgatttgtttcatctactaagtattaggtgatagaaactgaaatctggccataatcaaatcaaggcaagatataaattggttttggttgtgatgttttttttttttttttttttttttttttagacagagtcttgctcttgttgcccaggctggagtgcagtggcacaatcttggctcactgcaacctctgcttcctgggttcaagcgattctcctgcctcagcctccagagtagcctagattacaggcatgcgccatcaggcccagctaatttttgtatttttagtagagacagggtttcaccatgttggccaggatgatctcgatctcttgacctcgtgatccacctgcctcggcctcccaaagtgctgggattacaggcgtgagccaccgcttccggcccgcttttgatcttatgtgatcattttaatcgcccaagtctcccagcagattgatgagctgtgtatcctgctgtgggtgtcacagaacaaataggctgccatgcttctttctagacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtaagtcctgcgtggcacagcatgtgccctggcctggctttatgctcgggccaggagaagtgtaggaacagtcatggaaaagacaaccgatgtgttgacaggaactgtttcattcattgaacagacatatattgacacctgccatatgccacaaatgcttttaggagccagagtaagcagggaacatgcagacagtatccttgttctcattgattcctttattccaccacatttgaccaagcgccacctagtcataaggcactcttggtgtccttaacagtttacaaatgggtgggcaaatggatcaaatgcacatttattacgcatgacataataggctggcatgtcgcgagagaagtgatttctgttaggggcaccggggaaagcttctagaaagagttgctttgatcggggcttagccaccagccccgtgcttggataccactgggtctttgctcatggggctccccctccctggaatgctctccaccgcacttcagcagcaaacccatattcatcttcaaagttcaattccaatggcttctgctcgccgtggaagctgctgctcccaaggcctgctcatggttaatccggacaccctatttagggcatctattacctggcctgttgatcatttatttgtgggtctgtggtcccctagactgctctttgaggaggtgcagcctattatagtttccagagcctgtgtacagtgtgcagcccagggtcagtacaggcaaggcttggaacagatgagggggatttataaagtataaataaacatgtatatgctaaatgtttattatttaaggcaatgttgaggtctatgaaaacagtattcacatttgtgaaggtctggcccccaaaagattcaaagaaaaatgtgaagcaaaggtaatcccccaggttcacccacaggtcactgttcctgtcttccaaagattaaaaacaaaagctttgttcaacaaagcattgagaaaatctgaaaagcagttgcattataatctgatgtccaagagtctagaacttgttgaactctccacttgatttttcttctatccctgtcttctctctcatgttggataaatatatctttaacttaatcacccaaatattgccaaatagaacatattggcttaccatgttttatggatccaatgccatcatactttatgtttaaaatcactggacatagtttgtctgatatagttaattcaacaataattatgggctaaataaatgttatgtgattcatttaacttgttgacagattaattttaattttcatgttattagcatgcggttcaattgttttctttgttttttttctttaggtgaaaatgctttttacttgtccccagatatcaggaaacagtgtgattggttccaaggggaccaacccacaaagaaccttgtgaagtttggtcacaaacaagtgtaagtgattataattattgtcttaaaaattgtagcgctgcagggaatgcacaggtcctccaaccacctcctgactttatgggatgaggaccttgaaatccagaaaatgtgacttcccaaaggtaatgtgggtcatgcttctcaaataatctgttttatcagttagcttttgccatgtaacaagctacccaaaacttagtggcttaaaacaacaaccacctatttattttcttacttaatttatttagagacagagtcttgctgtgttgcccaggctggactgcagttgtgcaatcttggctcactgtaacctctgcctcctggattcaagcaattctcatgcttcagcctcccgagtagctgggactacaggtgcatgcagccatgcctggctaatttttgtatttttttttcagtagagatggggtttcgccatgttgtccagccttgtctagaactcctgaactcaaatgatctgcctgcctcagcctcccaaagtgctgggattataagcatgagccactgggcctggccaacaaccacttatttaatttgcaattctgtgggttagcaatttttgtttgggctcaactgggtggttcttctgttttctccttggatcccttatgtttgtggtcagctgcttgtcagctatagagctgctggtctagagtggtctcagatgggctggctcatctctgctccatgtggtctctcattctcagcaggctagcttgggtttgttcaccaggtgacctggcagggttccctgagagaagacaagtgtgcaaggcctcttgtgacctaggttagaactggcacactgttacttctgccacgttctattgaccaaagcatgtccaaaggctaacctagatttaagaatggaaaactaggcttgatggaaggacttgccacattacattgaaagggcatgggcagagagaaggtagataattgagaccatagttccaaacaatttaccgtatctggtgtgaaatgattacgtaaaagaaggattggatacatcaaaaaatagactccatgtcttcttaaaattattaatgctgtgataacatgtaatgatggtaataataggaagtcatgtgcatgttctatgaagactgacgggaggggtgggagtgggcaggactgtggcacccatgccgatgctgctgcctggcccatgtgccgtgtttcatgccctgctccatctcgggtgccaaccctaggagcaaagagggcagtgggggcatgtaacagagggctagctggggtgatgtggctgcaagaactgagcccctgcagcgtgtcagcaatgtgtgctccttaagagaatgtcacagtgtgtcatgctttggagggaagtgcagattctgcagattctgaacttcgtacacagatgagatgtgaacgcaaatgatccttgaaaaatgactatctggcttacgactagctgactctcaagatggggaaagagagcccatctcttcctactgcagacccttctgtctatcaccacttaagtccttcagctctttcttttgacctcagaaggagtggctttaaatctcagcatagcaagaatgaatatcattgctaaggccactaggacccttatcgtggcactggatgcttcatttagctttgtagcctccatttttctaggctctaatgattcgtattttttctctgaaaccttccctgaaattggctcaacctttttatctttaggaaaacagaatgaatgaagtaacctagtatttgaagtcttatgatattaacttgaaaatatattaatacttcctaggacaagtagcaagatatgactataaaataatatattttcttctaagatcaagaaagctatgaagtgtgggtccttgttgttatgtctgtttgattaggctgctattctctctagatattggtaatagatcaagaaattgtaaaaaaaaatacacatacacaaaaattaagagaaataaaaaatatatatactcccagtaataagccctgggagcaaaatagtacatgctaactttataattttccagctcaacatagcatttgattgagtggatattttcttataatgtaagtagctaactactgatttcatttaatttttggtgtatgttttggttggttaattgctataatgagaacattgttggatattattcattattgtctcttattttctctctgcctttattttagaaattgaaagatgtttttgtagaacaatataagcttcatttttaatggttctatttttcaatatgctgttccatatctttttttagggaggcacagatccttaaaagaaggaatttaatatatgcactgctatacataatctataaaaactattgcatgcattttgctaaaacaaatttaatgtagctcatggggttatgtctttatttattttagatagcaggtaaaagtagaggtaatatttaatttgtcttaacagaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatgggtaagaaagcccttgctagggctgccatcttgtgacatcctcatttcctgctccagggtgtgttcctcaaagcctgcatgtaacacactcagaatacagtccttgatctgggcttgtacacctggatgatgtattttaagaggtgttggttagggattccagcctcccactccccatcctgtgccctcaatcctgtcttgcgatagggatgggaagctctcattctctctggaatgtcagtgggggcacagttcacctcacctgaaaattgagttgtcttaaactaaagggaaaagtttccgtgttgaaataaggttttagctcctatttagggagtgagagagacagaaagaaaaacgctgcagttggttcttaggcagcaaggcagatgtttctgggctggtgtatggagccggactcgcctaccttagaacatgccttgaaaaggtctgggggagccctttgcaactgcaaactttgtctctgcctcatacccacagaaaaggggccctaagctgtgtgctgtggcaatactgggtgttcagtccagcagcttgaaaagtcagagcctggaccatcagtcattccccaaggctcaaatctatgctcatgctgaccatgagaaaaatattgaaagcaatggcaaaaaccacaatgactctgcaccaacttaatatatttcagactgaattagatacaaaaggtagatggctttaatgagaccaagagtatgttattttatcattttcctaaagaagatactggaagacactaccgaatgtcacaagctgtaaaggaaggctcatgataaaatggaaattatcttcatttgatgaacagtatgagagagaaagcagaattcctttaaaagaatttcatgtcataccctaaaattttatgacttaatatattttaaattatggggctcattttgtagcaaacacaacttaggattagtatgctgcatttccaaagtatcttcttaacaggcgagatttttaatagaaaaaaaagttgatgaataatgagatttttcattactgtgaatttcacatttcatgtatgctgatagattataagagcaatgttttttaggggcttgaacaagaaattagttccccgcctcagctaaatttcaagtcaatttgtctgttaacacatccctttcagatttcctctctcgctcatgcactacagtcatggaggattttattttttatcttcacgctctgatctatctttcagttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaagtaagtacatgatcagtacaagtcggtacctgatttctatgtagagtatcaaataggacacaaaggagacacttacttattgaatctattctgaaataaccacaaattcaaaaaacaacaacagcaacaacaacaaaacaactcagcctgggtgctttggtggcagcctaagcttataaaacacagaatggaaatgggattccatgtgggatgcagtcctgccctctgggtcctgggctactttttggaggaagccagatccacgtcgcctgagcacagccctttccaacattgcacccgggaaagatggccacgtctcccggtgagggctcctggttgcccaccaccccgtccaggtttccatgttcaggaaaacaccagccagtcactggctccttagggagtaatggaggtgtccctgaagtctcaccgccccgggggtggaggatgtcgatagctgagtctccctgccctgatctcaccatagttgggctctgcccttggctggctgttgtccccaggggcccccccatttcactgaggcctgcacttgagtgctgtcacagcttttcttaattattcatggtcccctctctcatctttctaaattcttctgggttcccccctcccattcttcttgacccccactgctccaggaatgtgaagggaaggctcctcttttcttcaggccaatgctattcagatcaaggaaccagcttgaggaaagggaattcccaccagtgccatggattaggcccatagagatatgagtccaaagacccagtcaaccctagggctctattttcctggacagcagcagaagaggctgtctgggaagtgagaggatttgttcagaagttcagggatcccctcccgtcgcttattagctcatggatccaacttgtagcccacagcataagtcgtggatgtagaggtgtcttggatctgtgtctttcaatcaccactccccaacataagacattaatcacagcaggcaaccttatatcagtcactaaggattcccaagccctcctgtttctgatttacctacgagttgcatatatttttcttttatagagaaatctcagcccccacctccacagccagcaaggtcagcttctagttcaaccatcaatctaatggtgagcacagaaccattggctctcactgaaacaggtgagttgtgaaactattaggtccattaatggcactaagaaaatacccatcttgattccaatttaacttcctgggttctaagtcttagcccaggcatgacttctatgggggaaaaggtccacgtcagctctgtgcagcccaacatcatcttattctgcataatcccaggtgtaaatggagtcttactttacctgtgatcagactcagtgaaaatttgatgggaggtgcttttggggctatcactagaattcacgtatccattagacatttctcctgtgcctcatactgggactcgagttgatttgtggtctgtgatgctgtgaagattggcgtttcatttactcagtgatttaatctaataaaaaaactgcttagaagaacacaagacaaatttggctggaatccatgaaatgcatgggtttggatctgacccatggggtgttctggtccggacatcctaagcacacaccccagcttagtgtgtgagtctgtgatactgtctctcatgtgcttgaaccccagagtgtgtgcatagtctatgctaagttagtgactggttaggtgtaattcaggaactgacagctgttacttgcttttgttcttgggcagtgaaactctgagagacctggaatctctcattcagcagaatgtggacttggcttgttcatcggtgagaaactgattattaaaatagttgataggctttgcttaagagtgttcagcaaagaatgatggtactaacataaaaaatggaaatgccatgggaatttagatataatactgttttatacacctgaagcaaaagctttctgctaactaggggacaattcattattttttggtgtatcgtctactgtcaggaggaggaaagcatttctcttcacaatgctcatttctgtaattgattttaaaggtgtttgttgagtgagcctgttaggcgaccccaccatggtgcttgagctcaaagagaagccacaaagaacacagtagattttccccaaaggtgtgggtcaggacagattcaactctaacttcaaagttgctgaaatctgtgtatgtcatttctcactcattggttaacttctccctgaatacagtgtgggaaatagaaaaattttagccaatttagtgcttcattgagagaaaaagacttggagtaaactagagatcagagatcaataatgagtaaactagacagcaagatttggggatgtttttgattctcttatgtgtggtccaaaagggacaagattgtataaacagtgcctaattcatataaacaacaatgtctttcagcaagggtctggctgggctgttttgtttttcttttcatatatatatatatatatatatatatatatatatatatatatatatatgtagagagagagagagagatggggggagagagttgtgaggttcagaattaagaaggtgcttttgatccagacctttaacactgagatcgcctgtctacctgtgataaagagaaaagagcttttgaaattggggcttgtgtttctttcaaggctgcaagtagttgatacagatgaatctaaataaaacctttctccttcatactaattggggcataaccctcagacccaggatgtgaatgtcctctcaccatttcatgtgtgtgtgtctgtgtatgtatgtgtgtacacatgcatatgtgtgttttccttcccagggtgaagacataaattacctttttttttttttaaaaaaagaacaaggccctgcataattgatctctgatctcttaaacttaatgacttcatagtaacaaacaagcacttaacctgccttggcctgatgaatatatgttggtgtacacacagttatggcatttttgagagctctttttgaattactaggttggtgcgaaagcaattgcagttttgccactgacagtaatggcaacaactggaattactttcgcaccgacctaataaatgggacatttacttaaaaatgtctaaaattcaaaatggataaccagaattaggagaggaatccttatcctccccacccctaccaacctctctccctcccctcctcaccttctcctataattgtcattttaactatttcccctggggtggggggaaaattttttaatggtttttatatatttggatataggaaaaggagtgacaatgaaccactctttattaaataactaaaaaaagataataactgcatgcttactcagtagttgcatgtatattttgcatccaaattccaatgaccacgatatgcattatttctccaaatatacattttctagaccattcaggcaaaatgaagttttaaaaatatattttttatatttacatgtgtccattttcattcctcttactttctgcagcatccattaattagaaacatgtttacagagatgggtccctttcttagtattaaatagtagatgctactgtttgcttttttacttctgtgaataaaagatgctgtcttaagaatctgtatttttcatagtttatcatgttagattctgggaacctggtgacctgtgtttgaatctgtgaaggaatttgtaggtagaaacactctgaaatgaaaaggttcctagtcctgggcacctaaggcaggggaagaggagaggaccagtgttaccattggttttcgtttgcatatgttaatgtttgcccattttgacagtcacattgaatagatgcttgtttatcaggaatgtgagtcaggcatgtaatgcgagggcagtctggttggggcattttttgtcctccataagatctggccctgtttggtatgtggcagggagactctcgcctttgagatgaaggttgattctgttaacaggccttgattccattaatatacctagggcatcgttagcaaccactcaggattccagctttacaatattacatgatttgattttcagtggttaatatttgtatttttttaaataaaaccaaatgaacccccacaaaaacatctcactccactttttgctttgctcggcatctaaaagaattatgctccagccacttttctgtcacacatctgctgcctgtaaatggcagtgagcagcagtggatctttcattcgttaccgtggcctcctgaaagcatgggtgtgctgggcctttctgccacctgctttgtcgctgctgattttgacagtgctacgtagttgctaattttggtttcaggcttttgttaccacctccctcttctcccttctcatttttagctaaggaagctttggatagatattttctatgcatattactattaaagctaagactgtctagaatttctaaacaacaacaacaacaacaaaaatctaacttaaaatttactttttgcagtattgcaaaatgaatcctaaattattggcttaatcacctgtgttaaagaagtttcaatgcagaaactagacaaaacaactaacaaaatcaccatgtcctttattatttattcttgaaattagcaatctgtagaactgatcacattttgtccgagtagacatgactgggccaattgtatagccctgaaggaaccatcattttgtgtttactaacgttttacttattgattctaagatgcacaattttcttctcattgggacacttctgaaactgaaatgtgacttagaattgacaatatatcatggtttattggtagcattttgtgttacttagtggaacataaaataatggtgcatcataaaattaagagctcttatattggatacaatacagtatttggttggccatgttccatgtgaatatatatcatcaattagcataaaatggtatatttgggggaaatacctgactttatgttaataataatttaaagaacaaactaatcccacagctgaagtaagttaaatagctacagggatttaggaaatggtcctctccaggctgtctgttgttcatcgctgtgtgaggatgttttctggttagttgtcatgtgtgggttatgatgagcccaaaggagtgttttttatcttgaagtcttaaaaaatagaagtctgttggtcaagatctgaaagagtaaaatttaaccacagctacattttaaaataaagttaaaaattggccgggtgtgatggctcatgcctataatccctgcactttgggaggctgaggcaggaggatcacttgaggtcaggagttcgagaccagcctggccaacatggtgaaaccctgtctctactaaaaatgcaaaaattagccaagcatgatggctcatgcctgtaatccagctactgaggaggctgaggcaggagagtcacttgaacctgggaggcagaggttgcagtgagctgagatcatacctcttcattccagcctgggcaacagagtgagactcagtatctaaataagtaaataaattaagtaagttaaaaatttggtaagtttccttggtaccctttgaactgaccaatgctcaaaatgtagacggcggaaagtgttttcattcaggcaaatcatacctgcatccaaggtatggaagtactttatactgtaacaacaatgccgagtgagaaggtgattgaattttcttgttttggggaccattaaactgatgaggaacatgttgatgattgcagcataaacacctctcagtctgtcttccttcagtttgctcaaggaagtacttacatcgtgatttggaaatcaatatgtttgggaaatgtcaaagctgatgcctttaaaaatgcattgaaacactatgggaatatcaaactatgaaaaagacaagattttccaatcaatatgttttccactttgaagaatacatatattttttgctgattataaagttaacagatatgcattgtcaagcattcaggaggtacagagaaatatattacacgattctcattgtgacagcattgctggcttttgatgaaaaccaatagtgacccgatgcatagccttcctatttttttctatgaatattattgcttgtgggaaggtgcatgcatcgcacatgcacatccactcctgcacatcattattacaaaaatggactgtggggcttagggtgccttgcgccccagtgtttttgaatggttgtttttaggatgttctaggtaggcacctgtggcttctgggaacaggtgggattcccagaacagggttttaacctaacattgtgcttgcctccatttcctctcttctatttggttactttcctgaagcccagtgaccaatagtaaggaagtttcagcagacagtggtctgagtcaggcagcctttcccctctctgttttccaagcaaacttagttacattggtattctaggttaggaagccggggaaggttgtggataattttcagtccccattgtcttttaggctcccactaggttctcaataataaagaagagcaaattaaggaagactcagccatgcgctcctctcacataaagagaaggctctagcttcctacaggttatacctggggggcagactgatttcagagggaaaagatgaacaactattgcatccaaagacgtgtcgttctagggaaaagtccaggttaagttcaacgagggccagccatctcccttggtactccaggacatttaaatacttttttttttttttgctttaaaacagttgctttaacatatgcactcatagctgagtagagtccagccaaaacgacatgtctcagaagtcaagattatgtggagtttgcattagaagccttcttaagaacataaaatcctccgttttcatgcttcagaagtagagaagtacaggtttttgtctttgaatagtgccgggttctcacctcactaatatatttctcttggttttccaaatatcttcttgtccacagtaacagtgtccttattttccactagtaaatcttacagggtctcagtagtgactctcactgaaataagggcagaaaacaccagtgccgtggtgtggaactggagggctagggtggagggccaaggaagctggagaagccaatcagacggggagtggagtgtgctgctgtgaggccactcatgggctgggtgtccgtggctctgggcagacctctcgtgactggttcagcagagcccaggggactgggaattgaacagctaaacacagatggtcaggactgaagtgcacttgaaacaaataaaatagagcaaatagggtccattggccaacgctctgggaaggaaggaagaatagggagatcatttgacgccggcctcacgctaacagggaagccaccagtaaatgaggaataaattttgatggttaaattaccttgccttgtcagttctctccaggaccttccttgacagccaggcattttccttcagttattggcatatttgagagaaagaaggttgtttttgtaaattgtcttcattttattctgacttcctggagtcttcaaaggctctcgtggggaccactggctttctgggccctgagagcgtctgcaactaggaggtgttgtaactgtggagccaccagccaccagcctggaatttgggtgacagcagcaaccaggaaatgttttagaccaattctgagcctcagtcctgtgcacctttgagtctggtccatcgtgggtgatccaagctatgattatccactgaagacttaggttttccttgtcctttttggtatctatctgaagcacagatgctcaccacctccgcagctgtgagcagcctgcctcgctggggacaaaggagatggagaagcatctctttgtaggggagagctggataattccagcctgttagctactcacaggaacatgcagaattattggctccagggagttttggagaaagaaggtttacgttttcaaacttacagataacagttgacatcaatgcttctctttcccagaacaatctggagtttgccagaaaactctgtaaacaggagtcgtgctgtgtgtgaactgtaaactcttctctccaggcgtcgaggggacctttgctttactttgcagctgggctacatcagacgtgtgcattggaaacataaacttccttaactgggaaaagaatgcttctctgtcttcaaaatagttctgctatgtgacatttttgccatcatgaattttacatcagtgctagctctttgttttacgtgtttcatttggcaggtcacaaaggctcttggctaccacacatacgtgcatacacacacacacacacacacacacacactcataaaggattttcttttctgctttacctttaattttcagtctacttggcttgtaatgaaaggtagagccttatttttgaactatatcccaacagaatcgaatttccattttgccaagaattataaaaccctgaggttttaaaattcagtttcttttctggggatttaacatggaaggacttggagggcaaatggcccagtgattggaaaggggaaaaacaattcatttcatttaaaattattcaataaccattgccagcatttgggattctgagtgctgtttatgaagccctttcattgatataatttcatctatctctcacaaggctgtaagcaattcctatgtccatatggcagtgaggaaatggagatttgagcaggttaagggagttttcacctggaagctcttcttttttttccttctgccacagtagggtcatcagactgtcagccccagcactgggagccgagtaacacgcatgttctcattaatatccttttctcatgtttttattaaagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctggtaagtgattcttccttgtgtttatggcttctgcaaataagagattcaggtcaataagtcaccttgaaaaatattagaagtgcaatgattatgatacatgtgaaaaagaagataaagtgtatcctcagataaggaagacgttcaaatacaacccatgaaatgtctttttgaattcctattttgggtttctaaaaacatattgtcccttgtcattcttcagaaatgttactaagttgctgttatttgtaaaatattgcaccaaaaatgattcctgggaagataatataatgaacaactacagataacgccaaagataaacaacccccacaaatttatcttttaaatagttttgcttcctataaataacaatgttgtcactggggccatccagtatctccattatattgtgcagttcaactggtaataaaataaacactttgaacagagcctggggtcagtgccagaatggggagagttcagttcgtataaaggcctggtagatggtgcagggcaaaagaatgggatcagatttcccagacatccctgggccccggggccccaggccaagaacgtcacagagggcctttgatggtactgagtagaaaagtgggacaggtgatggaaaccagaggctgcgggactgtgtcatgataatgacagtgcccttttgggtcagtaatgtggcttttcctctcttctctcggctcctcacctcaccccacccaccccctctctcgacgctcagtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgtgctggagggaggggatttaattttaattttaaaatgtttaggaaatttatacaaagaaactttttaataaagtatattgaaagtt

SEQ ID NO: 66 - DNA, 65222 bp, Homo sapiens
cgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtacgtacgcgccgccgtcctgccattgtctctctccagcgcgtgccgtgcgccccagggacaggggctggtgcccatcctcgccgcgcgctgtcccccgcacttcctgttccgaggagagacccgcgcgctgaccgtgcttcccttctcccctcgccccctctgtccgtgcaggtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggtaaggaagagcagctgctccgcgctgaggctgaagaagcttttctttccttttttttccccctcccccttctgcccacttccgtgagtgtggagtgtccgcgttacatgggtcaaatttttaaacatttttgagaaaatctttggtcctttgtttcactgggcagggaacagccctgtcagagaacactcttaggaagatagaaggccccagtgggaatgtggagcacttactggtacacttcacgactgtgggttgacccttggtaggcagcagacagttgaatgtgccaactccaagggacggggtcactaagtttcatcagcaaaaagcagtgtttttttatgtctaccctatgggtgatagtgtaatattggtgttctaaaaatacatccctctcaaagctcaacacaggcaaaaatacttttcactgggacagttcagaaatagttcctctggaaagcggaggaaaagacagggactgggagttaattttaaatgactcatttatagcactattaattgatctctgaaaacttaattttaataatgcaaatactctttatgtgttagccatttgtcttagtgactcataaatcagaaataacattactaatgttgtttggaaaacttttaaaaaattaaaatttgtaataattgaacaaaatagtagtgaagtggataaattatagtccgattcttgagtgtttgattaagggagaaaggaacttactttctgacacatataaatattttcagcatacaataacattatgtttgaatgttttcctttagtcttatttgaaaatctttgattctttactgatattggagttacgtatgtttcagctaaatgttacatttaataacagaagaaagtttagtgcctgaaaagatacaaattatcgttgtgtaagatttcacatttaaacagcaatattaaaaaaactgaattaggactataggaaagtatcacgccattctaaaaaatgtgtagaatatacttggaaaaatttcttatgcaaagttccacataacagaacgaaaagatcactcgctcgtgtaagttttcagttaaagaagaaagttatgttaatttggtaaaataaaaaacaggccttttcaattaagagatactattaaacccctagttatgatagtgatgatgctgttcataagaagtattgatggagaacttactggtcagagtctatgcaggcaaatgaaacacttcttttacttgggatctttcgttgtgaaagatcttacagcctaaaaacatgacggttcaacatgcagttgaataaatgtttagcgaatcgagtaaatgtagggaaaataaaactagctacattaggatgttaggattgctttcccgtatttaatttgagctgttaacactttcctgtttatactgttaattttgcaaacagtaatgcttgtgatcccatacactttgtctagtaaaatgaaatcttccaaatggagaaaataaacctctatagtacggatttttgccatatgctggttgttatggtttatcttgctaataactttttgtttggttagactctggccctatttaaggcaccaagtttgtaaccaggtacaattttctaggttataatgatcttcagatatgagattccatttctagagttgctctttataaggtgcttttcttcacttggtggtaagtaaagcccatcagagattctaaagctgattgcattaatcaactgttatttgacgtatgtacggaaccagaatattaaatatagcagagcagatagagcatagcctttgatatcaaaaggatctgatttcagattcccacattgccatttcaggtctgtgtgtccttgttaaatcacttaccttctctcagccttattttccctatctataaaataatatgcctcctaaagctgtgctgagaagtgaatgagaaactagcacgtgtcaagttctaagtatagaggctggcatttagtagatgctctataagtggtagctaatataaaaataaagtgttacaactttagttatgtatcacttatattaatactaagcaaaagtaagattttcacaggtcattcaagatttatacaactacagtaccagtacactggggcagcgatgttcatacttcatacatgcagccccacaatcaagtaaaataaaatagtttcactgtagaaattcagatttttttttttaaaagatgagttcaattctccaaatgtggctccaagccttgtgttgcataaccccgagaggaaaccctggaactgatttacaaggggtgggagaatttgattttcttcataattctagaaatctttggagtattttctctttggcatagtttgagaagagatgtgttgttgttgccttgaagttgaaatgaggtagctgtgtttcccttccctagttctcttctatagatccttagccttaccctggatccttgccttatatacttggcacttttaaaacaaatgtgctgcagattcattagatgtagcacattatttagtgtgtctttctctctctttcccatccgtttttttggtgtggtacattattatttcatttcacgtttctatatcttttactgtttattaaaaatattccacaaaaagcagtgaggtagtttaatagatttacagttttctttgcagggtttgaagctctgatttggattacaaattaagtatttatagtcttcacatcctcaatcccacagagttaaggatgcccagacccattttttcataacattttcccttaaaggtcctccccttccccggatacctctccagtaactctggaattttgaactatttggaattcaaaaagcagctacttttgatttattctctcagagttaaatggctgcttaatattggccccacttttgtttagttttttatctcatttgtcttccttgttatacttacgcactctgttatacttggatactttgaacttgaacgctgtaacagatgcagttggaactgaatgagctgtgtggtttgggatttggcagtttgagagttctgctgggaagctttcccatttttctgcactgtgtcccacttcccttctgcccccttgcaccctctaccaagttcaaccctttgcctttgttgtttatagtccatattttgccttttttttttttttttggttcttttacctcccttcaaaaatactgtacacatcccagttttgatagggtattcatgacaaaaaattctgcagttcttgttactctgagtgtacttgtgggaaatgagtggctgggagggtatggggaactgggggaggcactgatgagaagaagctctctcttcagaagggcattgctgtgtgatactcctccagaatgtgccatcgtaggataaaagctctgtcacatagaccttggttggctgattcaaacactgttaaccctgttttagactcatatttcaaagtttgaactttcttagctcaacagcttttggacctgttagtcagacctagctattttcttaatctagctttattacatcctagaaatgtgtaccaaaggccacataaaaagacaaatgattaatagttaactagaatgtgagaagaaaactacttgtacattatttggtagtggagttaagatacctaaagatattttccttacatcactattcatacagaaactgaaaaattatatgtaaaatatcaacccaggccaggcacggtggctcatgcctgtaatcctcacactttgggagaccgaagtgggcagactgcctgagctcagaagctggagaccaacctgagcattgtggttgaaaccccatctctgctaaagtacaaaaaaattagccggaatggtggtacacacctgtagtcccagctactcgggaggctgaggcacaggaattgcttgaacttgggaggtggaggctgcagtgagccgagatcgcaccactggactccatgctggtcgacagaaaaaaaatcaaaacattatatttttaaggaatagtgtttgtaataaattacttactggccccagttctaaataaatataaatgttattagctgtagcacaaaagtaaatatttcagaactagaagagtttatcctgaatttttaatttatgtaggcaaaatacgtgaattgaaaatatattccttaccatgttaacaccttgtaatacacagtatctctttttttagtaaaggaatttctccctcaccccacattcatactctttatatacagtactgtccaaaggatggataaagttgaaaagtatacatgaattttgaaaatatgaataaagtatatggaacttcacagaatttaaaatgtattgcagttcagaacactgaaaatcctgcagtgtctaactgggtcagaggaaaacctttgaagcttcgttactcatactgttgctcttccatctaatgccataatgttacacttttgaatttatgaggtgataaaaatatagtgtaattttaaaacaaagggcttatttttaagtgcaaatagtgaaagaggttgcttattttatctgactctcaagaattctcaggttctcctgtttaaccattacataattgtccaggctacatgagtaagtaaacatttttaaaaagagagttggcagactgcaacacttttaatttcaagtagttacttattttaaaataattttttatgaattccaaaaattaatgtcataaattatttcaggattgattggacgataagtagactaaagattgctatttgcattttggtttaggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatggtaagtatttaatattcttttttgtagtgagcatgcaaatattatatatactttaaatagtgctaagtttattaatggataatagggtttgtttttgaaaaccaaaatgactttggttcaatgccagctgctatcgcttcatcatttgatacgataaaaaaacaacaaaggagaggatcatgaacttctgctgtgattccactgggtgcaaatctgtcttctaaatggctcttctacagtagtgatggaagtcagcaattgtattattttgacatatgagaggtattaggctgatgctgagccctagaaaactctttttgatgatctgaaggtctacctgattgggaaggatagattgttcacatgaagatgtgggcttgggagcaggatttttaggtagataacaatgagtgagctggaaacactgacagtgctgcctaaaagaaaggattgcttattccatggctgatagattcattgggttcaggctgcttcagccattgctgctgtgcatattattgtcagatatcttagggccaactcaggattcagtttgatttggtggtattttacagatcttcttagtggtatttcctagtaaagctatttttaaaattttatttttacacattattctaaaaacttttaaattgaggtattgcgaagtaaaggacataaggtttactgatcttagagtgcagctaaatgcatttttacctatgtatacagccacgcaacccacatacatcaaggtatagaacatttgcagcacttgagaaggctccctcatgctcttcccagttaataacgctcctcctcagaggtaactgctattctgacttctaacaacacagattagttttacctatttctgaacttcatacaaatgaaattatatggtatgtagtagtgccttaggttaggctaatttcagttagcataatacttttgagatttgtccatgttgtgtttatctgtagtttgttctttttattactatatattagtccattgtatgaatatgccataatttatttatccattcttcttttgaggatgcttaggtcgttacccaggagcgggattgttgggtcagagggcaggtatatatatagcattagtagatacaagtaaggcaggcatgacctacccgtgaccccatatcccctctacttccctatctttctttttatttctggtcatgattcataaaagagttatctgcacttcctgagtccatttcctattcattcttcagtccgctacagtctgactttgactttcacaagtgcaccaagtttgttctccctcagggtctccagttgctgtggtctgaatttgttccccaaagttcatgtgatggcacagtgttgggcagtgagactttaggaggtaattagggcaagaggactctgccctcgtaaatggattgatgctattatctttaaagtgggttaattatcatgggagtgggctcctgataaaaggatgagtttggcccccttctgccctctgtcttgtgagctctcttgtacttctgccttccaccatgggacgatgcagcaggaaggtctcaccagatgctagcaccttgatattggacatctcagcctccagaactgtgagaaataaatttcttttctttataaattacccagtctgtggtgttccattatagaagcacaaaacggactaagacaccacttatgtcctcgttagccaaatttaatacactttaataacaattatctcttatcgaagagataagagataataatacttatctcttgttgaaattattgaaacatacctctccctccatttaataaagctactggttcttttaactatctgtctcctttgcctttctcccctcctcccacacacacacagcagaattgtttcccagggttccgtcctttgacctcacctgttcttactcttcagccaaaccattaacctgctaatctgttgtcctggcttctcctatataaacaccgataactgttcagtctgtctctctggctttagtcttgctcctggcacatatcaccatagacatcatcttcctctggccaaatttcctgtcttggtgaatgatgccagtcctatccattcacccaaacaagaatcatcctagacccagcccgattccgcatatccagttgattaagaagcccttttgcttttacattttaaacaaatctcaaactcattactttctcttcatctccattggatttcgcattctagtcatttagttatttgtcatggtggccttctttttggtctctttaagggatggtttcagattttgtagggcctcaaacttacacaatttgggaggtccttcataaggaaaaaaacccacaaaataacagatacatatatgtacaaaagtaaatatttagaatgataagtgaaagcacaacaaattacaactaaaaagttgtcaaatactacagacatttttaaatgtatgtatatatttttgagacagggtcttgctctgttgcccaggctggagtgcagtggcatgatcatagctcactgcaacctggacctcctgggcttgaacgatgccccccacctcagcctcctgagtagcaaggactacaggcacgtgccaccacacccagccagtttttttatagaaacgaaattctgccgtgttgctcaggctggtctccatctcctagactcaagccatctgcccccctcagtctcccaaagtgctggggttacaggcgtgagccaccacacctggcaacagatctttttaacagcctgatacttcttcaacttttcttatgttttttgggtgaccatagtctttggtcatctcttcatatgataaccactgataggttatggctgtgtccccacacaaatctcacgttgaattgtcataatccccatgtgtcatgggagggacctggtgggaggtggttgaatcatgggagcgggtttttcctgtgctattctcatgatagtgagtaagtctcatgagatctgatggttttataaaagggcagttctggtcatgctctcttgcctgctgccatgtaagatgtaactttgctcctcctccaccttccatcatgatcatgaggcctccccagccatgtggaactatgagtccattaaacttccttttctttataaattacccagtctcaggtatgtctttgttagcagcatgagaacagactaatacaaccactttatgatattttctatagagatgagaatgataatcagtggaatctgattatcagttatcacacactcaactatacatggaagtgactataaaccacaaatagttcattaagcctaaggttaaattccctttggcaacatcccccaaatgcccacagttactccagagctgcctgatacaagatgaagtgatttggagtggaaagagacaatagtcttgactaaatatcttagtttgcaaattttacaaaagaatatgaccatgtgaagatatattgctcaggttcttcctggggcttggaaaggatccacaagaaaagagtcttgaagcttgagcttcatcagctttatggtaaattggcctctggtgtgctattcctggtttgtctctttctgaaataaattctctcagaatagttatcctagaatacaagtcagatcatggcgctcaatgctttgaattctttgagaactttcttctttgcctcttattttgcaaaatttcaaacctaagaaagttgacaagaataagacattgaaccctagattttataaacacacacacacacacttttttttggctgaactatttgagagtgaattgtaaacattatgagatttctttattcctaattactttagcatgtatcatctaagaacaaggccgttatcttattaagcctaatacaatcatcaatcaagaaatctaacatactattacatttttactattatttaagatataatctggccaggcgcagtggctcacgcctgtaatcccagcactttgggaggccgacgcgggtggatcatgaggtcaggagatcgagaccatcctggctaacacggtgaaacccggtctctactaaaaatatgaaaaattagccaggcgtggtggcaggtgcctgtagtcccagctatttaggaagctgaagcaggagaatggcacgaacccaggaggcggaggttacagtgaaccgagatcgcaccactgcactccagcctggacgacagagcgagactctgactaaaaaaaaaaaaagaaaagaaaaaaaaaagagatagaatccatattttcatttccccggttgtttccttataatgtgctttatagctggggtttatcattgttgttgtcttttaaccaatccaggatgcaattaaatattacacattacatttagttgttatatctctcaattctcttttttttttctttctttctgtttttttttttttttttttttagaaacaggatcttgctgtgttgcctaggctggtctgaactcgggcctaagcaatcctcctgccacaggctcccaagtagctaggattataggcatgcatgaccacatctgccttctaatctcttttaatctggagcagtacgcccagtgggtttggggggagggaccgtgtctgtcataatatgaacatttttaatgagcccaggccctttagtttgcataattccttcatttatgataaatgtgcttgcaaaatagtgatgtttctatcgttcttcctatacttattggttgatattcttctgtaaatggagctttcctttttctctgctcccaaatttttctcttagaattattatgattcatggatttctattttaaattcagtattttgtgatctgttctgattattcttttggatgctcacattgctccatatttgcttgcagggagtcatttcaagctacctctaatcagtttttagccccttccttattttctggcacaagatattccaggctcagactttgcctatcccagtcctagaatcagccatttcttcaggaactctggttccttctagggggcaatgatatttagaaaccaaggtctgggctctaggatgctcatgactttaggtgtctttacttctgcgccctttaattggctagagctagggattatactttttatttaaattatgggcactgatgcccttatttcaatctggtattcgtatctcatttcaataactttttcttgtaaaatctttacctgaaatacaagatccttcatgaggtagcctctgactgtttctataatcttgcagggcacaatcccctgccttatgtatcagtcacactgaactacttgaaaaacttaatgtctttctttaggtctaggaaagtcttaactgtgtgacttcagatatcaccatccatccattttctctattctcttcttttgggacttttgttagactgatgttggaacttctggatctcttctctgattattttatctttcttttatatttcttattgctttatttctttgtgttgcattatgggagagttccttggccttttcttctggttcacacattagttctgctgggtctgttctgctattctgccttattaaattttttatttcaaaagcttttcataccagatctctaatggctgttttcataagttcttgttccaatcttaaggatgcaaacttttatttaaaaaaactctcagaccaggcgcagtggctcatgcctgtaatcccagcacttcgggaggccgaggcgggcggatcatgaggtcaggagatcaagaccatcctggctaacacagtgaaaccctgtctctactaaaagtacaaaaattagccaggcatgctggcgggcgcctgtagtcccagctactcgggaggctgaggcaggagaatggcgtgaacctgggaggcggaggttgctgtgagccaagattgcgccactacactccagcctgggggacagagcgagactccatctcaaaaaataaaaaaataaaaaataaataaaaaaaactctcaggataattaatgatgcttaataattcagttttgatttttctattaagtttggttttaagatggcattataagtcgttctacttgatgagattttattttatggtatggatacttcttaaacattggggaattcttaatttgcctacttttgcagttgactttccttgttggattgatgccttcctctttctctgcccagctgctgtctggggatgggggtgtaagtaggaaaacacccaggatcaacaggcttggctgcttccactggggttctcccactcatccccagtcatttgcctttgggccgcctcctccttgttgctccctgcattgttgagcagggagcactctaggtgtggctgcagtgtgagcctgtactcagagcttcaggaggcctcttcggtcctgtactgcctgccttcattctctcaagcactcctagtttctgggctgatgaggtttcccctctagtttttgagtgttgctgtgtattcagtccttcctgcctccctccctgtctttctccctccctctctttctccttcccccttccttctttcctcccctcttccctccttccctcccttcttctcctcccccccatttttttttttttttgagacagcatgtcactctgttgcccaggctggagtgcagtggcacagtctcagctcatggcaacctccacctcaggttcaagtgattctcctgcctcagcctcctaagtagctgcaattataggtatgaaccaccatgcctgggtaatttttgtatttttagtagaggtggagtttcatcatagtggccaggctggtctcgaactcctgacctcaagttatccacctgcctcagcctcccaaagtgctgggattacaggcatgagacaatgcacctggcccctctcccccttccttctttccttccttcctccctccctctctccttccctcttctctccttccctctcttctttctctcctccccccttccccctttatttcatcatctctgtgatttggcagggaggggagatcacagtgtgggcttagctttccatcttgaaactggaaatgaatgttttcctttcttctcacatccagtcccctgtacatgctgtattcttaactgtagtgcccctctacacagcccctatcatatcagcatagcaaattcacacttatcttttaaatcattacactttctgtgaagccttccgtaatccccccagacagttaactttctctcctctgttgtgtggtggctttggacatctttatttcagtgcttattatgttatattataactgtttgcagtcatgtctatcttctctcagttgactatgagtttttatatcattgcatttttatatccctggcacttgatgtgtggtaggtactcactaaacgtttattcaatgagtgaatggttttatggatgatctgagtaagtgaaaaaatcaatttcactaacaagatgaaattaatttgccatacaagatgtaattacaaagtaattacaaagctaaatctggctattcaactcgaggacctatattggcttccccccatccatcccttggaatacatgaaactgtgttgggtgctctcctggtaattcccttggaactctttttaactttttgtttgtttgtttgttttttgttttaaatagagatggggctggccacggtgactcacgcctgtaatcccagcactttgggtgactgaggtgggaggatcacttgcgatcaggagttcaggaccagcctgggcaacatggtgaaaccccatctctaggaaaaatacaaaaatttgccaggtgtggtgatgcacaccagtagttccagccactaggtaggctgaggtgggaggatcacttgagcctgggggaggcagaggttgaagtgagcagagatcatgccactgcactccagcctgggcgacagagtgagaccctgtctcaaaataaataaataaatacataaaaatttaaaaaaattaaaaaaatggagatgggatctcgctatgtcaaccaagctggcccccaactcctaggttcaagggatcctcccacctcagccttccaagtagctggaattaagcacacgccatcatgctcagcttcttgaaattctttttaaagttaaaaagaattcagccaagtataatccagtctcatttctttcctttgttacacatttttgacaactttgaccctatggatgtcttcatcatacttggctctgaataaattttcggcttatactaaatattgaatctatcttgaaaagagaattttttttcagaatgtgcttagaatgtattcataggtttaagctcccaaagacaggcatcctttcagttatttctgaagctctggtagagcctggtcctttactaggctagaatttttgaaaagaatttctaaaacttccaagcagtggcaatgttgtaagaattaacctgcaggttcccaaagccactacttttcaaagatgttatccatttgaatgtcagagttacattgtgcttgcttttaaaaaaaaatagacagcattttatgataacatcttaagcatataagggaaaaaaagactataatgttagctagaagtgtagcactcattcagagtcacgtgaccatgccgcaccacaatttaaaattagtttgaatcctctgcttgttcctgattaaatggttaatgtaaattaatttaatttagaatcggttctactgctataaccaatacaagccagacttctacttggaatcttagatcatatagctgactgatattgaagaatataggaatggttcaaaagagaaccacaaagtaactattaagaaacaaaagcctctcaagaaggttttaagaagtaagattttagaatccagataaagggtaggtagctaagtggcaacacagttacagcataatatggtgtagaaagactagacattttttcctttctggtgagtgaacaaaaacaaatgtcttcagtgacatagaagagatacaggggcactttctaggaacatgtgtaggtaagttgcttacaaccacgcacagtggaaaaaccaccctgctagcataaacctgaaattagttgtattttctccctcaaatcagattgttaaaaattattttacattatgttcacttcacttttccacttgaaacactcctgtctctgcttgatttctgtccagaaataaagtttaataagatgatctggctacccactccattccatcaacataaggagacctttgtagatataagaaggcctctgttttcagaaaatcaaaggcactgtttaggaaggctttgtgaagaatgtgaaataccaacatgttatttttcaagataggctaaattctgtatgaaaactttatttgctccaaacttaaaatgatcttagaaaaagtaaaagtaaaatctcaaattagaatttatggcataatttagagaactcaagtttaatttttaaatcactgtatctttggaatcagtaattctctactaaaactatatttttatttttccttttggtgtcacttttattatcaggtggagcaagtagcagtgttatgattgcttctctatctctaacccacaaagagacttggaaaagccacataacctctctgagcctcagtttcttcctctgcaaaatgagaatatgaatatatggcttctgagctccaaaatgctttcagtgaagctaaaattatctaagccatgtgtgtctgtgtgtatgtgtatgtgcatttttacatacatggtatgcatatgcactaaatatatttagcgtatacccgatatttacatatatctgctccatctgtatgcaattcattcacagggaagttgctgcatatgcgatgggggagttgctcaaatgtcctttcagggccagtgtacttactccctcagttattggggcttgttggctgctgctgatgcacatctgagcccctttccatgcattactctgtgctgatgggagctgccttgcccaagttatccctgctccaggggctcagcccttgtctgattgctggtcgatttagggataggatacagctcagctacctcctttccccaaatgaggaacaactctaaaaggccatctaagctccagagccccctgtaggatcagctttggtccctgttccaacagtactgcaattccaattttccttctacccagtcccgcattcctcacccctgagaagcgttattcccaagatcactccccaattaaccttctccacaccactcttcatcttagagtctgcctccccacgggaagccaatctacaacaacatgcatttctagaaatgaatttaccctcttttgatctggcagcctttttgaatggtgacacatctgatgttgtggtcacgatacataacaaatctggctgacaaatatggagttaaacatatatttttagccttactagggatgttcttatagatagattgttctaccaccttcctagccatagatgtatacatggtacaactgtgaattttgggactttcactttttgagttaatcctttttatttcttcagtttttaattttttaatcttaaagaaaaagataaagaatgattgaacttgttctctgaagtcaaatgcgttagagtttaatgattgaaatgtctgaattaataggaatgtacttcctatgaagtttacaaagagagtgacaattttgttgcctggaaaatcaggtcaaattgaaggttctgttacaatagaagtgtaaggtttactcaaactttgtaaatagatttcaagtttattatattaaaaaagcaaatccactgttttccatgctctccatggcaatcaagttgttacatttatcttcttttctactggcctagaaatactgatattcaggatgtcaaggttgtgtaaaaagaagcaggcccacgagtactggttgtttgttaatatccattcacctacttttaaatttttctattttctaaaatactatttattattcttgcagtgaatgcttgtttatttagggagtcattgacactttgtattcagagtttagtgggtagtggatatactgaatgcttttgaactgtggctctagtatgagctctttgttgtttaatgttcagattgtctgtgtaccttttttttcctgtttaatttcgaaactctttgttttaaaatttgttttctcagaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtggtaagtggaaattcctgttaagtataaagttatttgtcaggttgcctctttaggtattttgtagaacatcagttagaacttcagctttaaaagcatggtttgtcttacttaaccttgagaaataaaatgagagtgagtggcaaaggttttatcagaataaaattataattttatttttctctccaaatgaaccttttctatttaatatgatattttggaatttttcatttggtgatctttagtagtctttgttgtatgtatcaaaagcatgtttacttaaccaaacctgtgatgccacttttaatagtcatctttatacagctgaatgagcctggcagcctgagccagcaggccctgaaagttctctttcatttccatctaccagttggaaagaataatttttcttcctctgtgtgtgctttggcaaaattttatatcctcctaatcttgttgtggctcaaacagattcagaggaactacttatataaatagctgcttgttggatatgtgggagcaaatttgcttgcttggttgccgtggcgcatattgggttctgcagtcattttgatgctgatgttaacacatagcacctcccatatagtattaggactgtaatgtccttggagaatactgtggagttgtatcatttaagaatttgctgacatagaaactacatttccaaacctctaagaagcaactcctctcaacagacaaatctgatatacacggatgagaagttaaaagcaaagaaaacctactttaagcaggagcactttggcatccgccatcggttccctagctcttcaccaagtactctttccaatacgccccaatattcattatgtaaattcatgttaaaatgttgaggttccacagatgactacagaaataccatttgtgtaaatgggtaaaataaagaccaaatataaatgctgccaatttccatcaaatataaatggcttttattcacccaataatataaagaaacattaatattacaatgttaaagaagatatactcacaatattgatattatcgatgactgtgagaaacttttgttgcattcatttatagtgatgagcagtgagtagaaaggtggataagagaaatttaatcttcctttcaagcagattatatactagtggcttttaaaaaaatcttaatttggcgaagaatggtgcatttcctaaaatacctgggaagctggagagcaaaaagatggtttggttttgcttattgtgaaggttcatttgtcagatagttttatgcactagatttggtttcatttgttgaggggaggccgttcccttggaagccacaggtctccttgctccctgttctaggatcctgaacctgaaattcccaggatcattcttcccactttcccactcgcactttctctcctctctttctcttcttctggctccttttttctctttcttcctaatatctaatgttgcaattagggttagaggcatgatgaggattgatgtggccaaggttgggagaaagacgtggcagtttctttttaccttaactcaagccctgttgagaatatggaaacaagatcagaatggtatcattttagatgttttactttctagtaaagtacaactgggatcttgagtgtaaaatagaatggcattggcaaacatatggatggagatgataatgttagaatgaaaggagcattgaaaatctgcatttaagggtcagagttgaagagctgtgcaatactacccttagacctaggccagagagaaagccgcctgccttccagctttagagagctccatctgtccgtcctccagttgcacccctccccacagggcacaagtcagtggagccaagggttgtgcccacctggagctggtggacttcattcctttctagacctgcgctgtccagtatggcaaccactagctacatgtggctatttatatttaaatgaattgaaataaaaccaagtaaaattcagttcttcaagcatatgaaccatattttaggtgctctatggctacatgtggctagtggctactgtattatataatgcatatattacagaacatttccatcaacacagaaaggtctatggaatagtgctaggactatgctcccaaatccagtaccccagaattctccggccactggtcctgggtctgtttcggcctgtgcaggccattttcctgggacagtcctcctgatggtggaccacattgctggtatatgcacccctaggcctgcggggtggccaaagggtgagtctttatggggaatgggggaggggacagtggacagagctttgatgtccacttgtgtgcacagagctctttaaagctctgtgttagagcaggaggtgagaagagaatgggtggtcttagggctcaggaattagggatcagctctccctttgctgtatgaacctctgaagaatctgagaatttaaatataaatcttgcctgccaggcttttatgatgatgtatttgtcaaaacagaagtatagaatatcttttatataacagtttgttttcttgatttacagcgtttaaatatttaggtgtgtggtgggtgggcctccatttggacttttgccccaggccttgcaagctagggcacaggcctgaagctacgtaaatgcacctgagagagatttttagtttgtaaaggacagattttaaagaaatttgttcaagagaagaaagcgaagtttcctggctcatgggaacatctgtagacatagaggcagctctgttcctgctttaatttcactaatattaactgtggtggttgcccactgagaaaattattaccagccacacaattgtagtgcttggctttctcgagtattcaagagagtagctgcgtgggatggcatgcacttataatcccagtgacttggaaggctgaggcgggaggatcccttgagtccaggagtttgagtctagcttgagcaacatagtgatactccatttctaaaattaaaaaaaaaaaaaagaatatatatatatatttgttaaatttgaaaaagagaaccaacaattccttccttgaaaaaaaaacttttattttaggttcaggggtacatatttgttatacgggtaaattgcatgtcacaggggtttagtgttcagattatttcactaaccaggtaataaacatagtacatggtagatagttttctgatcctcaccctcctccctcccaccaccctctcaagtaggctctggtgtctgccggtcacttctttgtgtccatatgtactcaatgtttagctcccacttataagtgagaacatgtggtatttggtttcttgttcctgttagttcgtttaggataatggcctctagctccatccattttgccgcaaaggacatagtttcattctttttatgtctgcatagtattccatcgtgtatatgcgccacgttttctttatccagtctatcggtgatggacatttaagttgactctatgtcattgctgttgtgaatagtgcatgtttctttgtggcagaatgattaataacaattccttcttgagtggatagtttatttatgttcagagaaggcacaatctgctccactcgattcattttttaaataaaaacattgtttatatgtgtttgctaatgcatacgtataaatggtactgacgtttaaaatgtttgacaattgtgacttcagatgcaaattttcatgttggatatatagttttgttggatcttcaattaaaatttgattcctgttttagttggagtattttatgattcaagccttaaatcagaagacaagtgaaaaaatgaagaaaagaaaaatgagcaactcctttcatggaattagaccacctcaacttgaacaaccaggtgcatttcttagccaatgtctagacattcattaaacattcattacagatcctttctcacaggtcttagagcaattattctcaaacttgagcatgctcagagcttacctgacattctgattcagtcaacctgggataaggcctagaatctgtgttaatcagcctcccaagtgatgcaaaagcagattggtacttgaatcacattttgagaaatactgctttaaaaattgagcctatagatcctatgtgtcctaggtggggagctgttctagattaaagtctaatgctaagttactactaaatgcaatgcatgaaccttgattggatactggttcaataaaaacatctaaaagatgttcttgggacatgggttaaattttaatacggactggaaattagattatatcatgtaattactgttaattttcttatgcatcataatggtattgtgatgaataggagaatgttcctgttcccaggagatgaaggtgaacgtagagtcccgggcgcggtggctcacacctgtaatcccagcactttgggaggccgaggtgggaggatcacaaggtcaggagatcgagaccatcctggctaacacggtgaaaccccgtctccactaaaaatacaaaaaaattagccgggtgaggtggcaggcgcctgtagtcccagctactcgggaggctgaggcaggagaatgacgtgaacccaggaggcggagcttgcagtgagcagagattgtgccactgcactgcactctggcctgggcgacagagcaagactctgtctcaaaaaaaaaaaagaaagtgttttagagccaaaggatcctgatatctgcaacttttaaatatttcagctgtgtgtatgtgtgtgtgttgatgtgtggatgtgtgtgtgtgtgtgtgtgtgtgtgtgtgtgtctttctgtctctctagagataaggggaaaataaaaaatgttaataattgcaaaatccacgtgagggatatatgtgaagggtatatgtgtgttcattgcatcattctttcaacttttttgactgtttgaaaatatttttaatacaaagttcagggcaaataaactttaaaataaataaattatatcaactgttatcagaattttctgcatgattttgtaatagaaatagtaggatagcactttgttggatcaatgtcctttggaatttaagggacctcatctctttaaaaaagtgcagatatatagaccacatatatatataaatgatacacacttggcttttaatttcctggtgtgcaaagtgaaaggggagacatggtctattaggttgcaaacccttgggccttaaatcctttctggattagaaaatgggtgggaaatgaccacataaataatgtagatagttagttcttagttcttattaatcaagaagacaaaatataccagatcctcagagaaagcaaaacattacatgtcatttagctttaaaagaaatatcttggcccaggtatggtggctcatgcctataattccagcactttgggaggccaaggtgggcagatcaccaggggtcaggagttcgagaccagtctggccaacatggtgaaaccccgtttctactaaaaatacaaaaattagccgggcatgatggcgacgcctgtagtcccagctactcggaaggctgaggcagagctgcatgaaccagggtggcagaggttgcagtgagccaagatcataccactgcactccagtgagactctgtctcaaaaaaaaagaaaagaaaagaaaagaaaaatctcttgtgtgggtcttcatgtgagggcactaagtgatatagtggacagggctttcaaaagtgtctcttcaggaaatgcagcctcagcgttcacaaggctgtttcttgtactcttctgttaagagagctgtgtgtataacactaaagatattccagaggttcagaataatacagtctgggtacatatttggggctgatttgttccaaggacggatcctgggctctggggcacatggcatttagggttctgtaaaggggccacaggcagtagaagggaggagggtggactggaatacagtgcagggagagcctggcctccaaaggacttcgttattatctgttttataggctggggtttgctttggaatcaagcatttttattgctaaagaagtttgaattctactgatttagacggttgcatacccttcaaacaacccttcacaaatgtcactttcctcagctcctctggataaaaatgagatggcagatgttttacagttagggtctgtggtgagggcctggagtgtaggtattctgagttgattgagggctcatctctctttgttggtgatcaaactagtaaactgaaggttatattctcttttagaaattagggagctgagttagcacttttgctgaagtgttttactagaaggaaaaaatgctagttttggaatccaaataaaggggtcacaatgttttcaaacgatcgagttcaagactctgagccttgactctgagaagttgcacaattttaacagctcagccctctacctctacttctggtcccaggaggaaaaggacttcagatgtgagattgggttctttggaacttattcagtactttgaatttttaaaatcaaaggtaaaagtaaagaaggatgactgtgaaatactaaagttcagtatttggcggcttgttttattttgggacacacaagtaagaagaaatgttattttattgttccgtacgtcattagtgggtttttcatttgctctataaaatgtaaataaacatagtatttgtgtgtctgtgttataacattctacagttcctgaataattagtttatatatgtttataaattaggttaagcagtagtagaaaatcgctgtttttgtgcatcaaaaaatggttaaatattggctgtttcttatgctttaacctaataatattttaaaatattatacaattatatttaaagtaaacatgaaattgttgggtctgtaaacctgaaaggagtttattatttttattttctttttcaaaacagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtatcttgtcaagtggttctggttacttacaatctcataagctttggaaatgaaatgtgcctgtgacactcaagggtactggttagttttacagtggtctttacctaccatctgagattaagattatacatgaaatattatttgctttatatataagaattggtccaagctttctgttttccttacaaatgtacttgcctcatcttttccctatcaatttcattttattgtggtaaaatacatagaacataaattttaccatcttaaccatttttaagaacacagttcagtggaattaaacacattcataatgttgtgtaactatcaccaccatccgtgtccataattctttgcatcttataaaactgaaactctatacccattaaacgatgattccccattccgacctctttccagcccctgacagccaccattctactttctgtctctgtgattttaactctcctaagtgcctcatgtaagtggaatcatacagtatttgtcattttgtgattgatgtattttacttagcataatgtcttaaaggttcatccaagttgtggcatgtatcaggattttcttccttttaaggttgataatattctgtagtacatatagaccacattttgtttacccattcattcatccatggacgcttgggttgcttccactgttttagctattgtgagtaatgctgctgtgaacatagtgtacaaatatctcttttgagactctgcttttattttattttttgcatatatacacagaagtggaattgctggatcacatggtaattctgtttttgattttttactgccatactgttttccacactagctataccactttatgtgcctacaaactgtgcacaagagttccaatttctccacatccttgccaacacttgctgtttattttttttaatagtagccatcttaatgggtttgatgtggtatctaattctggtattgatttgcatttccctaatgattagtgatatcaagcatcttttcatatgtttttgtatttgccttggttttaaatctacttgtaaaaaccataatctgccaaacaagtatgttaatattttatttctttaaaaaacatccaaaatatgaaatgtgagaatttattgtccaatttagttttaaagacataaaatattccaagagtaaatgaaatcaagtgtctacaccttaaaacctagctattcactcttcggtttgactcttaggttttgtagggcgtgaaagagagaattgcattcagcttacggactggaaatcaatatccagtgttagttgaggtctaattaactttggctatgactatcatagacgttacttttttttttccttactgtgccctttctttttaagatttagcttatcaagtatttttctctttgcccttttaaaaactcagtagcaactatattttaaagatggaagttctatctgagtcattttagcaaatgaattgaaggtcttacatctaagtgtcccatgtaagagtggaaaagaacagatgtaaaatgaattttaatgtaagcatctaaatataagttttctcagaactcctgtctttaattttctttacccacttcaaatcatgtagcgataacctgttaggctaaggtcactcctgctctgcagtgtgtctggagaaacatttataattaatttgtttttagggttcaagtaaagcctaattgggaacagacaaaaagtttaaggtttgcaaggcaagtatcatttcatacaggtagggaaatttggggcagcctttatttaagtaattgatgttaaaaataaggtattactttgttcatgtggtttgtggtcatgtaattttataagttaaaacttaaattatgattttgaaaagtacagttgcagcacgcagatttatgtggataaaaaatacatattggagtagaatgtggtgctaggttagtgaaatattggcttggaaaaagcataaattaagcacctgtacagcacacacccagcacattgccttcaacgggttctctgtaagttttagttgaattaaagagtaggctccagtagccgggcatcatcatatcagtaagccaaactatttaaagacttcatttagtactatagattttgacgtttaaacttagaatgtcacagttcagaatttaagattttgaaaaactaacatgtttacatgttaagagaaaaaagatgtttttaatcatatgtttaaggaactgtgagggatgtgacttttgtatgataattttctgttgaaattacatgaattattcagtaggcttccacaattattattgactactttcaaaggcatatgagcactctgacgtcttatatcctttttaacatagtagcagtaaaatagctagatgtatctccagtggctgatcctgcctagctttctcctagggggagtgctttatttaattgcaaaattaatacaggcagatggaaaaaaagagaaagaaaagaaaaaagttatccttctaccctagaccctttccccggagtcatttacctgttgtaatttttttatgcactcattctgatactgtttgaaagagattaatattctggggacatttgattaataaaagtgtaatcctaggtatctgctgctttccagggatcacaggccgtttcccatggctggagcgtagagtgaaaggtgatggctggtgggtgatgaggtgggcaaggcctgtggaagctgttcctgctgctcttagacttgtgctagagttttaagcatgatcagactgggctttagaaagctcatctctggttgtggttgcagggtggaacagtgcggccaagacaggcattcaatcaggaggtcccattactctggcgatcagcctcaggaaggccaacattcagacagtgggtggccctgccattggcccttcatcgtctagaccagtgcttttcaaaccttaaagtgtgtgcagatcatctgaggatcttgttcctgtggagattctgattcagttacctggagtggggcatgagattctgcatttccagtagtctccgaggtggtgctggatctctggactgccagaagcagctggaatacctgcttttggaagaactgggaaccagccaaaaccagcaaactagggcctagaattcagtgcagaggcccaggaaggctaccaagttaacagcttaggattcaaagtaaaaatggggtgagctgtaaggctgactgatgcagtgctattcagaactggggctctcagtgccctgtgtgtccctgacgcgaggaaaaatggatgcctagtggttgggtggaaattaagtaagcctggaatagggatcggagggcaggcaggcatgatggtgtggagagcctgctgagctacaggtcttcaaccagttcagagtcctggcttcttaacctgacactgacccgtcccatttcggctgtgatctctccttgtacgtcacggccaaagccggaggtgctgtctggtctgagcaggggcacgggccattgacccggggctgcagagatccagatgctggttaaggaaaagggaaaataactggttctgcaggtatctatttattattctttaattatttacagattacaacctctggctcaaggaaaagtttcatttacattatgttaaaaagagatatcaaagctgtatttgcacagaaaagacaattttgaaaaatgctgaaaattaagagaaaaaaatttacccagattccactatcaacagaaaatgtttaaacatttattgctttgtttgatcctctagtcatttgtttgtgtatgaataagtgacactgtttttgaaaaaatgtattttgtaatcaaatcaaacaaaaattttaaacctacgtttttctcagagacttcagtaaatgggccaggcttgttttgttttgtttttgttttaacatttttaaacctgtgaatagaatacaagtgttaaggcacagttatgcagtggttttcccacagaagtgctgtggtctgcccttgggttatgctagagaaccattgaagacaggagttgtttgtttgtgttcccatcagatgggttggtaaagcagaggttgaactccatcatgtgctcaggaatatttgccttgagcaaacacgggctagagagttataataagcctatctcctgtccttgttttttttttttttaaagaaccagattacaaagaatatcttaattctttttaaataacatgctttttttaacctttaggaatttgaaatttggtgtgtgttatgtcaccatgaacatttggttcgttatttaggagcgacctgtttaacaacagtccggttaacattttacacctatctattcctattcaaatttttgattcagtagacacagtcaaggtatatctgttttgtatacgttagttttctattgaataacaacaaacactgcataatgtataagtacttaactactaatcctaaggaacgaggagtaatgtgataagtgaagccagccctttcctggtcttcagggagtaattcttacatggcatacaattgtaacattcttataatacttgatacagtgttatggttgcacattcttgagtcatatgatctcagatggttaggaagtgaagtatttgtaagaacctcaagaatttagctttgagctcttcctgccacagatggcccttagagtttcacatcacttattgaaatgccatctgagtagacaaatatgtggaagcaagctttcatcttcagtttacattctccagttcttagaatcattccgtggcatgtccttttctgtattgcataaaaacacagcctagtatacatgagtataccatgcgctctaaaagtctaagtggattcagtgctttaagaagttaactaaagaaaatcccagtcagtgatgcaagatgtcatcctgcccttgtctgcagttgatcaatcagtaaagttatgcaagatgagtaagttctggagacctgctgtatgacattgtgcctattgttaatgatatcgcattatatacttaaagttttctaagagggtaaatctgatgttaaatgtttttaccactggaaaaataaaaggaaagtcccagccttaggattactggtttattaggacctaaaagtctcaaagatgacttgattaatgtttctaattatgaaaacagcccaatcagcagtgtgctcttgagaattagtcttactttcattttcagtgagtgattcttcctgtgtgtgttctcagacagttcagtggcctgtggggatttacctgctactgattccatctatttagattatttgatgcttgcttgcttttagataatcttctgaatggagatattttataggtgttttttagttaatatgcttttacttaaataacaatgtaacttttacatatataagtatgtaaaagaacacagagacagtacttatgttcttctttagattggatgagtgcagacataaaaaatacttacatgttccctttcctgcataccactaacactgggtttggataatggctgaaatttctttcctttttcctctttttttttttttttttttttgagacagggtctcactctgtcactcaggctggagtgcagtggcatgatcatggctcactgaaatctccgcctcctgggttcaagcgattctcctgcctcagcctcccaggtagctgggattacaggcagacgccaccatgcccagctaatttttgtatttttagtagagatagggtttccccatgttggccaggctggtctcgaactcagtggttgaaatttctaaagggaaagcagtggccgtcagcagcataccatgcacattagggtcaccagggagaattttaaaacactgatgccaggggcttcaggcccagaaattctaattcacttgatctggagatgagacctcctctcatggtattttataaaagatctcaggtatttataatacacaggtatggttgataatcactggcatagagtaattttattgatctgggatccattggcttctaaggggttcttacactctcacattgttatactgactttaatgtttgtgtgcacatgaaattttctggtcatacaatcccaagaatttatgagatgggaaaagaggatgtggccacacagttaaaaagcattcatgcagaaagagaaaaacagaaatcatagagctcttctacactacacagctttgagaatttgaggaggaaggggagcaatcagtgaaagcataaaaagagctagcaaaggcagaaagaagcagtggtgtgctggagctggcaccagcttgtgagagcccagttgtgtttatcatccccatttccttgttctgtgatgtcatgttgatagcatcaaaaaatggcaaatgctacatatcatttgactccctcccccaggagacactgtaagtattaggaaggccaggtggggagaagttgaaaggatatgcattagtgcttagtgctgcagggctcagctgtaagagcctgagagcttctggacttgcaatctgccccttccaattggatttggttttagttggtacagactggctgcaattgcctgatctcattggtttaataagtgtttatgtgcctgcctcattccccaatatccatgaaggcatctggtgagtgctgaatacaggaatgaaaacatcagaagaaatgaactgagagcagataaaaaagggtcttgaattacccagagaggtgaagtgactcatcacactagtagttaatagctgaggtagaactggatcctaggtctcctaactataccgcccacactaggcttcttgaattatatttttatgagataggaccttctataaatcataggatggatgcgtgtaatctcttggaatgtcatgatcagattcgtgcttttgaaaactcaccagctttgagtaataggatggatttgatggggaaaaggctgttaggaagcagggaggttggataggaagttgctgcagaccaagtaagagaagtccttggggaaaaggtcagcttttgctgaccatagaataagaattttgcaagacatagaggaaaagaggctgacagagtgggagaagtgaaatgagcctaggaagagagttttgaagtgggctagggaaaggcaaaggacagtggggtgattttgctccgatgacatgagctacgtggacgagtagctcccttcctcaggctggttttgtagagttggctctcaagcatcccagtctgcccctgacaatgcttgagaccttctgaatgcattctgttgctgctgcatgttcctctacctgatgatagtcactgctgcccataactggtaagatttaattcacccttgggaaagaccacatctacctttttactcagggcaagtaaataatttgggtgctggaccacttgtcatgggaactcatattctgaccattgctgttatcactagctgcccacctattgcagagaggtagcagcagtctggggaggaagacttcagattttgagaaataatttaggggaagttaaactgatcgttttgaaatgtgagtactgtttaaatgttttagtatagttataaggatgtatatctggtaaagaaaaattaaagcactaaaaaaagggaatgttgtatttaataagagatttacttttgttacttcctcatttaacagaaaaatccagcatgtactaatttgtttacaggtgcttttcagtgggaagaattggaagaagatatcaggaagaagttgaaagattctggggatgtttcaaatgtaatcgagaaagttaaatgcattttaaaaacaccaggaaaggtaagttgatttgttgtaagttagtttactttgaccctctgaattataactcacatactatgatgaatataaaattgagtcgttagaagagtcaaatactgtataaatgtaaatgttttccttaagtatattttaccatttaaatatttaaaacataaacatgggttatttgtatcttagattgtgtgtgtgtgtgtgtgtgtgtgtgtgagacagagacctgtgttgcccaggtgggagtgcgttggcatgatcttggcttactgcagcctccacctcctgggctcaagtgatatctcccacctcagcctcccaaggagctgggactatagatatgcatcaccatacctggctaatttttaaattttttgtagagacgtggtttttccatgttgcccaggctagtctcaaactcctgggctcaagcgatctgcccaccgtagcctcccaaggtgctgggattacaggcatgagccaccacactcggccctatcttagactttaatttatgtaagaattaaaatacatgtgagtcatgtctttaaaatgctcgtttgcgaattctgccttctgaaacattcccctggagctctgggaatacacaatctatatcatgaataaaaggctgtttaatttgtccaggtacagttaaggttattagagagggtgccttctcactcctcacaatttaagtctcaaatagtttttgagaggaaggcagttttgaatgtccctttttcaagtgttctgagaaatctattcaacgaggtggacagttaaggatgatctcatcaattataggttcaaaattataaattagattcaagtttataaaaacagactttgtatattgccatagactggtgcacattaaaactctagtaacttggtattgtgtagtctgtaagggctttaaaaaacatttcaaaactttaagacattacacaatttagccagtgtatttttttgtctgattttgtgataaacaaattggctgcagtagataagtaaggtaagttatatgcaatacttagcggagtaaaggtatatattaactataagaaaaatgatgattcctttaattttttaatatagatgacttttctgttttctaaaacctgttaacattttaaagttaatgttttacaaaaatgaaactgtactagcttttagtgaagattcttgattgttctttagttgagaaaatagtcttttttgtaaacaaagtaacgtggaattaaggggtaagatttttttttttttagtaacacattgaagcaggtatacagaagctgtccagttttacaagtatatggcaggatggtagctcttgcagtctaattcaactaaataatcatttgtaaaaatttgcacatatgcctatattctcgttttcaaaacagttcatctagttgtcttgattaacttgtttacggaccagtgaaaatgtacatcacgtacatttgtgttctctcaaacttctgctctcccatttttttcaaattcaaaacagaattgatgagggaatctgtttatagattctctccctctctctccagttctctcatacattcatgtgtaatatacatctataaaatattcataatatgcaaattcataacctttatatggctgacaagtacagaaatcttgccttttcttctaaccctaaaccttttcttgagtcttgattcggaacacattcctttgaatactgagaataaaatgaattcttattggggaaagggaaggctgggtgatacgattccatggtattgcgctgaattccctcctctgcacggggagaaagaagagttatttcacaccttcttcctgtgctttcccagggtaaggggctgtctcatttactgagtaccacacaggggtgtaactctgaattgggacttgggaaatgtagattacaattgtgaatctgccacaaatcatctctgtggctttgagcaagtcagggcttcctataaaatgaggggtaaattggatggtttctgaagcctctgcgagctctccaattcagtgacgctttttgtttttgttttttgagacggagtctcgctctatcgcccaggctggaatgcagtggtgtgatctctgctcactgcaagctccgcctcccgggttcatgccattctcctgcctcagcctcccgagtagttgggactacaggcgcccgccaccacacccagctaatgtttttgtattttgagtggagacggggtttcaccgtgttagccaggatggtctcgatctcctgaccttgtgatcctcccgcctcggcctcccaaagtgctgggattacaggcatgagccaccgtgcccagcccggtgatgctttttgactgctactctcgttaagcgtggcggtcacttgactcccatgcccgaattccttccatgtgtatgacggttatgttgtgtataggatctcagaatgactttataggaccaggatttgtatgatcctgttttgcctctctgttttgcttatggataccattctggaatgttttcttctgccttaggaggaagaataatatcatttttcccccctcaccgaagattttaaacttcccaccatagtagattagagtaagaagtagatgtcatttattcttattactgctgatgttatatgtttatttcttagggataaagctttcagagttccctagctaggcaagcagaggattagcattctgaccagggctctcaggctctgagattcagcagggggaatgggtggagacgtcagaatttaaagtgaataaaatatgatatttcaataaaaatcataactaagtctttccaaattagggaacaacatagactttaggcaagattgtggtcctaatgaatcctagtatttaaaatgacttattatttcatcatcatttgggtaacactacctgaaaatattcaggcttgttttgtttatccactgtaaatagactaaaatttaaaaaaaaaaaaaaaaagagaaagaaagcaaagcaaagaaaaaagggtggagggtatggaaagggaggccagcccttgacttccaggagggttggcacacaggggatacctgaagaccacagaaaggataaagcactgaggtctgagttagacagagaggctgctcccggagccactagctccagccaggcgcgacaggacagacgagttatcaagggtgagagtctccggaacgccagatcaaaaacccaggaaactctttataggttctagtgggctctgctgtgagtaggaaggacaattaggattataagattggagatgaagatggaggtgaaccagctgggcccggtggctcacacctgtaatcctagcattttgggaggtcaaggtaggcggattgcctgaggttaagagtttgagaccagcctgggaaaaatggcaaaaccctgtctctacaaaaaatcagctgggcgtggtggtgcatgcctgtagtcccagcttctcgggaggctgaggcacgagaagcacttgagcctgggaggtggaggttgcagtgagccaatatcgcaccattgcactctagcctgggccacagagcaagactccatctcaaaaaagatggaggtgaaccacttcattactctacgttatttttttaactgttcactcctttaagagaaaatgttaagctagtaagtagaagaaggatatggtgtgataagggaaagttgtatttttctttcttttttttttttggagacagggtttcactctgttgcccaggctggagtgcagtggcataatctcagtttactgcagcctctgccccctgggttcaagtgattctactgcctcagcctcccaagtagctggtattacaggcacatgccaccatgtccagctaatttttgtattttcagtagaaacagggttttgctatgttggccaggctggtctcaaactccagacctcaagtgcccaccttggcctccaaagtgcgggattataggcatgagccactgcacctggccaaaaaatgtatttttcttaattacaaatcaaggactgtcttaatgaacaaattaggttgtacatgtaaacatattttagtaggcatttgtatggagttggactactgttgtctgtttctcaacaaagactcatagggtttcaggaccttgcagcttctcagcaatggagctgagttttcacttaggcaatttgtttactgctgtgaatgccaaagagagcagtgttgttcactgacaggcagcccatacagttcttaaaggtaagttcctttgaaacctgtgatcagagatgtcatagagtagggaatcatatttcttttgagatttagcataattttccaaattcctagcctagcctatatgttatcaaagcatgttaaacaacctttccctgtatttttgttttcccttatagattaattgcctaaggaattgcaaaacctatcaagccagaaaacctttgtggttttataacacttccctcaagtttttccttaataagccgatgcttgccgatgttgtcttcgaaattcaaggtacggatcaacttttacaaagtttatgattcatttttatttcttgttttctttccttgctttctacttcaggtttgaatgtttggtgtgaaggaatgattattccctactgaggtatgtagattaatactaccttaatgtcaacaaaatcttccaggtaaataggaagtattttattaaaatgataaaataaatttatatttcccttagtattttttcctttgccatatgcttcatcaacttttagggcctagcaagggatggggtgatctataatattttattatatatttttgtgtgtatttctttaagatcctagtgtttgctgcatctggagctaacccccttaaaattattttatctctagcttattttatccagctctcttcctttttatttgagcaaaaggaattgaccattattttattcagctgtcttctgtttcttttgagcaaaaggactgagggttatgcctggcccacctcaggcacccatagatattgctacatttattcctcctagcactctgagaattttatcaccagagcaactgagagctgctgcttatctctctaagaaagtaagactacctaattttaatgaagatgagctgtttgagtgcccattattgatcactggcttggataattttgtcactttagtagattaagatctaaagaatgtggtgggagctgccagcacacaaggtgccaccaggtgggggagaggcggagggaggggacgtggctcatcgccatgtgcgtcttgcattctgtccctcactggccgctgacctgcctgactgcacaagctctgccgctgccccatagaaatacttggattacccagtctttccgcagacgagaccaggttactgggatcctcatctcacttgggcttatgccaaacatgtaaaatttggtgcaggtgcctgagccttaattcttcaaggtgtcgaccttttagccgatgccgtagctgctacagtggggccgaagggaagaactgtgattattgaatgaagctagggaagtcccagagtaacaaaagatggtgtgactgttacaaagtcaattggcttcaaggataaatgtaaaaatattggagctaagcttgttgccagtaacactaagatgttgccagtaacacaaatgaagaggctggggatggcaccaccactgctactgtacttgcactccctatggtcaagaaagtcttcgagaagattaccagaggtgctaatccagtgaaaatcaggaaaggtatgatgttagctattgatgctctaattgctgaacttaagaagcagtccaaacctatgacaactcttgaagaaattattcagtttgctataatttctgcaaatagagacaaatcagcaacatcatttctgaagcagtgaaaagggttgtcatcacagtaaacggtggaaaaacactgaatggtgcgttagaatcaccagatctaatttttgtgtaccttattaatacatcaaaatttttgcatatcttattaatgtatcgaataattaggctaaatttttgcataacttattgatacatcagaaggtcaacaacatgaattcaaggatgcctatgttctgttgagtgaaacagaaatgtctagtgcccagtctattgtacctactcttgaaattgccagtgctcagtatacacctttggttgtcattgctgaagatgttgatggagaagctctatgaaccttccttttgaataggctaaaagctggtcctcaggttatagcagtaaaagctccaggtttgttgacaatagaaagaaccagcttaaagatatggctcttgctgttggtggtgcagtgtttggagaagggggtaggcctcataacacaggaaaagttggagaggtcattgggaccaaaggtgatgctatgctctttaaaggaaatggtgacaagtcttgaattgaaaattgtattcaagaaatcattgagcagttagatatcacagctagtgaatatgaaaagggaaaagtgaatgaatggcaaaactttaaaatggagtagctgtgctgaaggttggtgtaacaagtgatgtcaaaactaatgaaaagaaagacagagttacagatgcccttaatgctataagagctgctactgaagaagacatcattctgggatggggttgtgccttgcttcagttcattccagccttggactcattaactccaactaataaaaataaaaaattggtatagaaattattaaaagaatattcaacattctggcagtgaccactgctaagaatgcaggtgttgaaggatctttggtagttacaacaattgtgcagcgttcctcagaagttggttatgagctatggttgggggttttgtgaatatggtggaagaggaatcattggcccaacgaaggatgtgagaactgctttattagatgctgcttgggtggcttctccattaattacagcagaagtcacagaaattcctaaagaagagaaggaccctggaatgggtgcggtaggtgggatgggaggtggcatttctgattcctagaatagggcttgacatttattaatgaacggtgataggaagctcaaggcagtatttctcaccagtaactacagagaagtcatttgaagaaaatgactgaagaaaatgctgggtgatgtttttaaaaaatcactacaaccatcagttactgatttcagctgacaataaatagcagtttactgctgtcattgtccatgcctacaaataatttattttgtatttttgaaaaaaaaaaacatttttacattcctgatactgggtgaaagagccacgtacccatgtactgctttaagcttaaatcactgaggcatttttactactatgctgttaaagtcaggattttagtgcttgctaacagcagatgagaagttaagaagcagcttttctgtggagagtaagaataattgtgtacaaagtagaggaatacccaattatgtgacaacctttatgtaatacagatttgtttaaagttaaaaaagaatgaattgtcagataccttcagttaggcaagaaagatcgaaggagctgttttccagtgaaaatctgagtagaactttagatgggcaattactaaaaggaagatataatctaatttaatagtagaattgtgtagcagcgaacaatagtcatttacttttaaaaatatttcctcagaaagatgcacattacttttaactttggtcatctgccaagacagggaaatggaaactttccaatgtaccttccgacaagccacggccagccctgtgtgcagtgtgagcctgggacgctgaaagtagggcagcaagagtgaccttgagatacagaaaaacaactgggaaaaaagctaacaagaggacacagactttatatcatgctttcgtcattttagagagacctataactggctctaagccccttatatgatcacaccttgatttatttgttgcctaaataaagatccaaagtgtctatctaaagacaactttcataaattactcattataggtaggacacgcctagtcagggataaagctcctggtgattacagaattctctcattagcttctaggagaaaactgtctgttgatgaagacatttactaaaagtgtttggtacgctctatccataccagagaaacacaggaatagataattttgtacaatcatctaagaagcttctcatttcaacagaaaagactacatccattgttaagaagaaatatgattggtaaattaaaaaatatttccacctttctaaaattagcttttaaaaaaaaagtctagtttatggagatcgaatcagtttctgcattctgaaagaaggagaatgatgccgctggagatggctgaatgctgtcttccagatgacttcctggcactggggtcacctgtgatttagggttgattggactcacactgagcagactctgcaagatggagataaggtgggggcaaaccattccagtgaccattataacaacctagggcactgcttttcataaccagaaaaagaattggtaatctgaaggttatatggtgaacatatgagagtagtgtctagtggtgtttgatccagggcctggtgagttctggtagatgtcttccgtcctataacatagtgttgtattaaccagaccaagcatctctgatcttcctggatgttctagctactggttccatggccagggctgaccagtctcttaacatttgcacagtatttgatacaaattaggtacagcatactcgattaggtatttacttcctaggtcatgagtatgttttagacctttgtctgctctttttttttaacctaggtcctcttgattggagtttcggatgttcccaaacccctcagtcatcccctaagactctggaattttgggttattctctaaatgactaatctcattctttgtgtgtgtgctttagaagtttaactgtgagaaggaaggcataattcctggtcgcaggaggaaacttaaaatttccactaataaaggatctatgttgttacattgctgtgtctcctacagtccctagaactgtgacttgcctttaataaatggctattggtagtaagattaatcatcctaaacttgggaatccaccactgaagcataaatgtgcttgaagaagactttgccttgtaataaacttgtgaaatgaaagagggtccatctctttgccagcgatgttcattttgcagcatagtttgagagcaatctttttcaagtaaattgaatatgaatgcctggccccatcatacattaatgaattaggggttgtctcccatccccaccttttctcttttgctgtgttataaaatagctaccaaatttgcttataatttgcataggaggcattggtatcaaacattatgttagcataactcactgaaaagattttcgaagggaatatgtagcacatgaaaatatatgtcatattaaaaaagagagataagcagtgatgtggtgaatccttgctcctcctaatggcgtgcttttcttccatgattctacctactgtaggcacctgctcccctttcaccctttatgcagggctggggtcaggaagggctggctggatgtctgtgctgatgatgtgcagcaactgctgtggtgctcttcattgcttccctagctctaaaaccaagtcttcttaggagtcagaagcaaggaacagcaggaatggtggaggcaggatctgggagcagcttctctaaggccagctataggcaaggcacaccagctcctgagagttggggaggggagctgtaggcagcagcagcagtgtcatttcctcaggatgggccccagttccagccttggctttgcgtcttgaccagtgtgtctgtgggcaagtcacctgacatttcttgtcttcaagtctcatttgtgaagtgaagagggtgacgaaccacacagataacaagaggttctttttagtgttaagagttatgtaactaatagccatccctctttgattcttcttgcactacttgcagggtagcagtgagaaaactaagaagaaattttgagttagaagttgagtgaattcttgttcctttcatggctaaaatatgtgaccaccagcccactgaatgaaatggagcgtgtttgaatttgcctcactgtggtcactctggaagcaggctcagcttaccagggccatttctctgatgtacctttggaattcttccaaaatgtatagggagaagtagaaaaaccagaggcattctgagtgaggaaataagcagatgactcagcaaatcaccaatctacttcatctccttgaatagcaaatagttgaatttcatgaagaaactttaattttttctgattatgaaagtcatatacaattgttttaaccaagtgtgcacagaatgatcacacttatagaaaatgtctgttttgttcataagtgaattaaaaaggtcaggaaagatatattccatattatgaacattttttttagaaaatgaaatgggcatgatgattagaaaaatgttgtaagtgctcattgtaggacagtcagataatatataaagatgcaaaaaataaaaaataaaaatcacccataatcctatgccctaataacaatcacagtttgattttggcataatttccctcaagtcagttttcctctgcttagaaaaaggggttgggaaaatagatactgtctactcaattgtgtgtcttttatttttaaacttatgtcttaagcactttacactggattagaatccccttgttaacatttttaatgtcattatatggctatatcctattttcttactgtaggtgtaaatttaggtatctcctttattttcattattagaaataacagctgcattgaagatttaatgtaaatatctcactctgaaattagcattatgtccttggaatagattccttgtcaaagaataggaacatctgtaagacatcataaatgctatgaaattgtatatgtccagaaacattgtactaatttacattcccattggcagtgtatgaaagtgcttgttttcatacaaacaaatccttgtcagcattaagtatgcttatatcttaatttttcttgcaaatttgatacaactgtatgtttttaatgttctagtctagaatcaagaagttcagactgtgaaaatcaaaatccaaatctcttctgatccattgaatcttttagtattgagacatttgtattacatatatatatatatgatagcattgactctggcagcaactctgctagagattatatatgtaaatctcaagtcttgaaacagtgttgtattttggtattggtattcacagccctacttgccacatgatggtagagcagagatttgcactttaactcaaaggcgagtgtgagagtgcttaaaacacctggttagtgcacctagaaaaattagattgatttcagaatggcacaatcataactgtggctctatttaaagtcaaattgcattctctcatgtatcctattttacattcttgtcattatctgaaaacttataaaggttaagtacccttaatctaaaaacccaaaatccaaaatgccctaaaatccacgattttttgagtgctgatgtggtgctcaaagaaaatgcttattggagcattttggattttggatttttggattagagttgctaaactattaaggagattagagatcctaaactattaagaatgtgtgtgtatatatatatgtgtatatatatatatatacacatatatatactattaaacattcttaataatatatgtatatacatatctctctctttctctcaaatattccaaaatctaaaaaaaatggaaatgttgaaacatttctggtcccaagcatttcagataagggctactcaacctgtgccaggcatgaaggtttgctttttagatcatgttaatgcctctcagtgtgacagcctttgggctctatggttttgaattgtagctaaattattaacagacagctaaattttaatgtcactctgaaaaatgaatgtctaattttgggggctgtaaatgggaatagcaattggaagtgtgaaagtacttctcaccttgtcattgatgtgtaatttaaatgttttacaccaaaccaaaaaaaaaattgggaaggaaaatatttttatattttaaatttatgtcaaacttaagacagaccctcaaagtaaggatcagtaatcagtctcaaatcttaattataaactttttttaagttacagtgaagtcttaagataaacttacaatttttttctatacacttaaaatatttatgatgcaaaatacacacttcaaaagattcatagttgtgaaataattcacattggaatgtaactttgatattatcaatacaaatttatgggaagtaattggaataataatttaaaaattagatgattatctatctaaatgtaatgttttggctgggcatggtgactcatggctgtaatcccagcacttttggaggccaagttgggtggatcacctgaggtcgggagttccagaccagcctggccaacatggtgaaaccccatccctattaaaaatacaaaaatcagccaggcaaggtggcagacgcctataatcccagctactcggaaggctgaggcacaagaatcacttgaacccaggaagcagaggaagctgtgagctaagatcataccactttactctagccggaagacagagtgagactctgtctcaaagaaaaataaaaataaaaaataaaaaaataaatttaaaaaatgtaatttattttataattatattttgtaattatttcacgcaataataataaatttgaagtgacatgtaataagtctttggcttctttactccagttttgagcgtgaatattaacctcatgagcggtttaaggaaaactaaatgagaatggaatctatggaacaatttagaccagaactgatatactgaggcaccttgatgaggtggtagtgccatgggtcagaaaggcctggttaagatctttgcttggatgcatacttactatgtaggtttggctatgttactttacatttctggttcttttggttttttgcctataaaatagggatactaattccgactttgtgatgtggtcacgggggttgagatagtgcatacaaaggactagcagaggcttcacctgcagactccactcctcttcacctgcagtggcagctagtactggtggatcgctgtactttttcctgctgaacccacgttcgcagtcaatctttcctttaaagtgtcccaggccttcccccaaaactggctggaattagcctaggatagaaaatgggataccatcccctgtaataggtgatcctcaaatatatatattttctctaccactcccaatttgttgttttggcgtgtaaaaaaaaattactatagcagttctaaagtcagtcttggtaaatatttagagaggtacggatgtccttttgatatgagtctgtcacatgaagagttctttagaaaattacattcccttctggtttacttagctagtacatattttggatctctcttgagctaggtaggtatccttttttaggaatgaaaccaaaaacagttctaaaaatttcacttttgaaacctggaaaatagtatgaagaaagtgtgacaaatgtattttattttagtaaacagtcaaagattcttgataatctatgtaaagtgactagaaaacttgggcttttcatttttgtttcactcttgtagttcttttccttagaaaaaaattcttaaaattgtaacatcaaatgaatactacaaagaaaagatagtttggccttgacagtttcaaggaacatgattatcttttaactagaaaatgctatcttccatttccttaagtaatttctttacctgtatcctattgccagttagtacgtaaaccataaaccgcattatgttccttcagcatatttttatatacagtgttgaaagatctaaccatactaaggtattgtattacagtttcacaacagaacaatttataacatcaaaacagtagtttaaagaggtgaaaaactgaagttgatgttttcttaacaggaagcgtaatggttttccaaactaaattccaaccttgaaataggcttaaaaatgctttaaggtacagttggctgggtgcagtggctcacgcctgtaatgccggcactttgagaggctgaggtgggagcatcacgtgaagccaggagttcaagaccagcctggccaacacagcaaaaccctgtccctagtaaaaataccaaaaaagttagccaggcatggtagcgcatgcctctaatctcagctactcgggaggctgaggcacgagaatcatttgaacctgggaggcggaggttgtggtgagtgagactgtgctaccgtactccagcctggacgacaaagcaagactctatctcaaaaaaaaaaaaaagtacagttgttccttaatgtccataggagattggttccaaggacctcctgcagatacccagatccgctacgctcaagttcgtgatattaaatggcttagtatttgcatgtaacctatgagtatcctcctgcatactgaaaatcatctctagattacttacaatacctaatacaatgtaaatgttatataaatagttgttatactgtattgtttagggaataatgacaattttttaaaaactttgtatatgttcaatacagttgcagggtttttttttttttctgaatattttccactctctgttggttcgatctgtggatgtggaacccatggattcggagagctaactgtactgagtgttttgttgctgggttttgcaactctgttataaccacattatcaacaatttctgttaaaatttcaaggttacttatcaaattctacccccatcaactatctacttggtattttttggtagatcttaaatccctgtgcttaacccaagtgatagatcatccagtttatttaagtcatgcttctaatttttaaaaatatagtgccctatttatctttaacattttaaaaccttacaattacaagtcaaatggcatgacctgtttgtattctttattaactgctgtatacaaatacagccagcttgctttaattatggaaactggtccttcccggtggagggacactgtcccagtgaggcgaggaggggagtgtgcctgccaggaggtgagtgttgactgggtgggagggcttcccaagttacttccctgctcctcaggtaggtgtggctgtgcaaatggcagtgccgagcagtaggctcagagctggcagtgccaggtgttgcctatagatcctgagtgattattggctttggaaaaagccactgggcttagatgtaactcttttcttctttcctgagacaggagatgttgtgcttggatttaaaagggatgaagaacccaataattgtaaatgctttagagaagactatatatccctgatgagtatgagattttagagatgtgtgggtaaactcttgggcagggctgagtggcttggtttggttggagagttacttcctggaatgcgacagctttgtcactcacactggctgtggtgtcttctacgaaagtaaaaactgctccaaagcagaggtagctttgtcttcctcctctttgtgtcttcaattccaaatgcaatgattggcacatgctgattctcggtaataatctgttgaagtgatccaggctgaactgaaggctggcagtgtgtattcgtggttttctaaggtggtggaagtagagagccctggccactcacggccctatccagcgctgcctttgtgtggtgcagcagtagctagagagcctagcaagcttttcctagagagttaattcagttcggtgagttcagtgagcagtatgggctgagagagccctcaaaattcaacgtagcactggctctcccagcagcaggcattgttcaggtgagacagaatggttgcctgaggaagtagtgtgctggggagactgcagggattaaggtcatcctcttccagattttcattaagtctgaaatgctctccttggctccacaagagatcctcttgctattcctactgtggtgtacggacagcttatggtttacttcttacagtttcctgtttcagataaggggaagcatggccaagatggttctgtgagtcaggcccagaagggtaatggggttgttttcttgggaggcacatgggcacgggtagtattattaatatttcaagccaattggaaaggattgatgtttcattataaaaatatgaagcaaaatacttcatttcagtgtttctatttctggaaatacaaactaagtaacaaattgttgtcttgacttgcaaattgttggtttcaaggtcaacatctgaactttctttattgctccctttaaaattaagaagtttctggattaatggtagttatcactcccaaattcagattctgcatatcagcctagctgtccctaatgtggtagtctaattagaaggaaaattgctggaataaccctgcaggtttatctcacttgtttcttgtttcccttttgaacctttcaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccaggttagcaatacaaatgttgatagtatctcagaattctttctttccttgccacccattttgttaaattgcactctgtggaatctattttcatttaagatttattagttgacatcacggaatgtactaagcaattagaggtggtgctggaacaacaatgaattttcattcagttcaagtggaagtgcagtgattgggtgccttttatgggtctccgacgccggcacaagttcacatgtcccagccagcacctacagcatggggatcactgtaggcaactagaaatggaggtgtcttgtggtacccatggctaccgtaattctagagatcggggcagattgttacttggagcgctgtctcttccacaagaagaggagggttgcgcaactgctttgatgtctgtgacttctgattggggcacttttaaggactttcaatattctgagacttttttggtcttccttctgcccagaggatgtgggatttgtaaaggcctccttctgacttctgctaaagtcagaaactcctcaaactgacttctctgaaaacttttcttgagatgtttagaatacccagtggactgtaggattcatttccaaattcactgaccaaggactatctttgaccaggaaccaaacatctgtgacagctctaggttggaacagatccagcagggttcttctagctggaggcacttgaagaaatagcaaaattttttctacaggcctggagccttgcttgggatgctggcagggaagccctctgtgagtagtcttcagcctttggccaccagatggctcccaccacaagcacaactagattcggccccgtggagctcagttcaggagcctgagaccttgattagagaacctggtcaggcaccctaataaacataaaaagcaaacacacatttcaagccagacctctcttcagattcactgctttaatttttagaatggaaaggtttcttacactgggtattgaaataagttttaaacaagtcatgagccctctagtgaaagattttagaagttcaaaaagaagcaaatgtatttgtgttgattaaattaattctgggcttgcagctttctgtagagtattttggagccagttgcagttgtttctgtcagtgttaaagactgacttacggccaggtgccgtagctcatgcctgtaatctgagcactttggaaggctgaggtgagcagatcacctgaagtcagttcaaaaacagcctgaccaacatggtgaaaccccgtctctactaaaaatacaaaaattagctgggcatggtgacgtgtgcctgtaatcccagctacacgggaggcagaggcaggagaatcgcttgaacctgtgaggcagaggttgcagtgagccaagatggcgccaccacactcaagcttgggtgaccgagtgagactccgtctcaaaaaaagacttagtatttttgcctaataaaaatgaaagcatttgttctttttggaaataaagcttattgtttattatttcattgttggcaaatctgtatattaaatttacaaattgaccagatttggagtaataggaaaatttgattttcagtcatcctctcactcaagtaattgaagctgctaatattaagttttaccttgctaattagaaaatattacagaggaaagcagtaataatgataggatttttaaaaattggcaaaagtgtgttagggaaaaatgagtcaaaatgaataatcaaaaagttaagccagatactggaatctgtgcattgggaagatcacagaagacaggtaatgttattatgttaaatattcaccatacacagtgttcttggttccatagctacaaaagaatgtaagaatgtaaggagggataagaacgagaattacatgaaaaaccagatttctagggaagtattgaaaaaacccccagccaaattgggtggttgccaggggctggggaaagggggaaacagggagttagtgtttattgggtacagagtttcagtttgggaagaagaaacatgttctggagatggtggtggtgatgactgcacagcagtgtgaatgtacttcatgccaatgaatcatatacttaaaagtggttaaaatgggccggatgtggcggctcatgcctgtaatcccagcactttggaaggccgaggcaggtggatcacaaggtcaggagatcgagaccatcctggctaacacggtgaaaccccgtctttacaaaaaatacaaaaaaaattagccgggcgtggtggtgggcgcctgtgctcccagctcctcaggaggctgaggcaggagaatggcgtgaacccaggaggaggagcttgcagtgagccaagatcgcaccactgcattccagcctggacgacagagtgagactccatctcaaaaaaaaaaaaaaaaaaaaaaaaaggttaaaatggtaaatttcatgttatgtttattttatcataataaaaacaaaacaacaaaccaaccaaccaacctgaagactaatgtcaagaaaaaaaaatggcaaggatctagtttagctaacggaaagatttaccagatagtcctggaattaatttttaagggcaattatagaatcaccttttctgaagaattaaaaaaaaatagattcacttctgagtatgaaggcttggattctttttatttttacttttttattttatttatttatttttattttattttatttttatttttatttttttgagatggagtattgctctattgcccaggctgcagtgcagtggcatgatctccgctcactgcaaccttcgcctcccaggttttagtgattttcctgcctcagcctccccagtagctgggactacaggcgcccgccaccacacctggctaatttttttttatttttagtagagatgaggtttcaccatgtccgccaggatggacttgatttcttgacctcgtgatccgcccacctcggcctccccaagtgctgggattacaggtgtgagccactgcgccggcccttctttttaaaatggaataataggccgggtgtgatggctcacatctgttatcccagcactttgggaggccaaagtaggaggatcatttgagctcaggagttcaagaccagcctgggcaacatagtgagacctgtctctacaaaaaaaaaaaaaaaaaaaaaaaagaagaagaagaaaggaaagaaaaaaaagataaaatggaataaaagtgcagaatgctgactccctcgaggcttttcctaaccattctattctatggtggatgctacggtcagcatgtttttttaattgttgttttttgttggtggggggtgtttagatcattaaagaaatggtttcatcatccactttctctcatgtcccttttctcatcagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaaggtaattgactctgtgtatctgatagcctagttttttataaaatatttttcaaattatactattttaaaatttatcattttttaacatacgttaatactagtcttagtttggaagtttggctaatgaggctaaagtgccttcacaacagtttatctggctagataattttgaagcgttagggtttgtgtgcagtcccttttataaggaggcaaaatgtccagatacggaatttttttaactaaatagtggcccttagtagagtcatttgaatgtggtgctatactatgtcacataggcattgtaggaaatagaatttatgttgaatttccccaaacaatcacatcttcaggttcctaaaagggaaatgacagaattggtccatatatactgatagcgatggttaagctaaactaatttacttcttcattttttcatccatataatgaacatgttttgaagtttcagttgtatgtaggagatattggtgtgcctcatttatccttgcagaatgccttttgttttcatgtctcaccttattagcaatcactgccgtatgtgtacatgcttcttctgggcctcttgtaagctcggagtcttttgttttcaataattatatcattactgattttagagaacgggggtgggggagttacataattaagttaattttaagtaactgcagttacagaggccctaaattatgaatcagagccaggtctgtaaataaactaggactactgtgttgaaatctacttcccaaacccccagatgtgctcacagtcaaaaacctgccaaatccttattcccactttctttcattcctggaagcagaaagcttattcagatgggccatcctaccgttggccattctgccattccatccactgcccgagacagtttcagcacttgtggtagttatggcacactcttgtgtactcaacttgtggtaagccgagccctctaggtttttttcacaggaatatatttgttcaatcactacagagtgtcagtacttcttgaactattatctggcatccaacatgtctatacctatcaactttgacgtccagggttacaaaagcatgacaacttttatctccatccacattgctaaaatggagccacatgatggggcaaattccagatctgtgacagctgaatgcttgcctccaagctgaaacgaattcattcatcaacacttctgtttatagaagggaatttatttgaagcatctaggtcttctcctactatctccttaactattttggacttcatttctctcataatcaagtcttacgatcacatgtatttaattagggctaaaaacaaatttaaaaattgagtagggccaggcgtggtggcttacgcctggaatcccagcactttgggaggccgaggctggcggatcacgaggtcaggagatcgagaccatcctggctaacacagtgaagcccagtctctactaaaaatacaaaaaaaaattagctgggtatagtggcgggtgcctgtagtcccagctacttgggaggctgaggcaggagaatggcgtgaaccctggaggcggagcttgcagtgagccgagatcgtgccactgcactccagcctgggtgacagagtgagactccgtctcaaaaaaaaaaaaaaattgagtaacactgatctctttttgtaaaacgtttacattcatctcatgataaatagctcccctctaaatttagtttacaatttttaaaattctttctagtagtttcacaatctcagttcatttttgatgtatcattttcatactattctaacaagttgttcatactttttaaaaaattggacacaagtttctttttccttatcttttagtatcttcttaaattgtttatgtataagagaacttcccgtgtggtcacattgatttctttaggtgcctcccctcactgcccccctacacttggttcctcatcagaatcatttttgattgcactgtcagaaattcttgacttgttttccctgattctctggtttctgactctgtgattatccttatcttttccccttgaatttcaaacaatctaagatacaagctcattttgaattttgtttctgaagactttttattttctaagattaagcctaaatttaccagttttcctgtattcttttcctggtggttcctaatttggcaattgtgaattccagataacagaagttttcttcccaagttttctttgaagttcctagtttgagatttcacttcaccagtcagttcaccctgttggtcagaatttggttaacttttgccttgccatttctctgacttttaggagtgaaattgtcttctggcagaattagactcccagtagctctccaaataatcaaaatttctgaacactctgccagttttgtactgtgtgtcaggaaacatcattcatactttcttagatagatgagcagtgtgggtattctctcacttctctgtccattttcccctaacctctctcagttctttaccatgatttaccttcaggtttccatcaaggaggactcttaaaatacaagagttgaggtggagattccgtatctctactcctgtttaaaccctatctgttcaaactttggtgattcctatgaagttgtatttattcttgtattaaaaattttaatgcatcttcttatttataatctatatgttaatatttggctatctgaggcacaagttgtatttctgagagtttccaggtactttcttgtgagtttatgggtattttctccacgttcttcttgtagctcttaagttctattgcatttggtttatggttttttaatgcctttttaaaaattctgttgcttatttcagtttgaacccattttcttacgtcaacacatatccttctaaaacctagtttttacagtgagacatgttccattcctgttacagagtccctagactatgaatctgggccaggtctgtacattagctagaactgctctgttgaaatctacttcccaaacccccacatgtgctaccaattcctcattcctcagttctttcattcctggaagcggaaagcttattcagatgtgtcatcctactgtatttaagatattttggataatatcttaaatcttggtcaaaaataaaattcttcatttttaagcatgctttgtagccagctgtttatttctgtgacctcccttttccttctcagtcacagcccttaaggcaatgtcctaacctcctggtgttttgttatctgctctgggttaatcacgtaacagtagtggtggcttctctaaaaagctgaaggttcttattcttttcccttgagattgcacacattcatctgctaaaagataaggggaggaaaaaaactgttaaaatgttatgtgggattagataaactataaatttatttccagttcaaaaattgattttatataatgaatataagagggacctgtgaatttgtgtttaaatactctcacactatacagctttaaaaaaaaaaaaaagcatatccttgagtttttttattaaggtttagagattactaatctttcttcaatttagcattacttgttgcttatttaatatttttgcatctccttagaagagctatacttagccaaaaggtggaaacaacacaaatgtccattgacaggtgaagagataaacaaaatgtggtatatatgtacaatgggatattattcagccttaagaaggagtgaaattttgatatctgctacaacatggatgaaacttggaaaatattaccctaaatgagccaaacataaaaggacaaatattttagaatttcacttatatgaggtacctagaatagtgaaattcatagagacagaaagtaaaacagtgggtgctaggatctgatagggatagggagaaaacagattgtttaatggtacagagtttcagtttggggtgatagaaaaggcctggaaatggatagtggtgttgggttgccccaccatgtgtatgcacttattagtgacatttaactgtacacttaaggattgttaaaatggtaaattttatgttacacatattgtaccacaataataataataaaaaaaagagttctatactcatgtgccaaagttgcctgccagcaagttactgtcatctgcattggtggttggatggatcagtgagtgtcactggatgggcaccaaggtgatgatgtcagtggcctgcttgcttggagttttccctccattagcagctattggaactcagaatgaggagaatggagctggaaatcctgctcagtttactgtacatctcattaaaagcaaatatttagccacagctttctcttagaaacatttacacattgaaacccatgccttcggccgatggtgtttcctcctcaaaatattttttggcttgctcctcaggtgaacttgttttaacattgctcaccatcatctactacacagatacaggtgcagttattgaagtccgtggcttcagattaaaagctcaaattaaatcttcaagaacctcagatgcagccatgcattgcttaaagacgtttggccactccggcagccgtagattgttattcgctgttggcctggcttcttccgagaatgtacttttaacgttatttgctaatagtgctccctcatcctgtctgctgtcacagtatactgaaagctgcatcaggtaaaggcacattaaacatgaatatgggctctccgtgattgctcccaggccgttctcttgatcttatcataccagtggccattatgtgcaatattatttcacttttcatttttcttgcagtttcaccactctgattgcctttcaacctggctacttcatttcattgctactaactacctcatcttcagtcaaaagcctgaatttcaggatctttcaggtagattgctaatttctgttttgaaaagaaaactttatgttctttgttcttagatttgagacataagttgtagaagtagtacttttagcaaaataagaatagtcaatgtaataaatttcttgtaaattatgcagtgtggtaattgaggaaacaatttatagtcacctgtgttacataagtgccttaacctgtgttacacaagaagttttctaatgattattttatagctccatccgtttttaaatgcattttctttccctgaaatagataaggtgacaaaatgtgtcctcaggtgacatttggttgtgaaaagtgatatcttagttctaactacctaagtcagcagcaaagtttaaacagtacagatttaaaaattttttataaaggaatttaactcttgttaactatattatatttagctttattgtactggatatctgtatttactgagtatacctatatgggagtcccttatattactttggaataacagtttttcatatataaaaaatgttgtgaaacttactgggagtgtatgtaatatgctttctaaggtaaattataaaaattaaaaccaaagtgtgaactactgagtactgcataaaaagaaaaaaatgaaaatataatagttgtcagaatagacagtttagatgcagtggtttgctcatgttattatctagcatagactcaaggaaaatttgagctaaaaagaaaaggaagtgaaagattacctgatcaaggagtttcacaatctggacaaataaatctccgtggagataactgaagtgtcttctagggtgggggacagaaagtagggagtgggtgaggagaaggagagagagagggagtaagggaaagggaaagagaaggctaaaatttacagttcttggactcttccctccctccttcagtcatagtagttccactttatctgtttcatatcttgagttctacctaaaattttacttcgtaaaaaagactctgctggtaaaagatataaaaatcatatggtcaagatggtgattccacctcggtgtaatcccagccaacttgggaggctgaggctgaaggatcacttgaacccaggagtttgagtccagcctgagcaacataacgagacttctgtctctaaaagaaaaaagagtaaaaatctcttgtttttattcagctacttgtgcagttaaagaaaacccaggaacacacaatccgtttttgggagatgtattcagccagtcaacaaacattatatgtctattaggagcctccttatataagtcaactattagtacagtagagaagcataatcacatcaaaacaaaacaacagttatttattagctatgtactttgtgcaaggaaaaaacagtcagttcataaagataaggcttgtgtatgcttgctgtcagaaggaacattcttctatagttatttaagtagctgcttctatagttatttaagaagcttgctaaaagttaaatgaattgcactttggtcctggagccagtttcattatgttacctgaggtcactcttatttgtaagagaagaataagattattttctacttactatcttgtatagatatatggtatatatggagtactattacaaccttgggagaaggatggtctataaatccttttagttatgaattttcattatatggtattacccaattacctataaagtatgttatgacacctggcatggtgcaaagcaggacttccagtgcgatgtgaggtggcaggctaaggaggaaacgatgtgtcgatgttgccttctgttcctttgatgggaattaaaagggaatcatgagaactctcattctgcagtgcctcttcctgtccagggtcctgctatgaggtgtcatcctcttgggcagaggaaaaaagcgccttttggataagggagaatttaattgtctaaatcaatagttactaactggccatctatggtttaggtgtagcctgccaacgtgttttattgggaccccacagttaaaaatatatagtactggtatttaaaaataaccatattttggcttcttttgaaaaattggaagatctggctaccccaggcccatcatcctagtggcaacatgtggcttggcgctgacggcccacctaaaggagcatgccctctccagagggtcgcagtcacttctctccagtgctttacacctggcccactgcacatggtcacctgaagttgggaaagtttcttgtcacggtcactctacagcttccttatagaactgtccatcttcagcttgaaaagttctcaaattattattggaattctacaacttgttttctgttgactgagaatttttcatttttagaggtgtttagaaatcaaaaagtgagactggaaaagatgtcatgtcagtacaggcacagatacatcagaacccagttaaataggtcattaagtattagatttttatatactggactcatgaacacaaacagcggtgcacaggaatatgttacccttggcatttatggattcattattctcgcagtttaatttagctcgatattatgtgttctgtgttatggggttttgtttgttttgttttgctggctgccagagctcatctctaataacttttctctggtttttaatatttactgagggagtagtctcatgtcacctttgcttcctcttgaaacttagagctgagcagctagtttgtatggtcctgcaggctgaatcaagaccctgttaatctgacttataatagatgaggttaaacagtagatggagaatcaagtaattctcctgcctcatcctcctcagtagctgggattataggcatgtgccgccacacccagctaatttttcttttcttttcttttttttttttagtagagacggggttttgccatgttggccaggctggtgtcaaactcctgacctcaaataatccgcccgcctcggcctcccaaagtggtgggattacagacatgagccatcgtgcctggcctccagcaaggtctttatgatctatatcttgagtcgacctcctatctcattctgtaacctagaatgcctaactgtctgggaatgcagcccagtaggtttcagcctcattgtccccagcccctattcaagatgcagttgctctagttcaaatgcctctgacagttgtgcttcaccaaacctagagaatgaacaaagcgaaggacctggagttcaagaatggagggatccaactccaaggcaggaagcaggtccagaaagcaggcagggcagcagcaacagggaagaacagcttatctgatgactggctgggtgggaagcacaactgagaggacttgaaggactttggaagactaagttagctacaaagaaaactaagtattataccaaaaaaacttatccgggcgtggtgacaggcgcctgtagtcccagctactcgggaggctgaggcaggagaatggcgtgaacccggaaggcagagcttgcagtgagtccagattgcgccactgcgctccagcctgggcgacagagcaagactccgtctcagaaaaaaaaaaaaaagaaaagaaaagaaaagaaaagaaaagaaaactaagtattataaatggaaaaaaaaaataagtccgttatatccaggaaaaacaaaagctttattggaaaagaaaaggaagccaggcgtggtggctcatgcctgtaatcctagcactttgggagtccaaggcaggcagatcacgaggtcaggagatcgagaccatcctggccaacaaggtaaaaccccgtctctactaaaaatacaaaaaattagctgggcgtggtgtcacacgcctgtagtcccaactactcgggaggctgaggcaggagaattgcttgaactggggaggcagaggttgcagtgagctgagatcacgccactgcactccagcctgggcgacagaatgagactccatctcaaaaaaaaaaaaaaaagaaaaggaaaataatgaaatactactcgaagtagtggacaagatatatataattgtaagtcacataataacttaaatcctgatactaatttaaccaaaatggtagtaaattatttgggaaaacttgtgggaatggtaggagatgtatcacagagctggatctcatctattaaagaggaaatcaatagctgatatcttaattgatccataataaaacatattcggttaacagtctttttcttaaaacttcagtggaagaacgcagttttgttgaaaagcacagatggccgtcgaatatgtacttgaagcagcttgcggaatacaggaagtatattcactcccggaaatgtcgttgcttagtaatgtaacctggagcttttatacactacatttcttttttattattatgaagaatgggatacctccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaa

SEQ ID NO: 67 - DNA, 55421 bp, Homo sapiens
agttgaccaaccatgccttgaggataaattggatgggatcagatgggaagatgtgacaagaagagaaatcctcctctatataggatgctctgctgtttcctaaggattttcagcaccttgccccaaaatgtgagtcttgactttttctctggctttggggctaagtgggaaaaatgttacaggagaaaggtgtttggtcaggaagcctccagttgggggagtacccactgtggccctgctgggtgggtgccacccagaagaggggtgggaaagtgagcagttcggtgcatatggtacccaatgaagtgatctgagggatagggatcgaaaagtcctggagttagggtgctgcagaatctctaggttggattaagttttttactgacccctctgcaggttacataacacctgtgggacgacctgtggcatcccagtgaggcagcgatgccatctcggtctcatccaggatgaaaccgtggtttggggataccactagtcagtgctgtagtcaatgtagggcattgattactcataatgggaagccattggagttggttaaccccttccttctagtgtgttctcctccttgacattcctgcctgttctggggcccttgtgttttgggaatagaatgctttgtatcagcagtgtaacatggataggttaactggatatgggctggatatggggagagctggttcttcctgtgtttaaactggaataagtccagagtgaggaagtaaagaggttagagaggaaaagccctggagtgagggtcaggagatcttgtttggcagctggttctgccaagtaaaagctgtgtgaccttgggcaagtcattgtttctctttaagttttggttactcctctcatctgtaaaaacatgtgcacttggggttcttccagccccactagtcctcttctgtcctttaagtgtggatctgtggttctgttgttggcacaccagaaagggcacaagtttgagtgtctggctctgccatttgctgtgcgaccttggacaaggacaccccttctctgaaactcaattttcccatttataaaatatgggttattatgagacatcagtgaggatgaagctgagagccttttcagaggcacaatgtggatgtaaagcaacaccctgagtttggacagggcaggtggggtaaggcaggctgaggggtgatgtttggggttactggcaggttgaactgtgaccagggcatagagggggtggaggtcacggtcagctgtgccatagaaacctcctgccctgtcctgctcagttcctgttcctttcccagcagccgaggaaggggaaacagttgagaggttataaatgacgctgaaaacagctcacaaaagtgtctgagggggtcatgctgctggagcaaagcacgcgctgggaagcccatccagggtctggggacccctgaaaattgagcagcctcctggttcctattggtgcccaagaggatgcacctcctgcactgcttggcatcacttcctgggaaagtaaaacctcgtacggcgagtaatggatcacaactgaacagtgaccagagtgacctgtctcgagccatctctgagggaaagtcacagattccctagagaaagtctccaaattcctgtttattcttcacataaacagattaacctaggggtagcgattttacttaactcttcctttcatgttgcagcgaaagcgaaattggccacttctttgaagctgttctttgagccataaatataatttctcttcccgcccacagaaaggggttttctttttctttctttctctcttttttctttttttttttgaagccccaggcactgagacgttcagaggttggcaggaggtgcagctgccgtaggagcagcatgctgtccccctgctgactcatctgacattaacataattatgtttcagaagtcaaagtgattttcaaactatgagtaatgcagggtgttagagagagtgtttacacggcagtgggcatttcagcacactcaagaaaccagctgctgttaacagctgcaatgagtgaagaaataagaaaatgctctcaggaaaaacagcccttctctcttgtctctgtttctgtgcaaaggattcagatgtcatgaaaggcaggtgaacttaagagttccctgaggaccaatccagatctagcattgttatctgaatgccttgatgtctgatctttttatagggaaaaaaatgtctttatagcttattttccatttactcaactctagggaaaggtggatttaaagagcttagcaaattatttattttttataatgctaccggtgttaataattataataatagtctaaggttgtgctgctgcttctaaaataggaacaaggacaaaaatcatttcccccagttttaaagatgggggcagaagcccatggggagggggactgggaaatgtcttcttaaagctcctttgtctcattattatgggaaaagttctgagagccgtggagtgcagtgtgccaagtatttagacctcaggagagaaaaactgggctccagtcctgttccagaactgaatattggaatgggaatgcctcaatttcctcatctcataatgagaatattaataacactttctttgcctatgtcagaagaagagccttgaacttttgtagggtagggacagggtctgccgactattatagccccagtttctaacttagagcctgcacatagaaggtgctcagtaagtatttgcagaattaatgaatgagataaaagctataaacgccagagctctgctcttgtggtttgttactgcatctagcaaggtgtcattcacatggagagtggtcaataatttttttaatgtgttaagaaaaaaatcatgaactaattatacattcacttatacataagttattcataaacaaattggttattattttggggctaccaagctgaattacacacaaaaatatttctgtttacttaagaatgtctttaatgaccaacacaattttattaagcctcgtctcttgagtatatatcctttgcatgctccacatttgcatcatggaaaaaggagccccagagaaagagcacaccaaaaacatcgacctaccctgaactaaggggctcaggcgtgtttttgtggactacttgtattgagtgatctcttcctcctggacccattaataattattgttaggcttacttcaagtagtaaatttaagccagtccattcatggcaaatcaatccaaaatggccattaaggagagtcaggatctgtggtcccatcccaaatatttgaagatgatgccagaaagcaaatttagtgtgtcctcctggtgactgtcatttggtatttctgtcctaggccgattctccgatgggggtaaatacaggctagggcatttctaatgtctaaacctccactgctctctttctctcaaaattgcctgtccaacacagtcataatttcacctccccaactccgtcgttactgtaggtttattaatgtttgttggaccggcatcctaatttgggtgtgggtgactattccttaaggcatctcaagtaaaaaggctccttacttctgatcctggtttatttattttaaaaatacttgtaaatttaatattaatttaatagggtttttaagttagtagcaggttgctgaaggatctaaatgtttaacatatattctaaaataaacattggctgtttagagcccttacagaataaacttatttgaatttttcccctggcacccttttctttatttcttctactctttcttcctttcctcttttcccatctctccctccgtctttttcctccctgccttcttttctttttattatcttgtgtttcatttgtttctttgttgcttttggtaaacgtctttctaaaaagtatgtctggaaagagataagagaaactgattaaagagcctaggacgaggtagagagacttttcatcatatacactttctgacttcgaatttttaatagtggcaatactttttccccaataaaaaagttaaccagaacagagttgtacacccttcttgttttcatttttccacttttctaatgcgagcctatttcctccttactaggatgaaagacaggaatggcttccaaaggaaaatggggagaagagaaaggagacagtagacagaagctcaatgcctgtgtgtccacagtggagacgcaggggaaagagctagtgtaatagaaccagtaaatttttttttggcttttttttttcactcgaaatgtaaacatcttcccacttcattctttccacctcataagaattcttcttcttctacaacataatttttaatgattgtacaggagttccaattaatgtaatttttttaatgtagtttaccttactaatactctatgttaaacatttgggtaatatctgattcatcaatattgtaaatagtactgtaataaacattattgtagctaaatctatgttcatggcaattcttatttactttaaatatatttcctcaaaaagaatcaacatatttctcaaaaataaataaaccaaataatatatgaatcatagtctttgatatatgttgctcttgatgtaattttaatttctatagacacaaagaaattttccacatgtttgttaacaggtttattttctgtttatgaatcttctgttcagagcctttgcctgtacatctgttggaatcttaatatctgcagtgatttaaaatgttttataatatgtaaaatataccaacaaagacctccctatctattatttttttaaagtaataataattccctggcttgacatttacatttgaatgtaagttatatttatatatttttggcacagagagattttaagatttaaagcaatcgaatctgtcaatttttttttctggagaattactttttccacttagaacttttaaaattatttcatattttcttctaatagaaaacagccttttaaaggtaaaatttccatattttatgtaattacagggaaatgcacaaatcttaaatggatcattcagtaagttttgacaaatgacagatgcatatgcctagcaagatataaaactcaaagggtatgactttttcaggtgatggttgcacatatctatgaggatacgaaaaaacaatgaattgtacactttaaataagtgtgttatataaatcatatctatagacttttttaaaaaatggaaattaccatcatcccggaaagctccctcgtgttctctcccagctggtcctcactcctactctacccatataggcaaccacagattttagttttttcatcattagtttggtctgtttttgacctttatatggaatggagtcacacagcatgaactcttttgcataaggtttctttgacagcataatgtttttgaaattcatctgtgttggtgagcttcaggaatttgtgtctttgttactaaaagtaagctttcattatagtatgtctatatgacagtttatttattcctctattgatagacacctaggctgtccccagtttggtgccattatgaataatgaaactatgaacattgttgtaaatgtccttttatagacatatgctttcatttttcttggataaatacctatgggtggaattgctgggcataggatagatgtatatttcattttataagaaactaccagccttttctccaaaggtgttataccattgtacactcccaccaacaatgcatgagaattcagttgctccaaatttttgtccacatttggtgttgtcagacttttctattttagccattctgttgggtgtgcagtggtagcttattgtagtttaaatttgcattcccttgataaagttattgaacattttttcatgtgcttccggtttttctttattttattttaatgtgtatgtattttacatctaactatatctctttatccatcaaaagttattttgattatgatttgaggtaaatctctaaattaatttttttctaaataatcagttaacccagaacaatgcattaaataatacttttattattattactattattattttttgagatgggagtctcactgtgttgcccaggctggagtgcagtggtgcgatctcagcttactgcaacctccgcctcccaggttcaagcaatgctcctgcttcagcctcctgagtagctgggattacagccaccaccacgcctggctagtttttgtattttttagtagagatgaggtttcatcattttggccattttcttctggtcttgaactcctgacctcagttgatccacccaccttggcctcccaaagtgctgggattacagacgtgaaccaccgcgcccagccaatactttttttttttttttgagacggagtctggctctgtcgcccaggctggagtgcagtggtgcaatctcggcccactgcaagctccgcctcccgggttcacgccattctcctgcctcagcctcctgagtagctgggactgcaggagcccgccaccaggcccggctaattttttcgtatttttagtagagactgggtttcaccatgttagcgaggatggtctcgatttcctgacctcgtgatccgcccggctcggcctcccaaagtgctgggattacaggcgtgagccaccgcgcccggccgccaatacttttattctctgctaatttgtgatgctttatttaccataaagttctcatatgtacagtggtctcagaatatctattctatgtcttgatatgtacatttttacacttgttcttttgcaagttccatactcttatcgatacttgcttttaaaaatgatttaagagctggcaaggccccagtctcatcattccttttcatgttcaacattttctttgttgccgggcgtggtggttcacgtctgtaatctcagcactttgggaagcagaggcgggcggatcccctgaggtagggggttcgagaccagcctgaccaagatggagaaacccccatctctactaaaaatataaaattagctgggcatagtggcgcatgcctgtaatcccagctactcaggaggctgaggcagagaaggatggcttgaacccgggaggcggaggttgcagtgagctgagattgcaccattgagctacagcctgagcaacaagagtgaaattcagtctcaaaaaccaaacaaaacaaaaaacattttatttgctgttcatacttaattattattttggttgaacattagaatgattttgtgaaattctgaaaagaatactattgagatttttattgaaattatattgaccattcaaattaatttgcaaagcactgacttcgttgccataaagcttagtattcaaacctgcatttcccaatagcattttataattttttcatacgggtccttcgcattctcattatagcttttccaaggcattccatagaagtttccaatgtcatcattgttgatatttgctgttgtcattttatcttttctaaaagttgtattttctaattggataatagttctatatagaaaagcaatgtagcaaatttctacatacaaatttttatacagacaatttgtatatacaaaaggtacttggcttttgtgtcttttttatatttagcagttttcttgggctctcatatcgattctaataattcttagttgaattgttcttttgaatttccgggaatgtaattatatcatgtacaagtaattgcaaatctattttctcccttccagtgtttgtgcatcttatttttataagtgccctatttcattggttagaactttcaggtcaaaatttagtaaaaatggccacaaactatatctttgttttggtcctgattttaataatattgccttagtatttcatccttaaagatgactttgactgtttgaaataaacactttttgttatgttaataaaagttcttaaatttgtaattattttttaatagggaccagctgttgaattctaatgtatttcctgcattaattgagaatcttatttggattttcttttttagcctgtggatgtaatatattatactattggattttaaagatcttaaaacataaaatctttttattttagattaaaccctccttgggttattttgatactgttatctgaatttggattttcttttctatgttcataatttagataggtttattatcttctttttttgagctgtctttttcagggttttatatcagggtcatctctgttaagtaaattagatagattttccatatttgtcaatgtttgaaattactgaaacatagtgattacgtattccttaagaattgaaagatttttttcctgtaaagttttctaggcctagacacattttttttcctggagggaaatctttcctttttttctaagttcttcagccgtgattggcatatgtaggttttatacttctaattttgataatgtatatattttcagactattcatttcatctaggttttcagatttataatttataattttgcaaagtattgtcttatatttaaaatatctcctccttatctggtgctgaacctcccctttttatttctaattttattattcatagggtttttttttcttctttagtttctctaatatttgtctactttattactttttaaaaaaagtgctcttgaattaattccgtaagttttcctatatcctaattcagttagttttggttttgcctttagtcttttctgtctactgatttcttagggattttgttgtcattgttgtttttataaacccttgggttgaatgcttttatttttcctttccttgaaaataaaaacaaataagattgtaacttcaacttttagtacaactttcatattttcatattttcttagtacaatatttcataccttttgatatattgtgctcttattttaattatcttctaactgctatgttcttatactttaatttctgttttaattttctgtccttatatttaatgattttttgttttaatttctattattaatagctagttatactgcactgtgatcaaataatcaagcttatataatttttgtttcttaaaatatctctcattttggtatattcatcacaaatgctttctcctgttctataatatcttttcattttgtttgtgttgtcttttttaacacatagtttttttctcttaatgtaatcaaatatatccctcttattttattgtttgtatgtttgtatcttatataaaatatttctgcacttgatgataatgagtgtatcttcctatatattgttttttctcaaggttgcaaagttttgcctttcacatctgtgtctttaatctttatggctgatgtgagtgagaatctaatttaacttactcccatatggataaccagttgtcccagtctcatgagttcctcccattgctttgtgaggctatttcagtcatgtacagagcttccttgtgtatataggttatttatgggcttttgttcggttccattaatctatttctattccctatgccagtactaccacaatcttttcaataagtctaaatatctaacaagacaagtcctgctaccctattttcttcttcttccaaattttcttggctcttcctggcccattcacatgaattttagaattagcttcttaagaattgtgcacacacacacacgcattttgaagatttttaatatgaaaatttcatcaaatctacaaataaatatggagatggctaatatttttatgggaatcttgcatgataccacgacaccagaggtgccaccaagatgactaacatttttatattactgagtactgtaatcaataaacatagtaattctctccatttatttaggtcttcttgtattttattcaataatactttcatagttttcttctttgaggtctttcataccttttaacaaatttatttctaggtgccatgtaatttctgttactattataaatgggattttttcaattatattttctaattagttattactattaagaatgctattgatttttgcatgttttttgtatctagcaacctttgctggacagtttttagttctaagagtatgtgaatgttcttgacttctttatgtagacaatcacattttcagcaaacgaaaacagcctctaatctttctctttttccattgttttatattacatcagttaagaacttcagtataatgctgaatagaggcttataacttatagccttctgtaatttctgactttaatgaaaatgtctctaaaatagtaccaattaatataatatttgcttgtagagttttgatgtatagcctttgtcaggtaaggaaagttgccttctatacctagtttgctaagatttttaaaaccacgaatgaatgctatattctgtcaatgccttttctgcatttcttgagatactaaaaagataaaagataaaggaaaaaggcctttctttttaatttgttaatttaataagttttcaaatcttgaattattctttcattcttgagatgaaattccacttggtcaagatattttctttaagattttgtatctacatgaaaaatgagattaagttataattttccttatttggattgtccctgtctggctttaatatctcaaaaaataagttcggaaattctcttcctttttcctcctaccctctgaaagaatttttgtcgtttaaagcagggcttatctatttcttaaaaatctggtaaatgtttgggcctgatgtctttggagatggaagaacttttgattaataatttaatttctttagtagctaaggcttagttctggttttatctgaataaattaccaaattttatttttttcttgaaaattatttatttttcctaagtttccatatttattcagatgcagttaatagtattctttatgtattttaaaatctccactgtatctatttctatccctttttattgccactttctgtttgtgtttttctcatttttattgattggttgagctcagggttgatctttttctgtaagttgtttcaaaaaactaactttgtgttttattcatcttccctaaatataatttctttcattcttctcttatattattttcttatttctagtttagatttctctattgtgcttgcctagtttcttaagttgaacactttacttatttattgtgctgtttttatttgtttattcattttgcttttactgattttttttcttaagtagaactctacttgtccttttgaccacagcaaggacctcagcactttttgattacatgtggaccctgttccccatcttatttttattccagagttaaagtttttaaagataaaaaagttattaaaaaatattcttttcttttcttttcttttttttttttttttttttttttgaggcagagtctcgctctgtcgcccaggctggagtgcaatggtgtgatctcggctcactgcaacctccgcctcccgggttcaagtgattctcctacctcagcctcccgagtagatgggattacaggcacgtgccatcacacccggctgattttttttttgtatttttagtagagacggggtttcaccacgttggccaggatggtctccatctcttgacctcgtaatccacccgccttggcctcccaaagtaccgggattacaggcgtgagccaccgagcccggcccaaaataaaatattctttagtagttctttaagtgacagtctgtggttggtaaactctcttcatcgttggatgcctgaaattctttatttttcagggtatagaatttgagactggtatttattttccctctgcactttgaacatattacccttattatctcctagaatctattgatgtctatgagaaggctgctgtcagactaatttttattcctttgtaggtaaattcatttatctctttaacctttttttaactgacagataaaatgatatatatttatagtgttcaatgtgatttttaaagtaaaattataacatggaatgactaaatctagctaattaacgtgtacattacctcacatagttatcatttttgtgctggaaacacttagcattcactctgttaagcatttttcaagaatacaatatattgttattaactatagtcactatgtggtacagtagatctcaaacttattccttctaactgaaatcttatatcctttgaccaacatcgcttcaactcaccagccccacccccatcctacccccaccacggcctcagctctcggtaaccaccattctgctctctgcttctgtaagatcaacttttttcaattcccacatatgagtgagatcacgtagtatttgtttttccttgcctggcatatgtcatgtaacataatgtcctccagattcatccatgttgtggcaaatgacaggatttgtttcttttttcacagctgaataatatttcattgtgtacatataccacattttctctattcattcatctgttaatggccacttaggttgattccatatcttggctattctgaataatgctgcaatgaacctgaagtgcagatatctctttgacatactgttttcatttcctttgaatacattactcagtagttggattgctggatcatatggtaattctatttttaattttttgaggaacctccatactgtttttcataatggctgttccaatttatattcacaccaacagtgtgaaagggtttccttttctccacatcctcaccaacattttctatcttttctggataatagtcactctgatgtgtgaggtgatacctgttaacttatgattatctctttattcatagtgttctgcaattcagctgcaatttatcttcacttctagaaaattctcagccattatgtctttaaatattgcatcactgtcatttcctcctttctcttctttcagaatttttgttacattagagttggtatctatgagaaggctgcttgctgtcagactaatttttatccctttgtagataaattcatttaactctttaatcttttttaactgacagatgaaatgatacgtatttatagtgtacaatatgatcaatcaatcttccatgtctcttaatactttctcttctttgcctgtattctggatgtgttcctccgcaccattttccacttcactaatgccttcttcaactttatccaggcagaaattttctatctggtgcattttaaatttcaatgtttatactaatcatttctgaggttttttttagttggctcttttttctacctttaaccgggagtagaatcttgtcctgactattcactttgttggctgtcttccttagcattagatttcttcatgtattttgaaagctgagtttgcaggctcatttcaggggaaagtgatgtttgttttgtttggttttctgtctttttctccctcactcggtgctcatccctccttcttctccactattgcagtggtccactcagccctccagctccccgtcccagaaccagagtctctgggggcatttcagggttactgttgctcagtgacgatagggacagagcagacccaggcatggactcattcccaaccaccaggctgtgtctgtgtccttccacacccctagacaagcaacttctaggagctagagccccaggcagctctctggagactttttttttttttttttttttttgagacagagtctcactctgttgcccaggctggagtgcagtggcacaatctcagctcactgcaaccttcacctcccaggttcaagtgattctcctgcctcagcctcccgagtagctgggattacgggcatgcaccaccatgcctggttaatttttgtatttttagtagagacggggtttcaccatgtaggccaggctggtctcaaactcctgacctcaggcaatccacctgcctcagcctcccaaagtgctgggattacaggcatggctcccagacttctggagcctttttatttagccttcctttccaagcttgggaaactcagttccatgtaccttccccatcataaaactctaagcaccacaaagagcagggcagtatatatttttttattaccagcatatccccagtgcataaaatagtgccaacacatggtaaactgagtgaatgaatgatggctaacatgtcaaaaactgaaggactgaacctttggagtttaatctggagctttgtttactcccagtccctctgggggaacggtcagcctagtacacagcccaacttttatctgtagaagagaagacgcattggtgtaagagttaaaagaccttggttttagggctggctctgcccttgcctagttaagtcacgtaatcaccctaaatccaggattcctcttctgtaaaatgagtatctcatggtagaataacaatgctgtatccagatgtgatggctgcttcattagcctgggctctgagaaaaacagcagatcccagccgatgtggagtagggtgaatgagaaataaactatcttggttaagaaacagatttgtagactgggcacagtggctcacgcctgtaattccagcactttgggaggccgaggcaggtggatcatgaggtcaggagatcgagaccatcctggctaacatggtgaaaccccgtctctactaaaaaaaaaaaaaaaacttagctgggcctggtgctgtgtgcctgtaatcccagctactctggaggctgaggcaggagaatcttgcctctcaggcttgaacctgggaggcggagcttgcagtgagccgagatcgagccattgcattccagcctggtgacaaagctagactccgtctcaaaaaaaaagaaagaaagaaacagttgtagagttgtttgttactacagcataatttaagctatactgatggatacaattacttacttgtatccttcttctctacagagtgtgagctctattgggaggaagaatgctttcattttcactactgtttactttcaaatttccactttttttttttttgagatggagtcttgctctgttgcccgtgcagtggcacgatctctgctcactgcaacctccgcctcccaggcccaagtgaccctcacacctcagcctcctgagtaggtagcactacaggtgcataccaccacaccaggctaatttttgtatttttagtagagactgttggccaggctggtctcgaactcctgagttcaagtgatgatccacctgttttcacctcccaaagcactgggattacaggcgtgaaccaccatacccagccttcactttcttatgtaatatatgatagtcattcttcactctgtgttcactactgaggacaaacattaaaatccagtaattatcccacatttgcagcactctaattttctgagaaaattgtgacattgtctaggatttccaaaactgtagtaatatattttgtttgtttatttatttattttgagacagagtctcgctctgtcacccaggctggagtgcagtggcacaatctcagcttactgcaaccttcacctcccgggttcaagtgattctcccacctcagtctcccgaatagctgggattacaggtgccccccaccatgcccggctaatttttgtatttttagtagagacagggtttcaccacgttgggcaggctggtctcggactcctggcctcaagtgatctgcccaacttggcctcccaaagtgatgggatgacaggcgtgcgccactgcacctggccatataatagtatattttacagtgctgtggtactttttccagagagggatgggaagacaaaacttttgacttggatataatttaaagttttcatgaggacatgcaacacggttatgtgactcagtaacacagtgctgcctaagggctggcgcgtgcgcaggtctgccggcccctgcagggctcttggagttcttggtcttgtgtctcagtggggtttctgctcgtatgctctcagtgtacctgactttagtggaagtcctagccacattcctagtttgttcccctgcacctgcttgagacagaaagtcaaaaaaccaagacctttttgagtagatatgtaagaaaagctcagcagtgccctgagtgaactgcatgaacccatggcatttcttatgggtgtcataggagttttattttgttgttgatgacgttgtttgtgtcaatggaagaatgttttatggaatttgaaatacaaaaactgtttgtggttccttagacacttgcactgcaatagaaaattatactttatcgtaaaattaatggtttgaagagaaatagacagcataaacaaaatatggtccatactatgaaaatgcaaaccatacaatggtgattttgattttcataaaatgaaaatcctaaaataattactcagtacccagagacatacttaatatatacatgtgaaatatcttacacacagatataataaaagcttgccagcattttgatatttgaagttttcagatacatggcttctagataaaggatataattgcatattcttaaggaaatatagttttattattttcgaggaatagacatcagaactcagttaagaggatgctatttggggtcttcttttaatgaatataaaaaaagcaattcataacaagcacattggtttctgagtaaaatgaagcttctgaaatgtgtgaagaatgcttgaaaacaatgttttgtaagccagtgaaacatctcccttcccctcacttacaggattgcaaaatttagcaaatgaaaatacatcaggcccaggtaagcatgaatttcaaatagaaacaaagaatttttagtgtactatatcccaaacattgaaggggacagacttatatttgcgatttatctggaattcacacttaactgggtgctccgtactttatctggcaacccttcccacctcagaagttaaccttcattgtgcaccaccttttaggaaggaaccaggccagcctctgtaaattctgtattggtgagctcgtattaatgcattttcttttgcacatcttgaggctcataaagagactgaagtcgccaaccaatggctctcaaacccaatgcaccctggcaaagcaaagcagggcagccttcagaacttctccaaggggagggctgtgtgggttctcccccacaaagctctattttagtcacagtcattagtgctggagaaaacacacactggtcatgggattcaccttttgccatgtcgcaagaaagtcagtaaaataatgcctgaaagaaggcttgggcttccgtcccctgcactgagcactctggtagtaaccttctgaaacatgcctgtgcgtttttttcaacagtcaaagctcctgacatctctccctgcagagggattgagcagcacttttaaaccagagactgagtgatttcaggcaagtattccggcctttccatgagacctgcacttaggagaaaggaggggaaaggccaacttgactgagctcttgatagaaatacatttgcttacttaatcttcattagctcccgctgaagtataattctcagtttacacaccgagaaacagaggctcagagaagtcaagctgttgccgagtcgcagagccagtagcagagcttggattccaatccaggtctcttgggttgcaaaaggctgacccctatttccatggtaccacccttcatctctccagggaaagggaaagcgctaaagaatgccagggttatggaatgttctaggggagagcataggctgtcatggggcaggctcactcctaactggtttctgagagaagaatatgaggtataacaaaatgaaaatgggcttcatagctagacacttcagtgtctgaagcctgcctccactgctttttagctgtgtgactttgttacctaatttctctctctgtttttttttaagtgatgggatctcgctatgttgcccaggctggtgcagtggctgttcacaggcatgctcatagtgcactacactctggaacccctgggctcaagtgatcctcctgtttcagcctcccgagtttcatttctctttatcagtcaagatgccagcaggaaactgatggcacacacagcaggtttaactgaggagagtttagcaaagggactattaactgaggcttgggcaggattacaggaacccacaggggatggtgaagcactgaggaactagtaattgcagaaagctgtcaccacccaggcctacagggcaagaggagggaatattttattggatcctgttgaaagctggcatcatggacaagggccaactgacaggggctgtggccctgaagaaacacgaccactgtcggaacaaaaccctggaacagaggtcccaaccttgacctctctccttccctagccagcagtgcaggttataagtctgtagagtttagcccctcagggcacagaggagggcaggaagtggatggaaggggtggggcatagtaatcggagaataacaacactcccgctgggcatcagtttcctttttttaaaatgggaatcatagtatctaccatgtggcattgttgtaaagattagaaatacatagactgacgcattcaacaggtatttaccaagtatctaccatatcctgggctctctcccacagatacagtgatgaccaaaacagaccgtatctctgccctcatggtaggtgaaacgcaagaaagccagacgttacataagtatttacaagggggaggagataaaatatcacctctcacacacagggtactcatagtacttgtaaatagtagctataattatttcttaaagtcccccaaagagacctatgctgcataccacttcttgatttcttataccaatatgtatttatgaacaacttttaccgtccggacagattttctcccactggaatacaaagttctgagcatcctgaaagcagaaaacagctgttactccctgtgttagtcagggttctccagggaaacaaaaccaataagatgcatgtgtataagagatttattgtaagggacttggctcatgcaattatggaggttggtgggccactagatctgtagtcagcaagcttgaggagccaatggtgcagttccagtctgaggctgggaggctcaagacccaggaggagctgatgtttcaattcaagtccaaaggcaggaaaaaactgatgtcccagctcaaaggcagtcaggcaggaggagttaccttttactcagcctttttgctgtcttcaggacttcagacaactggatgaggcctacctacaagggggaggacgatctgcttcccttgatccatcagtttaaatgctaaggtcacccaaaatgccctcacagaaacacccagaatcatgcttgaccaaataactgggcaccccatggcccagtcaagctgacacataaaattcatcatcatgctatgctggagttaaaattctttataaagttgtccctcactttccccttcctgcctaacatggcctctctctttcacctggagtctctccaagtacggctcccgggccacctggatggaacctttgtgggaactttctggtcactcagatagcagggccccaggcaggctttgtgtgtgaggatacctgggacagagactcagaaatctgcatggtaaacacagccctgtggctgcccattctccagccctgtgatcaccttatggtgtcccctctccaacctgtcagataccaaaaggaggagaagagaaaccctacaagataagatgtgttctgagtgtcggaggggtgggagggcctctaaggggacagagagaagtgcctgaatagtgaggcagatccacaggatggtgagagaaaggattactaacagagctggggggtgaaaggtgagcggggctcctgtgtgtggcagctctggggctgctgagcccaggggacgtgaaggcgctgctggagcctcctacctgtcgacctctccagactcagcctggcttcctctgccttgcccccgtgcccagtcctggcgaacttccttcagttcatcaaacagctgaatcccttcctgcctcaggaccttggctggtgctgttgcctctgcctagagccctcttcttaggattctctgcatggctggcaccttctccttcaggcttcaccatcagaggagctctctgtggaggggccacctcaaaccaccccatctgatgtaggggcttgcctctgttttcccggagaatttatgaagacatgtggttttaaagatttatctgtgtgtgaagcaggagcaagtttcataggccacatattcatgtgtgcaaaactgtaatcgattatattttgtaattcttagtttctgaaccctccctctgtcacagaaaacagagtcttcttcagataaactcagccaaatgaagggttacaggatcatttctggttatcgacctaggcagattttctcccattcttcctggaggggtctcagttctaggtgtgtgtgtgtgtgtatgcatgtaatgagggttacttttgccctggtgccaagagagagaggcacctgctccatggttgttgctctttgtccacagtggctttgttgaggtgtgaggttccccgggcctttagtcattggcacccatcctcctgacttcctcccaaatgacccaggatatgttgtggtctccagtggccttggcattctccttttcccaaaattgttgggtcctccagcccctctcaaccctctggggtcctgcccgtgggcaggggaggtcctggctcctttttttgcaccagactgtgagtctgtcctcagcctggatgcctcactcagccatgcctcttctaccttcacacacaggattctgggggaagttacctgtggaagggggctcagggcacctccatcctggggttccctaatttgtcatgaagtttctattatctcttgacccagagcttgactggggaaggaggacacacacaggcagctcccctatgtctccctctcccctttctccctttctgctaagctggtgaatttttatttggggcaagccagtgggagggaatactcttcttaggacatggcactttcttcctctttgctgctcaaagtgcagagttaatgacgtagcagtgactccatggggcatcttcagcaccaagagcaatgcctggcatgcagtgagcactaaaggagtattcggtgaatgaatgaatgactacatcggtatgagtttgccatcttgaataatattcctgccctgaataactttggagaaagtgccaaagaacttcatttggtgagaatttccaatctccaccacaaagtagctgtcatccatgcctcaagagtgacagcatgagccctctggaagccagacatgaattgacgtgggagaaaataaacatgtgaagtgctgagctggcaacatgccccagttacctttgaattttatgggaaggcaaaaaataaccaacagttatcacgctaagccttaaaaagtgactttttgatcaggtcagtgctgcaaccttaagaatcccaaaggtaattgatggggagccaattctcagtttcacccaagtccctgcagggccctggggaaagtacaatgagcagcttcttactgtgaaagtgacgctgggctgggccctccgcagggcagaggagccctccaggtgcagagaagctctggggactttctgtctctgacgaatgaacattttcaccaactctgacacaagttttgcttttttctcttaaagtggaatgggtgagttagagggaaggcgggagaagaagattacgtttcggagaagagcttccaagttgaaaacaatggaagctaaaaaatagaggaaagtgatgtatttaaaagaccgtgtttgatagaatcctacaataataataccgtgcttaaattatacataattggcgttcaataaatgcttgggatgaatacattaataaatgaagaatatttgtacctatgagtttttatctgcattagacagactttatggaaagctgacctgagaactaaaatattcctttatgatattgtttctatgggaaaatatgttttgcattccaaacaactgacttgtgagtgggcttttgcagaagtcaggattgctgccatgggggtgggttatgtgacgcaaaccacaatctctagtctgtacctcttgtgaccaacccacatgcttagaagcccacaggctggactcagggaagctgccattggtcaaggaacaaagttttgctaacacggaaataccccagaatatgaacttaaaacacagggcagaaaacagtaaataaaatccagcctttccattgaaataaaatccagcctttcaaatggaacttcagttgtaactccagttaaaatgaagcattaaccgttcattcactcactcatacatatgtgtgtatctcctgcctttcgtcccaagtatcctgcaaataactctgcagggatttaaaaaatgaattatcttaaaggacagacaggacaggaagacagataacagcagacaagagatgtcaacagaattgtgggaaatggggagtgtgggatacggtgcctgtacttagtttagcaatgcagcagtgcaagcgaggcacctgctggggcggcgggggtgggggcgggtttcattccctctgtagacccctgtgagactcagcatgtggggtgacagcgattatgggaggtgagtgagagggagaatgttgagaccagggaaaattagccattaagtctgactcaattttgctttcctcggtagcttcttctacccctgcagccaggtgtctatccctctctccttgagaagcttgttttaaggagacattgaaacccaacagaagaggcttaggactaggagactcccggcagggtgtggattggatgaaaacaaggggattaattgaaactgcacgttctccactccccaccctgctcagaaacagccctaacccggcatgtttccaccagcaaccaccagggaaaaggtagaaccagttggctcaagagtgaagacaggtttgctgacattgtgtccaccaataaagaatcacatctcgtcaccctagggtgtcaccaccgggacacaaaattcatttcacacaaagagctttggagtctctttttagcgcctcatgcctatcagattggggcagcagtaattaccttgtgggtaggatgagaaggacagttactctctttttaaatttaaatttactttttatcaaagtaatacatgtacagagtttaaaaactctaacaatactataaggcttataatgaaaaaacaacaaccacaacaacaaaaaaacagtctcccagctcatgcaaccccacacctgattcccactccctgaaggcaattgctttcaattcttttcactgtatcttctccatatttataaatcatgtgtgtatactgctcatttcctgattttttccatttggacattatctatttctttcttattttggacatttcgaattttgctttcttcctccaccatccacataatcactccttcaaatgctcaaaatgatgccatattttagtcgccttcatacttggcaataacttccttttcaaaaatataagtaatacatgtatatagcttttttgtgtgaatatgaagacatatttatatttttaaataaaattattcttctaatctgaagccatctaaaatatagcatcgctttgaacatttgaacccaggtcatgagagagagtctgtttttctgctttcactaggcacattctccttgaagtggccatgagtggtgactgtggccgggtggagaaatgtgatcctagcacactcggcatcacagcactcccgggttgacacagtcataataatgcaaaccttgtctattagctctccactcttaaaatcaacctacccacaaagcaaggaagacatgagaatggaaacagagctcattgtaaatgttttcattcttgatgcaaaattaaaggtacaaatagcagataatgggagcaagggagagacagaagggaactgtgctgatatcctcagctaatgtactagggagtcaaaagttactttctagatggaggaagaaatagaaggttaagtatatcatataagtgtacagagggaacccatagaagaactaaattataaataaaaaagttgggggaaaggaataagagattatgttcaattttatagaggtgagtccaaagagcacctgtaatcccagccatttgggaggctgaggcaggagaatcgcttgaccccaggaaggtggaggtggcagtgagccaagattgcaccactgcactccagcttgcacaacaagagtgagacaccgtctcaaaaaaaaaaagaaagaaaaagaagaagaaaaaaagaatgtcttaaattgaccaagaaactgtttttaaaaagtcacataagctaattgatcggtcctgatcactgactcttggtcaactttttttttttttttttaaggaaaaaacaaaacttcagtttaacgtttctgcaatgcaagcttgtgatttatgattactctctaagtggatatcaggattgttatgaagacttaaggcccagtattttttaatagaatactcatctaggatgtaacagtgaagctgagtaaactataactgttaaacttaagttccagcttttctcaagttagttataggatgtacttaagcagtaagtgtatttaggtaaaagcagttgaattatgttaaatgttgccctttgccatgttacattgaacactgtttggttgcatgttgaaagacatgcttttatttttttgtaaaacaatataggaactgtgtctacaattaaaagtgaaacattttggcatgtttgttaattctagtttcatttaataatctgtaaggcacgtaagtttaagcttttttttttttaagttaatgggaaaaatttgagacacaataccaatacttaggattttggtcttggtgtttgtatgaaattctgaggccctgatttaaatctttcattgtattgtgatttccttttaggtatattgcgctaagtgaaacttgtcaaataaatccttttaaaaactgcaaaaaaaaaatgtcacataagcatactttttggagttaggaagttcaccatccaaataatttttaaaagaggtcgttaaaggtagtagtctctggttggtggcatgtgtgtggggtgagccctgctagttttcagtataaacacttccttataatctgatttcttttatctcgtgcatatattacttcaatttttaaaacgtaacaggtggaaatactcaaaaattgaattcagtgtgaacacagagccataaatgcggatactcattttgcaacggccatctgtattattgtgccatcagaaattgcacatttcccaggcaccactttgaatggtaatataagcttaatgggtctcctgttgaaagacttaccgagttagcgttggatatgggcagcattagggaagcaggataatgtactttcatggctcttactataaggtaagggcgccaaccacttagatgaggaggaaagacctcacagaagtgaaaaatattcctttatcatgtgcctggtttcttgtgcatctttgcaaagaacatggctcttggtagcctctcagtttgttgaaagaatacaattcatagcaatacacacaagaccgtccaccatctgatcccaactttttcagccgcctcttcccctgtatcctgtaccagggacatgtggctgctctccctttctggagagatacatactcctttatgcttccatatctttgcatattctgatcctctacttggaatgcttttccccaccttcttaagggcatgtgttaagacccatcttcctaacggagcctcctgcaccgcagtctccccaggctccttagacagagaggtcctctcctgactgttcttgccagcctgtgacattctgttcctcaactatattcaacaactgccaccaggctcctcttgcaagggagaaaatctaaagtgatatcttggcttatgtctgtgggaaaaatataatccagaagctcaggaaaccagttgagaaggtcattgagatgttctggcaagagcagaggtcaggatgtagttttgaaaatgtaagtgctctttagacactcgatggccaaggattggccatggggaatgctctccatcccccccgccccagtccattgtgtgcactcttccaatcagctgggctcagctacgtttgtgggcagatttgcactgtattcatttatccttgatagtaaggcattctgcagtcatttttaaactttttaatcatgggaatttgcaaacgtacacatataaatcctcatatacctgaaatccagctttaacgattatcaatactttgccaatcttatctcatctccccttccgcacacttttcttttatggggtggtagggtaggatgggcattttttaaatttttatttatttatttattttttgagaaagggtttcattctgctgcccagggtggagtgcaatggagcgatctcggatcactgcaacctccgccgggtgggagtattttaaagcaaatcataggcatcgcagagtatgtttctaacagataaggacttcttttaaaattgcggtacaaagtacataacataaaatgttctattttaaccatttgcaagtgtacaattcagtggcattaagtaccttcacactgtgtgcaaccatcaccaccatctgtctccagaacatttgcatcataaactgaaactctgtacccattaaacaataactcctcatttctccctcaacctagcccctagtaaccactattctactttctgtctctgaatttgaccattccagacacttcatctaagtgaaatcatacagcatttttaaaaatctggtttatttcactcatgttttcaacgttcatctaagtattttattccttttaaagactgataagggcttttaagataataatcacaacatatctaaaaaatttaataataattttctaatatcatcgaattagctaatctatgttcacgtttccaaaagtatgtctttaaatgtcattttacagttagacagaatcaggatcctaacaaggtccacacattatatttggttgatatgtctcttaagtctattttaacctaccatattctttctccttatttttcatgctatttatttgttgaagaaatgagttaatttgtcctgtagaatttccctcattctggatttggctgattacatcctcagcattgtttaaccatttcctctatcctctgaatttcacaaaaacaaatggtcagatctaggggccggattgcattcaggttcaactactttggtgggctgtgtgctttctattacatcacagcaagaggcccttgtatctgatggtctcacttcttgagatagtaaaacagatctgtgggtttgggtgctgccagcccgatacatccattgataacatggcatttaaagataagtgttcttggtaagagtggcaattcctcagggttctagaactagaaataccatttgacccagccatcccattactgggtatatacccaaaggaatataaatcatgctgctataaagacacatgcacatgtatgtttattgtggcactattcacaatagcaaagacttggaaccaacccaaatgtccaacagtgatagactggattaagaaaatgtggcccatatacaccatggaatactatgcagccataaaaaaatgaagagttcatgtcctttgtagggacatggatgaaactgcaaaccatcattctcagcaaactatcacaaggatgaaaaaccaaacaccgcatgttctcactcataggtgggaattgaacagtgagaacacatggacacaggaaggggaacatcacacaccggagactgttgtggggtggggggagggggtagggatagcattaggagatatacctaatgctaaatgacgagttaatgggtgcagcacatcaacatggtacatgtatacatatgtagcaaaactgcacattgtgcacatgtaccctaaaacttaaagtataaaaaaaaaaagtgttcttgggtgtggtggctcatacctgtaaccatagcactttgagaggctgaagtgggagggtggcttgagcccaggcattcaagaccagcctgggcaccaaagtgagatcatctgtactaaaaaaaagaaaattaaaaaattagccaggcatggtggcatgtgcctgtagtcccagctatttgggaggctgaggctagaggatcacttgagcccaggggatcaaggctgcagtgagctatgattgccctaatgcactccagcctggatgatagagagagaccctgtctctttaaaaaaaaaaaaaaaaaaaaaaaaagtgttcttaagactttgtaaatgattgtaagcatacctatgtgtctgtgtctctatttatatcagtcaccattcttagccctagggctgtctttatttttctgtagatctttaaaactccccaaagtccctgttcaatctgtgatgttgagtagccactcctggaattcttgagctctcagatttcatgtaagatagcaccctatttccaattagtccttgagttgcctgcacatgggtgctcactcagagtcacacacatccacctggaaggaatcatcacccacctgccttggtagcctgttccaatgtctaagcactcccagagcataagtcttccctctgtctggtctagccctccctgtgaagttaaattctgtttcctccagttcggggctcggtggagctgacgagcagctggccagcagcccctgcagatgaggcctggggaaatgatgcatgaggctaagacacattccaggtagtctacatgcttcatgaatttaatggaagactggcaaggactagaatatgttttattgcaactttctagctgggattcattatttttcttttaaaattaaatacaaataacttatttctaaaaagtaaatattcagagactatgaatgaaacaaacaaacaaaaaagaaaacaaaaaacctaacaattttccagagttggcattgtgcttattttgtgcctttatagatgaacagagtcctactggtgtcagatttaaaaagtcactctacctcttaaacattttgccttattagggtggaagggtcaaagagcaaggagggagaagacagagcagagacacagggcagaagagtctcagatgagggtggcaggggtacaagagagcctgggtctatagacagaaacagagcatgttgctgaaactgcccagactctttatttcaatctccagtctgtaaaatggagatgaagcgccccgcctgatccctttttagggttgtgggagatgcagaggagctaatgggtgtgaatgtgctttgtgggctgaagctactgggccccttacaggcctacaggtcaggggaaagaagagagtgttgccagcacctgtgagcagaattaacccattggctgattgcctggccacctggacttagcatgtattgaactgaatacatgtgcaggggctcacagccattccgattctaaagactggttaagtttcacaacaaaaactgaggataattgcagggttgtcaattattgttttgccatctactattacagttatatttatttaaaaagtaaaaggatattttaataatatctcaaccactgaggatggtaagatgagcaaaataggatacccactcccaaggagttcataaaactgtagggaaacacatgtataaaaatatgtatataaagaccaaatagatgtgtagcccctaggactctttggctcgttagaaaaaacagtacaaaatggcttaacaaaaagtggagatttgccggttcatatagctgaaaactctgcagaaagtgtggctgccacccagcttgatatagagcctcttggctctaacctttttctccagttgcccatggcaacctcagcagccccaggctacagccccctgccttcaagtccagctagtgagctgcctccagcagccccagcccggtgctcccgcagctcagtggctctacatggatcctgagccccttcctggaccaaccacagtggtccctggcctggtttgctctgactggtcacccaatgcacagggaccggaaatgtgcggggagtggctttctcggacgaaaactgggaaaccattactcgaattgggatggatagatgctgaatggccaagaaacaaaaatatcctctaagaactatgggaacacagaaaaggtgcgtccacggctagcctcataagccggatgacctgttcagtcccacccttaacaagtttcacattggcttaatgctctgctgtcactgactcaacattcttaataatttctgaacaaggggctccacatttgcgtttggtaataggccccactaattacatggctagtcctagaggtgactaacattatattacctacacaaggaagtgactttgaaactggattttgaaagatataatgaaacagcagttttgtaaatggaaaggtttgggtggcaggaggaggaggaaattccatcataggcaagaatgttagacgtgagaggcttgatgagaaaatgaaaccactagcgcctcaagtggttggggcttaaagtgactgtggggtgtggccccagtggagtgggaacaaaatattccttcgatgaattaatattccttcaatgaattaataaacacaagtgaagtgaaatttaacatgagaaaaaatagtttatattttttaaacctccatgattccaaatggccgttacaagataactcctattttccacctcacttttctactgcacactaaggctaactttcccctgtgtaacataagtgcctactgatctttatcactagcgtgttagcaaggttagcattccacttctgtgatttcaccatccaaatatttatgaatcagagagatgtttctaagaacatgttttccaattgtttactttataacaataatagtgtgctttaattacaaagatgacgttttacaacctaaatagaacaagcctcagttgtgtgggagttcattgctttggtgataaaagagaaacacagacagtgactcaggtggaacattcgtttcattttcactttgtgtttcctttggttctacatgtcaggacatgtaacagagccaaggcagaagagtgctgtggggggtgtgaaagttaaagctaaggctctatatgccagaaagaaaggacaatgtcccctctcacccactggctcccctttcaaggccaatgccaagggggaaaaagaaggtggcttccctctggcacatgaatggtgagctagttaacagtcagtgttttgttcccaaattctttaaaggaatgctgaagagataacactggttcttctgaattgagaatctctttgaattcccactgctgtcttatttccatttaaattaagcttaagaggagaaattaatgttggggtatctgctaagtgcccagtgtggagcctctttctgtcttgttcattcttggatgtccagctcttgaacaatgccaggcatacagtaggcactcaatacatacacgaggaatgagtgtatgaatttattcctcacagcacttttatgtgaggaagatgcgggggcaatcttcagataagaaaatagacattaagtgttggaaattgagagaaagaggtggtttgtccagcaaggcatgtccaacacagacagagacaatatggggcctcctcggtgactcacttttatgtgactaggtatgtgtctcttctgtagaaacttggtcaatagggaatgacgacaagaaaaaaggggcccttagaaaataatatcaccatcatgatcatcatcttcatcatcgactgtagacacagcgcttataatcacaaaattgaagaactgtaaggaatttcagaatttataataatagaagctcccatttactaatgtgttgttatattctgggtactgagttacatctatttatctatctatctatctatctatctatctatcatctatctctctatctagctagctatccatccattcatctatctagcaatcatctatcttttcaccccctgccccatatcaaccctgcaaggtgggtcgtattagctttatgttcaatgttccaggccagtaagtggcagaggttgagactcttgctgccttctggagcccttcccttagcacagcctccttgactaacacaggaggaatttgaccctcagagagggacctcaggtttctcagctagtgcagaaccagaacttgaaccttggcccgagtgttgtttccacttaccacagtgttctcagtgtagatgagtacactttggatttctttccgtttcgcttatataagtcactatgaggtttagcaggacaaaaactgagcttattgaagattaattcatcattccatctcctaccttagaaacaattttattctttcctggattccatctcagcccctggcacatggtaggcattcaaggagtgcttgatacataattaagccaggatttgatttggatggaatctcagtcttaggtaccccttaatggcaggactggaaaaaagtaggcaaatacactcttcgaaagacacacagtaatattagtttttgccttcatgaaagtttatactttcatcttttaagaattaacacatccgcactatagaacaatgggataattcagaaatatataagtagaagagaaaaaaagttacccacccatacttccaacaactaaatacttttaatattttatggaaatttctttatttcccttattctacgtattttgttgtttatttatagcttttattgagttatgattgttctgtgttgatatatatcttactttttaaaatttatttatttttaacttttatgggtacatagtaagtgtgtatgtttatggggtacatgagatactttgatacaggcatgcaagatggaataatcacatcttgggaaatggggtatccatccccttaagcatttatcctttgtatctcaatccaattatactcttctagttatttctaaatgtacaagcaaattattttgactacagtcaccttgcggtgctatcaatagtaggtcttattcattctaactatttttttgtaacccattaaccatcctcaccttcccccacccccattacccttcccagcctctggtaaccatccttctactctttgtgtccatgggttcaattgttttatttgtagatcctgcaaatacgtgagaacatatgatgtttgtctttctgtgcctggcttatttcacctaacataaagaccttcagtttcatccatgttgttgcaaatgacagtatctcattcttttttataactgaatagtactccactgtgtataagtaccacattttctctatgcattcatctgttgatggacacttaggttgcctccaaatcttggctactgtgaacagagctgcaacaaacatgggagtgcagatatctccttgatatactcatttcctttcttttgggtatatactcagcagtaggattgctggatcatatggtagctctacttttggttttttgaggagcctccaaactgttttccataatggctgtactaatttacattctcaccaacagtgtacgagggttaacttttctgcacatcctcaccagcatttgttattgtctgtcttttggataaaaccattttaactggggtgagatgatatgtatcttgcatttaaaacccacattatctctacagcattccctaagttgtaatctctttgtgaatatcttttaaaatagtggcatagcactgaaaaaagacttgtttaaataagtgtctagtttgtcagttctcaactatgtcaggctgaggatcattggcttttcctggttcttgagggaccatttctggtcttcattaatcactttatcagaaagctagctggaataaatattgttatccaaagcctgagggaaagcataaattacagctgtgaaccagtgaggtagattttcatggtacttggtaattatccgtaaatttccaataatccacactgactcctacattatgccttaggccccaacctggctcttcttcctccctctctctcctctctcctctgagtctttccattactttgatatccccaacatgctgatggctaggggccattcccttctttgacatcccactgctaagcattttgtcccgaaatgcccttattagtcttttcccacttctactgcctacaatacccaatcagttccttcccaccccaatgctatgctctataacatctgagataggggcattcctcccctctccatctatcctaacaccaagcttctgccaaaatccaaagatgtctgcctagaagtttcccaaaatcatcccctcctgttctccttaccagccctgcctcaggtgaggcaacactgctgtactcccaagactgatcagatgcctgcttagggtacctgtaatggggagggcccccgaaagtgagggaagctcagttttaataaagcaatcctgaattttgcaatgaaaagatccaggggaaaaaggctattttaatttcagtacacataagagcattgtgttttgtgaataatttttattttgagtgaacaacatacgagagtggggataccaccatcttcacagttcatctggcctccgatggcctcacctgaccagtgttgcagcctcctgatggccctccatgggcatcttcctctcccatccagcccaccctcagccctctaccagcagtcttcctgaaaaacatctgtttgtgtccatctgccactgacagaccccctccctttgtccctggggacagagtccaaactgattattacatcttcaaaggctatcacagtctgttcttcccagacttgcttccctaacgtctcctcccttccacaaatactcctgctcagcaattgcctcactgttctccaaacactgtgcatgttctctccattccgtattttcatccactgaatgcgtattcactgtgggtctggcatgtgcctggaactgtgcaaagagctggaaataaggacagagatgagcagggcacagccccttcctggcactcacagcctcttcatatgactttctctatgcctggaatgcctgtccacttcccttgcctagaaaacggtcggctcaacatccagctcgacagtcacctcagccatcagctcttgccagctttcctgggcagagccgtcctgccccactttagcccttgctgcatcaggctgtaactatttgttatcaagtctgtctccccatgggctgtgagcacctggaaggcagatatgcatcactgtgtacctgcagcttctgacacggtatccagcatatagttggtgctcgttaaaatgttggaggactaaacatacatacatatatatatagtatatatataaaatacctactatattgctggacttctgcttcatgtatattaatttgccacctaaacaagatttttaactcttcaggtcaagaaatgctcttatattgtccttgtaaccccaaggtgtctaagtagactgctgagagcagtgtccggtaataggacacaatttgatgcattgattgataggcataaactcactggagtgactcactttgccctcagccactctagtttcaagtacaagttcatcatctgatgattcaagttcatcgtattttgggaaaagaataaaagtccaaaaagccctactcagtttactcagtcaataacagggcttatgtttgtggttaaagcaaattatgaaataattgcaaatttggcaggggggaaagtatccctgagggcacagggatctggaatttattaagcatgtatcctctgggacatcaggagtaagaattttctggtaaggtcaactctagaagcatctgtgcattcagcaagactttggtaaagcgagggtgctcattttcaacaaggtagggaaggctaaagaaaagtaaacacacatcatgctctctaagattttgaggacagtatcgcttaatgtaagttttgaaataagttagatttgtgtttaaatcaagtacctatgagcaattttcttaacctttctgtgctttggtttcctcatctgtaaaaccgagataaaaaacctacctcacaggttattataaggatgaaataagatactgggtatttttaaaagtgcttactattgtgcctggcatgtagtatgtgctcagtaaatagtaattactaaataggacctggccacacatcaagtttttttaaatttgttttaaaatcagtcagtaagccagcctgagagatggaactttccatgagggtctagacactttggtgtctcaggtttccatatgacttggtagcttcaagggtaaggcgtgaagagggaaaaaagcaatatttattgaatgtcacttttgagggtgaattgttttttaattttggggggtatatagtaggtgtatatatttattgggcatgtgagatattttgatacaggcatacaatgtataataaaggtgtattgttccttaatcccatgattaaggaaacagatataaatgaggaaacagacattatcctcattttacaggagaaactgaggttataagaccttcttaaaactaaataagcagtggcagaaagaggatttgaactcagttctatctgaccacaggttctttctgccatccctggcttctaccctacaccatccccttttcagccccaaggatagtatgccttgccagccactagctaaggtgcccctaaaatgttttagggtgctcttcttacaatcagcttttttcaccttggccctattcttagcaaaagcagcatctccccaggtggagggcaaaaaaggggttcacgagtctcaatggctgctaaggttcctttcggtatgagaatttatgattctgacacgatgtagagccacatttttctctgtaagctcagtttcctcatccatcaaaggagggccctgaactgcatcagagcatcccaagtttcccgtgagcacttgccaggaggtggtaggtatcgtggttgcgcactcagacttgggagtcagactgcctgggttgagtcctgctctactgctcactagctaggtaacttctggcaagttatttaccctgtctgtgcctcagtttcctcatctataaaatggagatgtttacggtccatcaaagggtggttacaataattaaaagcattaactgtacgtaaagggcttagtacatagcacggaacacccagaatgctacatagtaacattttacacttagaaagaagggagggaactaatcctctcaaggtcccaggaataaaacttttggcagccgatgctagacccagaatgtatttgatatcttctctctttccttagaaatccttgcatgacttacattcaaattccacatatctatatatgtttaatacaacacaatattttaaggattttttatttaaggcagacactcaagtaagatctcctttgtttatctcatggccctggtacacctgtgtgtgctcatgtccagtttgagaaaatggaagtgaatgacttctagggtccttttggctatggtgtcttttagttctgagaatcaccgccaaacatctacacctgctcaggtgcagactgaagtgaccagctacctggtagccactcatgtcaccaaactggcatagagatgctagagctgcccgagctacactgagaattttgcctgaaggcacagggagaagcacagcctggctgctctaattctgtattactagcccatgctgcagactacattttctgcttcaaggtagatgaagaggaaataaaggaggatgggaagcagagaggggcagggatttaaaaaaaggaaaaagcgcctgcaggattttttgtttggatgttaggaaacaaggaaaatgcacaagtagtcacaatctttgggggtccttccatcttccaccatatatatgccgtgtgtagcatttgaaggtagacatcaagactcattctttaaccccatttaagcatcctgagcaatgatggtatttgatatcctttctcttataaaaatatttgaatttgtatagcattcaagcaaaatattagcaacactctaaattctaaaagtagggaaatgattaagtaaatcatagaacatccattggcaagttatggtaataagaatcaggatagtggttacctctgggaagcaaagaggtctacttcttgagtggtgagttcctaatgtgtttgattattaaaatgtgtgtgtatatatatgtgtgtgtgtgtgtgtgtgtgtgttctatataatcttttgtatatatgctatactttataataagacatatttttaagaagaaagaccatataccattcgaggtaataagcaaaagagcaaatttcaaaggtgcatgcaatctaaaatcataactgtattttaaaatcatgtacatgagaaaaaagattagagggaaacacactacagtgttaatagtgttgagattgtgggtaatatttttcccttgtctgtttcccaaattttcataatgacaaaaaaattatagtaaaactttccccaaagaaatctttaaaactatgaatcttttatcttcaaatcactttcacatctactatctcatttgattcttacaacaacctagggggagtcaatgctaagtggttacgttttatagactgggaaactgagacatcgtgtttatgacttgtatactcactcagttgactggaggtaaacctgtggatgaatccccggtctcctgagtcctgctaatctactgacttccaggacttcatcttggattctggggtctctggattcaatctctcaaatgggaatatctgctacctgggttttggccctgtagaccaaggtagatgtctatggttgttgatgatgggctacacacaagaagtcaccagagatgtaatccatgcctggggtgttctgccacatccctctctcacaaggcacctagtccatgggggtgaaaattcttggaagtattggaggtgggagaaggacaggctgtgtttaagttggacaacatttcttaactctagtttttggaggggaagaaaggttgcagaaatgggtctgtccttgttctattcagtgccttacctatgatgtcttctctctccccatctctcttagggaaagttgccagaagctcatagggtggctttggcagagggtccccattcaggaccgtcagagctcagcccaaggctcctcacttcagaaaagttgggagccttagaaacggggagtgccttgctcaagaataccaaagacagaaccagaccccaaacccaaatcccctgctcctagcccaggatacttggcagggccatccagcattgaggagagccccaggtgtgtggtggagttgctgtgatggggaacgaggatggctttcatcagtgtctgcctgggctctcactcccgccccctcttgattgtcattcctggagatcgcttgacttcatccactattttccactgacaagtgatactgaatgagttcctggagagattcaagggtacctcagaaagcttctcttgattcataattaattaatgataccactactgagggctgactgggtgccacatcctcagagaaatgtcacaacaatcttatgcattaggtgctattgttagtgccatttttcatttgaggaaataacttacttaaggtgacacagcatctaagtgctgaatccagaatccaagtgccttccacactttggtgcctactgtgtgatgctgcccctgtttcctgacaatgccaattttggacactattaaactagcaatccccacattcaaactgactttgtagaaagagtgagcttcggaaacagaataaagtataagaaaatggactccactcccgttccaaagcgaagaagtaggttgagccaggcagacagagctgctagtactctgccgcttctctggcagatcttatcttgtgtttctagcattctgggcacgaatacagtcttagggtttagagaacagagtaatggggcagaggaatgtgggaagggactgtgcactgaactaagaaactgctagaacctttaaatatctcaaacttttttgttttttcttttgcgtttggctccctgcaatgtttttctgtttagatttggttgccacgagtgggctgtttttagttgcctagttccttcccctccccttttaattttttcccttccttttgcacatgtcccagcatgaagtctccaactcttatctcactcagcaaaacataccaaggctgatctgaatgtggattccccaggcaattcaccatcataaaacctcagcaatcttcaagtctctgcttaaccctctttcattgaggattaacccctgaaatcaccctagccagggcttccttctaaggcgagacagccattcttttgtttgcatggagaagagttttggtgtggaaagcttttctgtcccctccacttcatggcactgcctgtgtgtgtgctgagagtgtgcacactggacattggtggcattaactgaagtcagggtaaaataaggatgcaaaggactcagatgttgatcactctcctgtggcaaagacctcaggggctctgccttgctctgttcttttccagtctctcaattcagcaggcatttcacggttctcctgggggctgaggggagggaggcaggcaggagtagttttcgttttccctgggtaagagtttcattcaagtgggagtggacttagttctctgtcaagattcttatcacttttcgggtttagaatatcaggatcagacttccgtgaacagctgacagcatttctatccaacttggagattccaaactaagagtaattagaatgaagcaagattgataaaaagaactggaggcacaatggtaataagaataacccgaccggggtgttgggggcttctccccccaccccaattatccttcccttgcattgttttgtggaggacggtctggctgtttgtttacttgacgccctaagttgaatttccccttaaggacaggagcagatctccacagatctggcttgggtgttttaatggaatcatagttcaacctgtaaactggtcaaaatttctgtttcacagcagaaagagtaaaaagcttcacgtgttctccctcctctccttgcttcactttataatggtgctatttattccagaacaatctataagtagataaaatagctaagtagagataacaaataacttcattcaaatgcaaacactcctccacctaatcccgcccggtgtccgccgggctgctccgacacgcccggggtttacctgcgcgcactccagcgggagggcgggttgtggaggtgtgctgagcggcgcgcgggggtgagggcgtggaagcggagggtggggcccggagagccgttaccagggcgaaaagtaaagcgaaaacacccgccctgcacttcccgcgcgacgccgctggaaatcggttcaggtccagagcaggatctcggaggatcccgcgtggaactccagggctcccgggtccgccggggcgcaaagacttccgaggccgccctccgcgtgttcccaggcccgtggagaggtgggtggtctgagtgaggtcgggcttggcggcgaggaaccccggtggggggaactggggacttcaagtgagacccaggctccagacacctctagtttctaccccaaattaccaaactgtgaccttcggccgcctctctcccagaggcaggtggaaaggagcaggtgtttctgcccttcaccgtgcccccacaccctgcggccgcgcaggtctccctcccaggcaggtgcgaaagtcccaggccacacttgtgtctacaaatagtcatccacgggcagtcaagaaggttccttggttctgccgctctctgagcagaaattgttggggtcggggaataagaaccaggaaatcgtttttaaggttcaaacccagttctgctgaggtctcagctcgaatctcggaccacggggccccgcctttcccgccaccctggcttgagggcagaggggatttctgctgcgggttccgcctgtggtcattgcgtccccattccgggccgtccggtcccagtccaatcggctctgggagcagaagaacacgtgaaagctgaacatgggttttccctaaatattgcctgagagcggggcgacccccaggcctgggcaggttcgcggaccccaaagcaccttctctttccccctcctcctggccgctggcttccgccccctcctaccctcccaccgggttgcctctgattcctcctggactccgatcttttcacgctcttgttggtttcactgacatgttcttgtcaatttcaaacgctttgtgattgtaaaaaaaaaaaaatcgaaccgatacggtcctaccactcgccctagtttcggagcccggagctgtcctgcgtgtgcgtccatgtggagtgtccggggctgcgggctcgggcgcacggtgccagccgagggctgccctccgcttttgtgttaaccggcgggcttctcgcggtccccgccgcagaggtcacacccggcgggtaacggcgtggatacaccgaagggtgactttggacaccttccccacaccacagactaacgcttctgcccctactccgcccctgctagagaagtaggaggccagtgggggagggggtattttcctgaagctccagaaaatgaccacgcattttagagaaaggtcgtgcccgcttcccagcctcacctagtctgggctggggccgggacccgcctccccaccttccccgccccccccgctcttcaacctagcggagggacagatgccagcgcggtggagtcatgccgctggcttgggcaccattggtcatgcctggaacacgcagcagcgagtacgcacatctggcggctatcccgggcggctccggtcctgatatggagagagagggcgggctggtgtgtgtctcagtgagcgaggctgggggaacgcgcctgggctggctcctccccgaacttgcatcaccagtgccccctctctccacccgccttcggccccgccttggcccctcctccaccccccttcctccgctccgttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggaggtgagcgctggaagccgagggagtgagcgcgacgagggctgctcgccttcattcccttcgcgcccctctaagtaaccagtccgccgacccctgacccaccccggatccgcgcccccagcctccggcttggaaataactctggcttaaacttcttctaagccaccgctgctcctcggcgcttcgaaaagtttcccgcaaagcgaaagaactaactttctcttttgacttggggcgcgaaaggttcctggtgacggaggtcgggcgtccactctgccgccagcctcgagcgccgcttctctccgccgacggcgctggcttgcccggctgggagagggcgtaaggtgggtgggcgggtgcgttggggtgtccgaggctgcctcgctcgccgtcccgctccatccctcgcttcgagacacggcactgtgggagccgatccttcccgggtgggggggggggggcgcagagaggcacgaaggccggaggcttgcgggagggctgccccacgcgccgagaggaatgaatggggaaggggcgagagggcgggaggcgtcccgggcgcggccgctgggggtcgccctgggtaccccgcagcactggcggcaggaccgtgaaggcaaccccgagaaaaagttagctgggataagcttggaagtggcgagcgctggtgtcgcgctgtcccggggcggaagacggggagggctcccggcaacggctggtgtccggaccccgagcccgggactcccacacacctgggactctcactctggcttttccttcggcgggtccgcgggagacccaccgtggcggggaagcgagggtgtggagccacttgtgcagatatttgagagaatggctttgtggtctagtgccaggactctgagcgcttacactgcaatcgatgtcgttgggcctcagtatgcggagccgggaaataagggcacatgggcagtaccggccccctctgcgtgttggagggcacaatgcagtggttggaccagataactactaaggtcctttctgtctggagattttcagattttggagtggtgtagtggggagaaaaggagccagtgaggggacttgaatggggtgggtctctatctaatgtcattcaccagtgtccagacagtgggggaaaggggacttttctgcagggcatcttttccctcaccagctttctttccactggattcgttctccttctctgctccccccactcccattttcatttctcatctacttcctttcctcctaaacattttcttttccctaatttcattgcataggtcacatatgctttcttacaaataaaatagttactaaatccttgatgaacccagaaagaaaaggagagccagaaaatctggatgttctctcagtgtacccctttcgttgtaggtgacagtcatatcttctgttcgaagtttctgtctctgtaacttaaagtgaaggcaaaaaattggtattactgtccccattgttttgcagttagcattggttgtagaataatgctacaacatacaggctcctgctttgaggatatcctgggcaaagatgggatggggtgaggattgcagttactgtcggaatggtttcagagacagcaaagaaggcagcaccccacgcccgcagtggggataagatacagcacccagcatctgtggcagtgatgggagccttctttttctctctctcttcctccttgccctttagccattatagaattcctttttctccatggccgttttcttcgatagcccctccctatctcagtcctgtcaaagtctcctctgtgattggtaccaggtgccaggactcttgaccccttatctacctggctaatggctctgttctctggttgccttgttggttgatcccttgaggcggtcgatacctattggtgatggagcaaaatgagcagtcggtgggtgttcagcagcttggcatgggctgggccactcaccagctttatgacctcaggcaagtcatttttacctccctggaccaatgtactcattatgaaatgagaatctgacctagatgattctaatattgagagggtgtgatttccattagatagagtccatgattccttcctttttaaaattggctgggcatgggacagggccagtggcttcgagtgtttacccagccaggggaggaggaaggacatagccaagatgcctcagaagctttccaagggagaaatggtttatatgtgagaattggttctctttcaaatatgtaatgcagaaatgctggcatcagcaaatagtggggtgaaacctacctggtctgtgaagaacttggggtcaatgagagtacaaaagaggctctgactgacctgaatgtcttgaaggttccagttaattcctcactaacagggctttattgaattgataacaacagaatgagtttttcctgaaatggagaagatggagtcacagtagtaatgactacccggtgtgtatgtaaatctcatatgtccttctcaacagccctttggggaaggcagttttgatctcaaattacagaggaagagaatgagaggcccagaaagcctaagtgatttgttggtggatgctcagcttatgagtggcactgataggcttagaaacattgtctctggcccttgatgcccagctttgcacctcttcaagaggtctgggaggaagaccaagatatgaagagttagtgaaaggccagtactggcttcctagtaacataagatggttagcaagcaatgcttagtggaaagaggatgaaaattaaaagtgaaaattcaatgtagctgtagctactaggaaataaaaatctgggagctgaatttccagttaaaggaatacatgagtaaactttcactttcttgaaaatgatgaaactgccaatgatacaacatgatttctgattggaaataatcaagcagaaacaaaatgcaagttcttggtagcaagtctgaacaattttatgatcagcatagaaagtcaactctgatctgaggtccccaaacaatttttttcaatgaccgggatgtttgaggatctcaactttctgaaaaattgtgtgaagatttaacttcatttccttgtggggacacagccgtagtctaggctgaatcatacctcgagagactgagtaaaggaataactagaaagtatcccgagaagttaagctttagcctagtgccgagaaaacccaaatctcgacagatacatctgttttattttctgaaaggcttttaacatttttacaaccatttatgtccccaaggaagcccacccaatgcttttcataaaagcattccataccactgacattcttcagcttctttcattgggactgctgactttacataagaagaagggtagggggcgggagtcataaacagcagaccccaagccctgagagctcattaataaacctagttggatggcaaaatggaactacactctactgcagtggaattcaaagtccccgtgtagaagggagccatccaggcctccaaacaaagaccagcccagtggcagctctgaatgtcatccccgaatcactgagtttttaataaacttggaaagggaagggaaacatgaatgcatgggagaatcttaagcctctggctttagaaggctagtttctcagagtttattgcctgacagcgacaagtatcctcccagcatcctaagattataggattaaattgagagaagaacttcagttctgactcatgacacagggctttgggaaaagaattacatacatagcctgggtttctttgactagtcaagggcagatttcattggcctggaagtcttgcctccattggtgtatgttagatctccagggggagtttgaagtcagggtattctattcagaagcctttgagatcaaagtgggtgaccagctgccctccttcctggactccacagagcctctgtcagagagccagccctgggctggagagatctctgggaggcctagtaatcatggagctcctggccaaagaatgttttccagggcatattcatgtattagttcctcaattcctcataggatattatgggaaaatagggcgattattacaagccctctttaacagaggagaaaaagccacggggaggtacaatgataacacataatggagtaagtgggcttcaaatcttcatcttctgacctcagtctgggaattttgtggataagagacccacttgctcacactcccagaaggcagttagcaagcagcctgggtatgcaccgtgacataaagattagcagttcattaaacagagttcagtttatcccgaggaatctttacttagcctcccctctatcacttcatttccaggcctcccacctaccttaaggcctgccccgagaaaatttgctctggttttttgtttgtttgtgcaatataacataatgcttgtttgtttttgtaatgtagaataatatttgtttgttttttgcaatgtacaaattaagggcatgaatcctggagccaaactaacttaattccaaatcctgatgctgccccatattaattctgtgaattcgggcaaatgacttagtttgtctaaacctcaattatctcatctataaaaggcagctagatcttaactcactgggttctcgtgaggattaaatgagatagtgcccctaaggtttctggtatgaaggaggcactccttaaatgttcgagacttgccagagggcttcttctctgtctggactgtgctaatgaccacagatccccggttgagaggaatgcccagaccacactcatcctacactcatccctatactcattgtcccttgggaaccaactgcagggaggaggggaaatggccaccactggagggagtacacagcaggccaagacttatgggggactcttccaaattggggccatggaactgtcactatttctactctttattttccttttgtcatccttttgggttcaccgagctatagaataacagagggagatgaatttagcaaatacatcactgaagcttctccctcggaagttgggcccaagcaatgggaatgagaaaggtaaccttggaccgtgggggccatttgatttgatgaccccatccccacttcatttatcagttggccaatgaggcatggcgagtcaggcattgggccaggctctgggtaaagcaatggtggagactcaatgcttgcattggaggagctgtcagtcatttaccagacacagactgggtcctagagagctgaaattactagctcaagtcactgctgtttagtgccagagccagccccagggttccctgcccccacacccagcctaagtctatccctataccacaggcctgaacaactcccccacaatacagtgcctcacttttctttaagaccttttgctttgccaaccttaaccttaagaatccacctccccatcccctgccaaagactggggtgaagaaacgcacctggctacagttacctttctcattcccattgcttgggcccaacttcgggggagaagcttcagagatgtatttgctaaattcaaggattccccactttttgcttttacttccactcactgatagtttcagcttgacgtcaagcctctttgaaaaagaggcttttttttttaagtgaaagaaactttattttgagtaatatacaaaaaaaaaaaaagagagagagagagaaagaaaaagaagctgaaaatgagattactcatgatttttaaaatggcctcactgatttttaaaaaatgttcttcctctttcaggactgtttgtggccacatttgcacataggcacaccagccaaaactcatagatcttgtgaattcagagtagcctgaaacatcatcccttataaatttcaaataggcattttgttcatgtcactgagctatgtgtattttaagaacctgctttacttaagatgaggatggcatgaaatgaaaacaaaacagaaacccaagggcttatgggacttttctctgagggtggggctctggtgttggaggtctggtgggggagggggacttgatcccatgccccagagcccctgaaacagtttgggtttcaatgtgtctttcagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtgggttctatcacaggtattcattctttcggcacatgtttcgctcgcagccactgtgtgttgggcatgttctaggcagggggctgttgttgagagtgaaacaaacaaaaccactgccctcagggagcttaccttctcctgggaggagacagaagtacataacatacgtaagtacacgttaagagatgagtgcaaaggagaaaaaagcagggagcggggcagagagaacgggtagggatggggttgctgggtttaaaaacttttcaggccaggcatggtggcccacgcttataatcccagcactttgagaggccaagatgggattatcgcttgagtccaggagtttgagaccagcctgggcaacacaatgaaacccaatctctatgacagtattagctgggcaaggtggtacatggcctatagtctcatctacttgcgaggctgaggtgggaggaccgcttgagcccaggaggttgaggctgcaatgagccgtgatcacctcactgcactccagcctgggtgatggagcaagactcattttgcttttagagacagtgttgctccatcacccaggctggggtgcagtggggtgatcacggctcattgtagcctcagtctcctgggctcaagcgatcctcctgcttcagcctcccaaaacactgggatcacagggatgagccattgcacccagccggggttgctgttttaaattaggaagtcaggtaaggattcactgatagtgacttttgagcagaggtcaaaaggaaaggaagaaggaaagaggagagggaagaagccacgtgggtatctggtaaaagaaattaagggcactgaggtggaagtattggtgcctggtgggctgtgcagtggggcagagtataggggtgggagataaataggggctggtcatattgggtcttacagattattattgtatagatgcagccctgggctcaaagtgaggtgggaaaccacagaaggcttttgagcagagaagcaacaagattcaacacacacacacacacacagatacacacacacacttttttttttgagacagagtcttgttctgtcacccagactggagtgcagtggcatgatcttggctcactgcaacctctgcctcccaggttcaagggattctcatgcctcagtcttccaaatagctgggattacaggtgcccgccacacgtctggctaatttttgaatttttttagtagagacggggtttctccatgttggccaggctggtctcgaactcctgacctcaggtaatccgcccgcctcggcctcccaaagtgctgggattacaggtgtgagccaccacgcccagccttgatttatatttttaaatgatcaccctggctgtcatgttgagaatgggcagtaggggtaagacagaagctgagtgcacagaaaggaggccgtggcaggaatccacgtgagtcagggggcctgcagcaggagggagcagtgcaggtgctgagaagtggttggctttggatctgacttgaaggtaaagctgatttgctgatagattggatgtggggtgtaagagaaagggaagactcaagggtgactgagttttctggccagcatagctgtaagaatggagcgtccatttgctgctgagatttgggattataggggttagggtggtggcaagagcaggaggtctgtcctattctgcagacccctgtggagatgtcaagcaggcagttggatatgtgagtctggagttcagaggacagtctgggctagagataatagagttggaaattatcggcatatagatggcacttaaagccatgagtcaggatgaggccaccttctgtgtccagttgttctgaagaagcttggagcgtggtggtccctgtttttatcactactaggacccaagcacccagacagtagagcaaggaccaggcagcctgccccacccttccctgtagcaatgttcacagccttgggaccaggtgttgctccaggttcacttctgtctgacacacttgcactgttccacgcttggcaaccttgggtaagactcctggaataataaacatggtgagaagtctgggaggtggcttctggcgatgccatagtggcttaaggatgtcagagctgaggttccaccattttattggccttttcctcatggtggcaagtggaagtgtttcaggcttactcaactggcatgattgcagcctttgggcaaggagtagtgggactgacctaaaagactgtcctagttcaccacttgcaggtggcaccccagcatgggccgattaatgccgctttggttgggaatgggcttaggtgccttttctacaggagcatcatgggcttctcccaaatttgggaagctggtgctctgatgctccaggtgaagtcagaggtgaatggggttgcccttgggtcttgaattgaagaagaggccgggagtgggtggctaggtaatgatcctgagatcattcctggttctcaaagaaaggagatgtttaccagacagaatctgtttcggctttaaatgattatagttaataccaatagttatcaatttgcatattatcctcatctcaaaatccaaatgcatttttaaaattggctaacttttaatttactaatatattgccggtataattttaactttgatttttgttgttcactcacgtgtgtgtgtgtgcgtgtgtgtgtgtgtgtgtgtaggggttttcacacaaaagtctagagctttagtatttcggggtcttttagcgctagcattgcccttgtctgccagcttttgctggcagtaaaaggcagtgtatttgaggtaggtggcatttcttactgccctttaaatgtgtttcttttggattttacaggtagcccctgaagaagatgaaaggaaaaagaggcgacgagaaagaaataagattgcagctgcaaagtgccgaaacaagaagaaggagaagacggagtgcctgcagaaagtgagtgccttctagccttacccttcctctcgctcacgcctgtcttcaccagcttcatgtggctatcagaagaagagttagaaaaccccctacttggttatagtttcccaagaagggccttgtagctggtagcagaaatgccagttgcagaatgaggaggtggcaaagcagttaacacaatggatgtgacggtggatgtataaaaacaggtgtgtgaattcgtctgatgcctgactcccagcagcctcggccggttcatacatgtccatcagcttccaggctgcaggacatgccagcccagttaaagaggcttcacttgactgttttcctgagaaaaggaagctgccagctctcatttggctcactatgaaaagcctttaattaatctcttcaaacaagttatttccttaatccacaagcagtggttacacttgctttgcattcttgtctggttcctaactctagagcccttctccctggcttagccagtaagctgagcccctggctgcgttcagccggcccgcctgagagacactaggggaaatagcttttgtgggcaagcagggtggccggtggtgctcagcagtctttccagtggctgtgtccctcctccaaatgtggacaggccatgacagagtcttagcccaagtcccacagatccccaaaagttctgttgattgcttcaggggatcagtgaaaattagggaattttgtgtgttgctatatacattttttctggggagatgagcttctcattgagatctgtgactcagaatcgactaagccaccataagtctggatttctccccagctcccaaggcccttttgggtccagaagacctgcatatgggctgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggtacacccctgcatccaggcagcagcccaggccaccccctcctcactggcccttggctcctttcttgatgcctctgttgcttgtcccccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 68 - DNA, 2960 bp, Homo sapiens
gcatgttgacacatcaggcccagctctatcactggggagggagataggctgccagggacagaaagggctctttgagaaggccactctgcctggagtgggggcgccgggcactgtcccccaaggtcgcggcagaggagataggggtctgtcctgcacaaacaccccaccttccactcggctcacttaaggcaggcagcccagcccctggcagcacccacgatgcgggacctgcctctcaccagcctggccctagtgctgtctgccctgggggctctgctggggactgaggccctcagagcagaggagccagctgtgggcaccagtggcctcatcttccgagaagacttggactggcctccaggcagcccacaagagcctctgtgcctggtggcactgggcggggacagcaatggcagcagctcccccctgcgggtggtgggggctctaagcgcctatgagcaggccttcctgggggccgtgcagagggcccgctggggcccccgagacctggccaccttcggggtctgcaacaccggtgacaggcaggctgccttgccctctctacggcggctgggggcctggctgcgggaccctggggggcagcgcctggtggtcctacacctggaggaaggtatgtggggcccagccccaagcttggcaccgccgtcttccttcaggtgggccgggtcctcctagggaagatcaggggctggcagagcccccaccctgggcagggaggctgtggtcttgttcctaggactgggttgcgggtccgtggcctggaaggtgggcaccacactctgtcctgtccccgaagcccagctcttagacttgcccctgcctcggtgccagggagagagctgctgccttctccccacccctgaagacgacgcagggctcggggccagtggaacccttcttcccacagccccagcctgttctcagggccgctggcctaagatactccctgcggggaaggggcttcatcgggcaccccaacccagagaccccagggcggcagccccacccacagcctcagacgcagcccctgcctgcccctgccgtcaccgctccctggctgcaggaaggcagctaagaggggcacccttgtcccccgcttgaggtcccctgcacagtggccagagcggcagggacagatcccaaagattcccggggggtgtggccttcaatggctcaggcgtcccctgctgtcccggctgcagtgacctgggagccaacaccctcgctgaggttccaggagcccccgcctggaggagctggccccccagagctggcgctgctggtgctgtaccctgggcctggccctgaggtcactgtgacgagggctgggctgccgggtgcccaggtaccagggagttgcatggggcagtgcccgggccgtggcggggggcatggatttgttgcagggtctgcagtactgagaacagcgtagaaccagtggcgatgggaggaaggggaccggtagagcggggctgggtaagcctccatccagccgggctgagccctggtctccgcagagcctctgcccctcccgagacacccgctacctggtgttagcggtggaccgccctgcgggggcctggcgcggctccgggctggccttgaccctgcagccccgcggagagggtaggtccgcgtggagagggacggggagccgggtcgactgcccccgggcccccagcccctgagccagccgcgtgcccacccaccgcagactcccggctgagtaccgcccggctgcaggcactgctgttcggcgacgaccaccgctgcttcacacggatgaccccggccctgctcctgctgccgcggtccgagcccgcgccgctgcctgcgcacggccagctggacaccgtgcccttcccgccgcccaggtgcgcgcaggcaccgggacacggggcaggagcgggcgggggcggcgtggcctcgtggccgctctcaactcctccaattgcgggttccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggtggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggtccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgccggtgacccctgcgccgcgcggactcctgccccgagggtccggacgcgccccagctcgcgccccttcccatatttattcggaccccaagcatcgccccaataaagaccagcaagcaaccggc

SEQ ID NO: 69 - DNA, 66283 bp, Homo sapiens
ttatttttctgtgtgtcccatacaggcccccaccatgaagggtttcacagccactctcttcctctggactctgatttttcccagctgcagtggaggcggcggtgggaaagcctggcccacacacgtggtctgtagcgacagcggcttggaagtgctctaccagagttgcggtaagcccttgcagtacacccatgtgtgtttatggggaaagcaaggcccacagatgtgagccgctagtgctcagttggagttggggtgggaggggagaggggaccagcagctgaacactttctccacctgcagcaggtctgggagggccactgggagcttttggaagaaggagcggtggggccaggactgggagcggaagagaatggcagaacaacaaagagtacaagaaagagaaattgaatctaaatatagccatttactaacaccacagaacccaaaaaagaacaaaatgatcagtgagtctaccaaatcatcaaacctcaccagctgaaaattaggaaaagcagcttccagtaggcccttcctcaacaccgtacacctgggctacctttccatctgatgtactttgcaagtgaagtgaaaagatcacttctgcccaaagagaagattcctgtccctctctggacactttcagagctttcactgcagcagtagctctcatgaattcagcaagcacttcgcatgcagctatcaatgccagggtttctcagtgctagagataataaaagtgcatatgccaggcctgtcaccccagcgggccaacccaatacgccaacagataattgcaattcagtgaagagaatgcagtgaactgtggtaagaagtgtcagaaccaaccaatcgggctgtgtcttagtcagctagggctgccataacaaaccaccacaggctggggacttaaataacagatttatttcctcacagctctggaagctgggctggtttctcctgagacctctcttctttgcttctaggtggcatcttctccctgtctcctcatgtgctcttccctctgtgtacatctgtgtcctcatctcctcttcttataagtacacaatcatatcagattagggcccacctccatggcctcactttagcttaatcagctctttaaagaccctatctccagcagggcatgatggctcacacctgtaatcccagcactttgggaggctgaggagggtgaaccacttgaggtcaagcattcaagaccagcctgaccaacatggaaaaaccctgtttctactaaaaatataaaattagctgggcatggtggcacgcgcctgtaatcccagctacttgggaggctgaggcagaattgcttgaacccaggaggtggaggttgcagtgagccaagatcgtgccattgtactccagcctgggcaagaggagcgaaactctgtcttaaaaaaaaaaaaaaaaaaaaaaaagaccctatctccacatacagtcacattctaagataccgtagtccccccccagtctgctaggaatacgttccaagactcccagtggatgcctgaaatcatagatcgttttgaaccctacatatactatggtttttggacccaataaatgagacagctactaagtgacggacaggccggtagtagagacaacatggatattctagacaattcgtgttcctggtgggctgggcagcacgagatttcatcatgctactcaggaggatgctcaatgtcaaactaatgaattatttctggaattttctatttaatatttttggactgcagttggctgagagtaaccgaaaccttggaaagtgaaatcttggataagggggctgtactgtactgggggttgggacttcaatacataaatttgaggggatgcaattcatcccatacagggctcccaagtggggagcaactcaggagcccagcctcaggatcacatctgctgttagagggactggcttgtgcaaacgcatggcattgtgatatctgccactttggagggagatgggggcaaaatgccgtttgaactacaggagatggaaaagagaagttgattaagcatctgaattggcctcactctaagctggggagtgatgaggatgcagtgcttgagcaagtacctgatcctacaactgccacccaaagagctgcccagagaggtccagatggtcactctagtcaccagggccatttgttcaatttgacctcacttttaaaaataagggacattgaagtgcacacacacacaaaaattaaaaataagtaaaagagaatgaacgactggatgctggaagtgctgatcttgtcactctaggttttcccatggcgtcaggaccactagtatcccattcattttcagtgcaggatgagaagcaagatgtgagataaatggactggtcagggttggtttttccaattcatccttgcataaaggttgccacagctgatctgtctcccagactcaccctctgcctgcagccaggctggtgcatcctttcaagtcacttgcaagaggactgggcacgtcagggaaagaacaaggacacatcacctgcccacaggaggatggctctttcctctgtaggtgaagtttccccatggagtcagtgaatgtcttagccaagccactcagaataagagatggaagagatgcagttctcatccaagggagtgggacgatcagacaattaagcaacagggtaaatgctttgtgtgaaaggctgtagtgaaggcaggcattgtgcaccagggacatagtagtcagacgatggtgaggttggtatctggatctgttggaaaaggagtcaccaagcctaagttgaggcttaaagactgatgaaaatactaatgataacacctcatgttggtggaggccaccaggctaagtactttacatgcatcattcttatgttgcagatgtgtaaactgagggataaagatgttatgactagtgaacttttccaaggccacacagctaatagtggcagaattatatccccagggtcacagagaaggtaagacattgaggaactattgatggaattaaaacaaattgatccccagcctgcctgactccagaacccatgctctaaaactccctgtggtctagagtttaatcagcaggcaaagtggactaaaggaggggtgagaggagaagtttggcagagacaatgacatgcgtgaaggcaggaaaatgggaccaggcacagggttcagggaactgcgggagggctgaaaacacaaagggctgaaagaggaagtggaagacatgagcaagaccccagacaatggcgggctgcctccctttggccaggaggttgcattttggaaagatcctcgggcagtaagcaggagtgtagattttgaattggaagctatttgaggctgaaaatagggttttctccaggtggagcaataattcaggaaagaaaccactaaggcctaagttgacatcatttccgcagtcttgataaccttgaggagaagggaaacttcacaagcagttactgggctctgaatactgactaggaagtaagcagttttctgaaaaagcagaagtcctggcctggccaactgtcaatgacacaggaaagaagagagccactgtctttactaaagcaaaaggaggagcaaacacagtcagggccttgggtttgctaaatcacgagtcccacggttacaaaagcccagagactccactccatgcacaaaccacaaacacccaccgatatatttatttatatgctgcctccagcatatacacgaagatgtgaggagatgacagaaatacttatgattggaaggggaaataagcagcagtggaagaagcagggtgaggggaagcataagggaaagtgctatggactgaatgtttgtgtcccctgaagattcatgttaaaccctaatcccagtgtgacagcattagaaggtggggcctttaggaagtgattagatcatgagaatggagacttcataaatgggattaatatcttaaaagaagaggccagagatctcttttcaccacatgaggacacaatgagaaggtggctgtctgtaaaccaggaagcgagccctcaccaagaacctgctcctgctggctcccggatctcagatttcaaccctccaggactctgagaaatcaatgttggctgtttaagccccccagtctatataatttgttaaacctgcctgagttggctaaggggaaatcataaaggcaggagaggttaggacacatgtaacagatagagcagcatgagaggtaagagcttagaatctggagtcagcaaagctcattcaaatcttgggcaacactctagatctcatgttattgtttgtaaggagggtgtattcgtttcctgttgttgctgtgacaaatttctacttggtggctgaaaacaacacatgtatttgctcatagttctgtggtcagagtccaaaatcaatttcactgggtagacagggcctgggccttgctcccttagaaactctgggggagaatccctttcttttcttttccagcttgtataggtgcattccttggcctgaggcttcttcctccatcttcaaagctgacagtgtagcatcttgcttccttctatcatcacatggccttcctgttctgtttcaaagctccctctgcctccttcctgtaaggacccttgtgattaggatcatctccccaactcaagatccttaatcacatctgcaaagtctcttttgccaagtaagataagattcacatgttccaggggttaagaggtagacatctttggggaccattatttagcctaatgtcatagggagaatatattacctacgcaaagggctgtgtgaagattatgtgagaaggactatatgaaaggtgcttagcacatactgtgcactcaatgtatctttgctgctgatgattttgtacagtattttacaactgattgaggtataatagactctgagcttccttgaagccaaatcaaacaaggacatggcattgtttctgaaataaaattagtttttaagatgctcagcttttcctgatatagggatgagcgatgaggggaatttctccccagagtagatggcatcctggatggtgtgtctactgagaggccatggtgactcaaacccgctgtttctcatgatgccccttggtgcaggtcaggaagccagaatcaagatacattctgcaaagggccaaggcagaatcctccatgaatatagcatacagcaatcacaggtcagccttctttgagagtgaaggttagattgtgtacaggaatggataagctgcatgtcctgtgggcaatcctccataaatattgttgccattgtttttgttactggatgtttgtaagggtcagatagagttctggattgtattttttggcaagggcccagcgttataatttcacatgctttgacatcaaccaggcagaggaggacctgtgacacatgctcaaatgacttatgtccccctttggtttccctgatactcacagtctacctggacagagaagtggctcctagaagttgtgtaaggcagacacttgcgaactagagcccgcaggccaaaccccactcggtgcctgtttgcatatggcctgtgagctagggatgatctttatatttttaatgttaaagaattcaaaagaagaagaatattcatgacacatggaaattatctgaaattcaaatttctgtgtccataaatacagttttatttgacacagctgcacccattcttttagatgttgtttatgctactcgtgttataatggcaaggtagtgtgacagtgaccacatggcaaggctccacagagcgttataatcatctggaactttctagaaaaggcttgccaatccctggccaagagtaggaaggaatctcttaaactcttcgccagatcagagtctcaagttccaggccttccagatgattctacccacagagaggctgcatgagcaagtgaactcaatggtaaacccaccatgattgcaaggtatttataagatccttttcagagaatcatcattgtcataataacctctcccttctgcatgccactttaaaatttatgaagtccttccattgacaaagcctcatttaatccttacaaacaggtagataggaagtttatctccattttctggatatagaaactgaagcgtacacacattaagcattttaataaagtaatatacctgagccatgatacaaacctatgtgtccttactgcatgctcagtgacatagagctatgtcatagaactctagtagggagtaagtcatgccatcagatcccagaaatacagggtgagaccaggcagaaggcacagcacaaaagataagtcttcgggtaaaaaagtgaaaacgccaagcagtctgtggaccagcaaaagaaggatggggaggaagaggagatcaggaagagagggaggtggtgagggagagggaaagagaggaggagagaaaagagcggaaggaggaggaaaaagaggaaaaggaagagggggagaaagaagaggaaggggaaaaggagtaggaggagggaagagaacaagaaggagggaaggggaggaggaggatgaggaagaggtggggaagaagaggagaaggaggaggaggtggaagaggaggaagaggagagaaatgagaagcaggagaggagaaggggagaagaaagaagagaggggagaagagaaggaggaaaagaagatgaaaggggagaaagaagagaagggggaggaggggggagtggaaaaagaagagagggagaggaaaggaggggagagattcatctcctgatgaaagaatggcttccctcctgccccaccccaccccagccccatcctctctacgcacatccagaactgggccaatttggctcttcccaagtatccctcaggaacatacgaccacctcagaagagaaggagccctaccacatctccgtttttcagccatgtgcaccaagttcttgtttgttgcaaagtgatgtctagaaatgacatcttccaaattaaaagaagtatatgtagggccactctcttatcattaagaacagcatattttatagtcagagccctcctgcacaggaggcatgctaatttcctgaggaagccctatttcccatccccaaccattccaccacgaggtagtcagtgagcggggaggggaggaagccctattcagcagtgtgtggagggctgtgggtggtccctgtgggacctggcagccccctggaagcatccagggtcagtttaccatggcatctggtcaccaggcttcacacttgcaatcagcacctgctctcctccccttaaagacagttggcctttaagtccacctctgcctaaataggcttcccatgctgctgatgtttgctacagggcaggtgctttagctgacccccaaaaagcctcttaattacaaagcctgcatcaagtcacatgtgcctgaatcatccatcaaagtggccaaacgggacaattaatcagacttgaagaatgtaaaacatctccgtacagaatagagggtaagctgcaaacaacctcgccatgtagcagaaccaacaggatatattgataaaatgctcatagaaaacattctaaaagctgccccaggagaaaatggatggggaaaatgctactttcctcagaacctaataattctgaaggaaatggagcataaaacaagcatgcatgaaacatcaaaaaaagaaaagaaaaacctcacaggtcatctagtcacttagcaatactttcaaatattgcatacagacagcaatttctctcttcatttattttcccagattaacaaggatataaaagtataatttaggaaaagtagacaaatagctagagagaaagatgcaatttcagagggatgactctgggcgcgcaggattgaacagctagctgccttgagtagggcaaggccttttggcccaaatttaaagagaggaagttgataaagaaacacaagaatatccaacactgtggtgcagattttttttaatgctagatgaaagtgaacgctgccagaagggaagcaagccacgtaggtgtgttcctgtgaccacgccaccaagatcctctgggtttccattggtgggaacgttttacagcccaacctccaagcctgagttaattctccaaagtactttttaaacgagatgctaagtaacttagtgaataggaacctagagagggaaaaaagccaagagtctgtagttctgaagaggcctcttctgcaggcaggaaacgttttcccaaacgctgttcacagctatttccatccttaggcaaaatcttaatgggcagctccgctcatgttttgggaggagaatctttggagaggtagaaatgggaagggctgtcctccagcccagcagctatttttgtagaaactacagcataggcaacacattcctaaagcagcagcgattgtgaggtcctgggcatggtttcagacccaggcccgcaggagggggagtgtgaagaccagagcagtttctgttttctccagagcccaaggaaagcgaaggtggaagaacccattcccagctccagtagtgcagccagcgctcctggcagaacctgacagcaccaggtgccccatgaggcaggagctccaggtggacagaggttgtcgatcctaattagagcagtcagaaggcacagaacgggagcagggctgaggatggagtatagagaggcaggtgcttcctccaaaacctgaacaaggcggggttttcactgaaataaaagggtgacccatccgcgacctgtgtaccatctaggttggtgttcattcctttccagggatgccatgtaaggcaatatctgaggcccctgatccattagctttgactggggttctagagacaccaagtgggcaacagaagaagcgtggtgggatctatcgggaaaccaatatttgcacctccgtctgtgggattcgtgtgcagtaggtagtgtgcacgtcagcatccaccagcccctgcatgggacccaggaaggcatcactgtgtgtccctcctccagtgctccctgccctcagcagaagtgagtggtaaccaacacagtggccaggaagaaaaaatccccagcccagaaatctccactcgcgtttccaagcacggtttacagtctaaggttcacaaggtctgcctggttagccagaatggcgtccaaaggctctcttatttgaaacctgacaccttcccttctggccagtggaagctacaccagcttcagtgataaatctagaacagaattatcaggattccttttgcttcctaaccattagaatccttccccatagctgagatctttcttattcaaagggcctctctgtgtgctttagtgctcaatttagtcgtcttatattgtattttttaaatatccctttaaacaattcaacactacttacacaactagtaagtcaaaactttgtaaatttaacaaattaatttttgcagacatacgtacactggccacaaatttgtcttaaacatctaatcgaatatagcagatttttttaatttgtcttataaatttcaaaagcagacaaagcacaaattatcacaaaattattcaactcattttttttcttaacctcatttcaaaatactgataccatgagtttacatttatctctttattatctttgtactgacatttatttttacctatactactaaactttcccaagattacagtaatatttatctcagtatttttctgggtgtctaatacattccagaccaaagataaaggctatctcttcagatcatctgaggatgcaggttttgacttaccaaccaattgattctgggcttggtggccagtccacaagttgagctctctttacttaaattttacctattacatgcttaagacaatttatgcctcttccttcacaaagttccctctaccctgctgctttttttctcaagtgatgtgctctttaagttgtgctaagtcagtgtcttgtaactcattgtcccacccttattgtatattgacctggcctacaggcatcattggaaactcatgcctgcccttgccttctcccattggaaactcatgcctgcccttgccttctccacatatcattagaggggtgatttacaggacatgctgaactttgtctgcatggtcaaggttaatccttacaacacttagctagttcatcatcctagaacatagcattgacctgtctttccatttgtatattctgtgccatcactggagctgatttgactgttgcctgatattctgcctaatttgtatatgggaccacttgagctgatcagtccttctgttccatttttcccaagactatctggctcattcacaactctttgtccttactcctacttgcttacaaagatagaaaaaactgcatagttgtctctgatctatccatatggatggaaatacttggaatctccaaataactaagaatgaggctccgtgctcatctaatgcttgggacatgacccaatttccttcccatctttgttatcacctagacatgcctgctaagtaattctgaaagacagaatcacgagagatgaggtcttcaggagctcaaaacagtagtcttcctatttctaggaactgcctggtattgttaatgccattcactccaaccagcagaagaaacttgagcactttcccttaacctaccctctagcattccatcagtgcagtcgtagaggactttggtcttttcagtcagttcttagtggctagggataagagggaagcatgccccagtgtggggtgagacactggagtggttcctgaatgtcagcttgatgtcctgtgaggctgactgactggtttttgacagtgtctgccttgcggctactggtgaagcattgggttgcagagagctgtcacatgacgacctatttccctacaagcctggtgctctgcaggcacaaagagaggggtcagcattctgccagtcccttcccacaggcagacggggttcccttataggactggaaaatgttcaggcaagataaagagcctcagggcttcaagccaagtgcctccttgtttagaaaaggaacatctgagccagaaaaccaatgtgtcctaaccatggtcacaaagccagccagccagcagcagagcccgacagcaccctcccaggcaaactgcttcttattcaagcataaaaaccatcacatgaagcaaactcacccaatgtcaggtgaaagatgctacataataaaccaagaccagaccctctcctgcacacccacatccccaaagcacaaaggatcctctcactaggcagccctcctcttagggcaatttccccacgtcctgttttgcccaagagcctacaaataagggcctttgaatatgtaagagatcactgggggctcctttataatattgagaagataagcaattccataattgtactattattgtaaactttacatagaaatggcattttcatagggcagtgaaagcaagagcttgtttagggtaagggctgccttcctctgtgataggagcctcattaaggagtccaacagcctttagtaaacacataaccatgacaggggatgcctgatgaaaatatagcaggtcaaccaggcgcggtggctcatgcctgtaatcccagcactttcagaggccgaggcaggcagatcaccttaggtcaggagttcgagatcagtcggtccaacatgacgataccctatttctactaaaaatacaaaaaattagccaggtgtggtggtggacgcctgtaatcacagctactcagaggctgaggcaggggaatcgcttgaacccgggaggcagaggttgcagtgagtggatattgcaccattgcactccagcctgagagacagagtgagactccatcaaaaaaaaaaaaaaaaaaaaaaaaaaaaaaaaaaaaaaaaagaaaatatagcaggtcacttgggcccctaacaccccaaagcttgaggccagggcctgcttctggtcttttctccaaatgtagaaaagctcgctgcatacaaccaacttcatccatcagataaacaccaaaatccttccacttctctccactgggatcatttgccacgggtctggatcactggatgtaggatattttcctaaagggaagcatgaggagcctcaagtctccagagagtaaattctagactgacctacactgtgctttttggagagaagacaggaacgtcattcttccaggatgagcaacagcttttctgcctcacacttgacttcagttttgactaaattaaagggcaattcatgtgtaaataagtgcacacttccaaaaaatacctgaggggaaaactgccagtggccctttgtttatttcaagcagcggctgatcagagtacaggcttgctagcaagtatcaggtatcctaacaaaaatgtgcctgaggttttagagtcaataacaaaaacaatgaacaggagactcttacgtaaatactacctgatctcaggatctcagcagagcttctttcctgggggagtggatcttcagcatttgggagaagcagtggtaggagaacaggcaacggagagagaaggccacagttcccttcctactaaaccacagtcatcccctacatctcaaccatgccagaagatggaaagtgagggtcaaacatggaaatatcttcatggaaagggcagatgatgaagagggtaagctgcaatatacaatagaaagcagttgcaatatacactagaggccgggcgcggtggctcacgcctgtaatcccagcactttgggaggccgaggcaggcagatcacgaggtcaggagatcgagaccatcctggctaacacagtgaaaccctgtctctactaaatacaagaaattagccaggcgcagtggtgggcacctgtagtcccagctactcaggaggctgaggcaggagaatggcgtgaacccaggaggcagagcttgcagtgagcagagatcgtgccactgcactccagcctgggagacagagtgagacactgtctcgaaaaaaaaagaaaaaaaaagaaatatacaatagaaagcagaagggaccatggtgcttgcctcatctaaagagggaaactgctgtttccctccatcttattgccatgtgggaatgcagtacctgggatgcctgatttcctcatttttcaaaagaagctaaagttcttcatctagaggtgcagcctcctaatttataaatatggcaactattttaagtgtgtttcaacattgcgcagaccaacaaaacccatctggaagctaggaaccgtagaggggctacccatttgcagcgtctgctatggaaaaagggtttagccaggtcatgccttttatgccacctgaccctaccaccttccttccccttcttgactcaaagcacttccaggaaacatccttcagttcgattttaccatcaccaccctctgtatcaaaatggtgtcaccacatgagtcctgaagaatgctaattatataatagttatgtatccacttgttcagtttggaatattctcatcagcccaacaatcaagtattcaagcatacctagttcatgccagtcccatcaccatttgaacacctggaattgctagatttgataactagcagacccaaatctattaaaaattattctcgatacccacaaacaccactaaaacatgcatttccaaaagacagccgaaggcaagaaacctggtgtaaattactctggtgatgaaaccacatcggaattagtacagtatacatagtccatactcaatgtgaattacaggaatttgcttaaatattgcttaagtttagagtttcctcagaaatggaccctggcactaagaattgagtgcaagtttgtttgagaaatgatcctggtaggcaccaggagagtgaagaagcgagacagggaagaaaaagaagccagcgcaggccaccactgtgggtaactggggttcagtcctggggaccctggggagcccttgtgaaacatgccttagagatgtcatatctcaagggggaagaaactggggtattgatctatcaactcccacctgttatttgttgagagctgttcctgtaggcattaactctcagcactccgacttaactgtgtattggacaagcttactcccacagtcacagaaagccctcaagcaaagagttataggtgtttacaggaagaaatctttgaggaaaattaatactggtgtcttagttcattcaggctgccataaaaaagtactttagatcgtgtaactcataaacaacagaaattcattgctcacagttctagaggccagggagtcggagatcaaggtgacaagaggttcagtgtctagggagcgctcactctctgctttacagatggtcctcccgactctgtccttatatggcagaaagggcaaacaagctccctcaggcctcttttatgaaggcacttgtcccattcatgagggtgctgccctcatgacctgatgatgtcccaaagcctccacctattaatatgattgcattaggaattaggttttaacatataaatctgggaggacacaaacattcataccaaagcaccctgcagtgtccttgtgcactcgcatctctagcatcacactaaagcattcatgaacaggacactggcaaaagagaaaccaagacagttcacaaaaattacccacacatctaaggaaactgtatgggcagtcttcttgtctacataaaaaacttctgtcataaaaaaactgccttgctataaagtatctgaaaataatggataaaatatgacagaaatcttttaaatatatagctgagcttgcaataaaaaaaatagcaacaacaacaaaatgatgaggtctccagaagccaaaacaaagccaaagccaaaaacaaaaacagaaacagaaaaaaaaacaaacaaaaaaaaacaaaacacacacacacacacacacacagagtggaaaaccaacagtgaagttgtgtctacccacagaaaacgtgtcaatgtccattaaccagaacttaggctttaatggctgtgcatgagtttggtaaggaagcccttccccatgtgagatggaaagttgatccctccatgaagctacaaccttctaagagttacagtcacagtaaaaaaataatagtaataaattaagaaataataaaagaaacagaaaaaagcaggtgaggaagaaaaacactattaggcaaaacagaaaacaaaaaaaacttatctaactctgcctaatctcttgggaaactaagtcttccatgcaaatatgtcatctaagtatactatcatctaggtttgggccccaaatgtatatactaccttcatagttcaaaaaaatcttaagcctagaaattaaatgtagagtggttcttgattgggaacatctgaggcatataggcagaaggaaatattaattatctctatggggtcatataccctcaattcacatttcactgggtctctaaatttttaaccataagctcacagtccaaaattcaaaaagacaaggaaataaaccaccatgaggaagagtcagcaaaattctacccaaactgtagaattctacatccaaagatattagattttagaaataaaagatacagtatataaaatgtatagcttctttaattaaaaaaactcaaaacatgagaaaaaaatagtatcaaaataatcagggaggtttgaaaataaaataagaccctttaaaatgcaacatttaattgttgaaatgaaaaaataatggttatgttaaaacattgtttttaaaatagctgaagggagaactgatggactggatgaaaggtctagagctatgactcaaaatctaccacagagaaataaaacgaaaaatatggagctacagctatagaagaaaataggggaaaaggcaatttctgaagaaaaatgctgaaaattttccagaactgcaaaagacatgcatttcagcttcaataaatgcaataactcttcaatgtttattagccagagatatcagtgcattacattgggggtctctccaccaggctacccacaacatagcaacgtgcttcccacagtttcccagagattcgtaaaagaaatttcacaattagaccaaccaggataaaaccacaaaccaccaaaggaaaaaaaaaaatggtaaaagttgcaagagaaattacctaaaagaagttatagactgacagctggctccagcaatactctcatagaaaagagaaaataacaatcaacgtagaacctagaattctatatacagtatagctacaattctacatacagtatagttaagtcattcaatagtaagtaaaagactttggagaaaaaaaaatctagagtgtttgccaccgagactctcactaaaagaactttaaagggtacttgaaatgaccccagaagtcagttttgagatataaaatggaatgacaagcaaagtagcaactttatcaatgaatgtaatgatgataatgatgaatttggaacaagaatgtgttagatttctatttctgcataacaaataccctaaaatttggcagttaaaaacaataagcattatcacctcacctcacagtttttttcctctggggcaggaatttgggtgtggtttagttgggggtctctgggaaaaggtgatgaagtagtcaattctaggcttggctgggggagcagctgcttccaaactcatgtgagtacatcgcaatgaacagacctccaaagatccgctttcatgcccactcacagggctgttactggagttcaagtcttcaatagctattagccagagatcagtgccttgccatggggggtctccccacaacgctaccccataacatggcaacgtgcttcccacggagtgggagaaagcgcatgacagctgtcatagtctcatgacattgcagcctcatctcagaagcaacattccaatgttttcgctatgttctactgtgtctggaattgatgggttcttcatctcacggacttaaagaatgaagccgcggaacctcgcggtgagtgttacagttcttaaaaggcagtgtgtccagaacttattctttctgatgctgggatgtgttcagtttcttccttttggtggggttcgtggtctcgctggctgactttcccggtgaatgttacagctcttaagggggcatctggagctcttcgtttctcgcggtgggttcttagtctcgctggcttcaggaatgaagctgcagaccttcacagtatgggttataactcataaaagaagcgtggacccaaagagcgaccaccagcaaaatttactgcgaaaagcaaaagaacaaaacttccacagcacgtaatactactcaagcaggttactgctgctagcgcgggcagcctgcttttattctcatctggccccacccacatcctgctgattggtccattttacagagaaggccgagtggtccattttgacagggcactgattggtgcgtttacaatccctgagctagacacaaaggctctccacctccccactagattagctagatacagagtgtggacgcaaaggttctccaaggccccaccagagtagctaaacacagagtgtcgattggtgcattcacaaaccctgagctagacacagggtgctgattggtgtatttacaatcccttaggtagacataaaggttctccaagtcccccccagactcaggatcccagctggcttcacccactggatcctgcacctgggcggcaggtggagctgcctgccagtcccacaccgcgcacccgcactcctcagcccttgggtggtcgatgggaccggggcgccgtgtagcagggggcggcgctcgtcggggaggcttgggcggcacaggagcccacggagcggggggaggctcaggcatggcgggctgcaggtccctagccctgccacgcggggaggaagctaaggcccggcgagaaattgagcacagcagctactggcccaggtgctaagcccctcactacccggggcttgcgggcggacctgcagcacttgcggggcccgctgagcccacgcccacccggaactcgcgctggcccgcaagcgccgcgcgcagcccgggttcccgcttacgcctctccctccacaccaccccgcaagctgagggagcgggctccggccttggccagcccagaaaggggctcccacagtgcaacggcaggctgaagggcacctcaagcgtggacagagtgggcaccgaggccgaggaggcgctgagagcgagtgagggctgtgagggctgccagcatgctgtcacctctcactaccgcttagaagcaagtcactgggctactccagaggaggggattgcacgggacgtgaacactaggagggggtccctggggccatgttggaggctgcctagtgcaaaacggcagataacaatagcacacagaggaggggctggtgagtgaacattaaagcattctcatgtccttgacctggtctttttcagggaggagagtaaagacaatgtttatttatgcaagacgaaaaagttctagaaatctgtggcccaacaatgtgaatatactgaagacttccaaactgtactcttgaaaatggttaagatgggaaattcactgtcatgtgttttttgccacaataaaaacaaatatatacatacttatataccaaggttttaaaaataggaaaaagagaagtttatttttaagatttattaagatattcgtgttaaattttcaaaggtaagtactacctgactagaaataaagtatatgatttccaaactataaacaaaacaataaaaacaaaagaaaaaattaaaatattccaattaaatccaaaagaatgctggaaagaagggaggaaaggcataaagaaagaaaacccaaaataggataaaataattattaaaatatcagaggcttggctgggcacggtggctcatgcctgtaatcccagcactttgggaggctgaggcaggtagatcacctgaggtcagttgttcaagatcagcctggccaacatggcgaaaccccgtctctacaaaaaatacaaaaattagctgggcgtagtggcgggtgcctgtaatcccagctactcgggaggttgaggcaggagaatcgcttgaacccgggaggcaaaggttgcggtaagctgagatagtgccactgcactccagctgacagaataagactccatctcaaaaaataaaaataaaaataaaaaaataaatcagaagccctaatagatataaatggactatattaacctgatcttacaaaacaaaaaaatgacaaattgcattttaaaagttagctgtctgctctttaaagaaatacacctaaaatatagatctacagtgaacaatacatttaatggtgaaacattggaaacgttccctttaaaatcaagagtgagacaaatttgcccgtcactgccacttgtattcagcattgtactgaaggacctcaccagtgtagtaagacaagaaaaagaaaatgttaaaggatttgaaaggagcaaacaaaaatactattatgtgcatataatatgactttgtctacgcagaaaaacctaatctacaaattactggaactaatgaaagttgaattagcaatttatttggggactaatttattacattatttcaagagatagctagcatgcatcgcgttacttaattcattttcatggaggtagagtacatcattatacgtatcgactacaattgtgtccctcctccttttgataaaaatttaggttgtttccacttttttgcaattacaaactgttgtgaatatccgttatttatgtctcctgtgtcagaaaatgtttaccggcccagtcctttttttctttctccagttttcagcagcttaagcctgggcaaaagtatttagactaattgctctagttgtatcagttttgtccagtaatgtttccatgcacactaacagtttttaaatgttctgaagacacatgaacagatggcaaaaaaaggctgaacaatatccaaacggttacagcaatggtgttacagagaagggcatagcgttgagccaggccttctttaaactttgctgtgaagcagaagaaactcacacgtggtgtttaacttgtgtgcaggtctgcgggggaaggacggctgtgattgttcaacgggtgaactcttctcctttattcatccgaaatccaatttcctgtcttatttttcatggcagcttgctatctttcaatataattctttttatatctttagcaaaagtattttttattcccctaatcaggaagggaatgctagggtgtgttgattctggaggcagagaaatgagtcctttccttggttaggaatgtattttgctggcagagagaccaagccaaccgcagctctgcttttcccctccagcatccacctgtaagagcttgtaatcttttattgttcatggccccgggatcctattcccggatggtctatgtgaaatgaagagaaagtacaagcaagttcagatttcccatagaaacacctccctccttcctgtccaggagagctctattgcagagttggagcatccagcagacccaccctggcttcatctcattgacataagagatgcagaaagaaatggcgaattggctttgggaatgaagaatttgacttccctggttccagttcaagacatacgggtgggaactcccactgggtatccactctgctttcttgggaaagcttcacggtatctttaggaaggaagcctgggattccacaccctggagatactggatctcttattctctatgcacttccttacacactttctcttccttcaagggcctctcagttgaggcactactccaccttaaatccaggtggccacattcagaagcactgtcacgctggcctctcagcaacatgctaacacagaaaaggaggctgtttatgagtcagctctgccaacaggattgcttcctaggaaaagtgcaaattgatttttttcctcctgttggtctgctgggggattggaggcagccacggacaattcattagcacatgtaggaaggccagggagaaaaataagctaagttgctctcatactagaaagcatttaggaagcaaacccataaacatggataattattgtgtgtccattaaaatttaaaaaaaaaaaaagaattcgtgcttgttctgtaggcctctgtgtatggccaagattggctacagggccctgaacattgcaagaaacgtttgcactggcaaggaagggtgctggcctctatttttgtagaaacagggtctatgttgctcaggctggtcgtgaactcctgggctccagcgatcctcctgcccaggcctcccaaagtgttggaattacacacatgagccaccacgcccagccaggatctgtatggtggtgcttatacgcagtaaccctgcatagaactacaagagcgaacacgtgcgtgcgtgtgaaaaccgctaaaacctgagtacagtctgtagagtacaccagtgtcaatgactaggttttgatacgtggttctgtaagatgttaccatgaagggaagtgggtgaaagtacacagggcacctctgtactctttgtgtagcttcctatgtctatcattatttcaagataaaaagattttattttaaaaaaatggcctgaagctcttgagcctgaggctacgcatctccctctgcctttatgacccacagtgcaggccctgagcccccagagtctgggctccactgccctggcctctggggcatctgagaagcctggtacaggaaggaagcatgaagcttaaaatagtgctcagttcctccttttacaagtgaagaaacggaagcttaggggggggcaaggtgagtgctagctgatgccctgatttactgcctgagttacatggaagcttctgtccctaggaacataccaagacagtctgccctaaaatggtcaagctagaaggccaaagcgagggagggctggggttttgttttgtggggtgtgtgtgtgcattctcatgtgtgtatttaagggctgcaaaggacatactggttttgatgtcacactatgagcacaaatggtgtagaaattctattccacaacatgagcgatgttcagcaaagtcagtaagaaggtgagcatgtctgagcttacctgcaagatgaaggcctgtgatgacggtggaaactctttctgaccccagcagccacagaaatttgtattttgccaaggaaggctccttctttgaaaatatataggaagaagacagaagtctacctttctgataccactttaagcaatagaggaaaagaaaattatcttgtttttccactgtccttccaggggtgattctaggaccgttaagatctggccgtgtctgagcaaacaccagccacctccgacctccagcctttcaaagaaacaagctggactgtttgcatttatatgattcaaaatgaaggtcacaaaagcacaactgacttgattttatgaagagcttttgttgacaaacgtgaagttcccagaatacacagtctttgggacttgagtttttttgtatatattattctctgtgcctgagttggtagaaaagagcctacataacataggctcctactccagcccagtacaaggttttcaacctgcacactttccataaaccctctctgcctcagttttcccaattctaaaacacggatgatagcatctctcttaaggcttttgtgaggatttcagctaatacatacgtagggctcagaacaggacctgctgtggaaagagctatagaagtgatcactgttattacactcatctgtaattactgcaagtatttggaaatatataggaatatacttaagatgaatggacacaaaaccgcctccacagcttccaaggcaaagcgctgctacctgtccaccgtgtggcagttcctgtcacccacactggtgcctccctgttctctcaccgcaccttgtggctacgctgcgcgccggtcgtgtttgtcccccctttctcctgaaagtcaggggctatgcttaagactaaatcacctttgtatcccacatctagcacagtgcctatcaaacagtacgggctcaaaaagctttaacaatcggaccgataaaatagcagggcttttgtctctcctgtcaatctagcatctctccttccattttttctgcacctaccaaaaataagaaaaaaatcagactgctgctgtgttctgccagctgctcttaacttccagcacgtgtcccaagcaatctacttgaaaggatatctacccccttaactgagtactgaacactatgaaaataatctttgtggtctcttgtattaggagagagcaaattgaagatgttaaaaagccaatgtattagcaagatttgagaagatccaaaagcaagctgattatttccaaaaatcagctcaacaactcctaagattgatagatgtgtccacaatttgggggttcttggtctcactgacttcaagaacgaagccacagaccctcacagttaagttcttcaagagggcgtgtccagagtttattccttctgatgttcagatgtgttctgagtttctttctcgtgggttagtggccttgctaacttcaggcgtgaaactgcagaccctcgcagtaagcattacacttcttaaggtgatacatttggagtgttaatcatttattttcccccagtgggtacctagtctcactggcctcataaaagaaaccgcaaaccttcatggggagtgttacacttcataaaagcaatgcagacccaaagtgtaaacaacaaaaacacttactgcaaaaagcaaaagaacaaaccaaccacacaaaagcaacgaaacaaccagttgtcactagtggagcctgcagcctgactttattctcttatctggcccctcccacatcctgctgattggtccattttacagagagccaattggtctgtcttacagagagctgattggtccgttttgacagggtgctgattggtcgcgtttacaatccctgagctagatgcaaaagttctccagttccccactagattagctagatacagagtgttgattggtgtatttacaaaccctgagctagacacagagtgctgattggtgtgtttacaaaccttgagctagatacagagtgctgattggtgtatttacattcccttagctagacataaaggttctccaagtcctcaccagcttaactagatacagagtgccaattggtgcattcacaaactctgagctagacacagggtgctgattggtgtgttaacaatccttgagctagatacagagtgctgattggtgtatttacaatcccttggctagacataaagcttctccaagtccccaccagagtagccagatacagagtgtggattggtgcattcacaaaccctgagctagacacagggggctgattggtgtgtttacaatcccttagctagacataaagattctccaagttcccaccagactcaggagcccagctggcttcacccagtggatccggcactagggccgcaggtggagctgcctgccaatcccgcgccgtgcgcccgcactcctcagcccttgtgcagtctaggggacggagcgctatggagcagggtggcgctgctcgtcggggaggcttggcctgctcataagctcacagcgggggagtggggagcgggaggagacttcaggcatggtgggctgcaggtcctgagccctgccgcgccgggaggcagccaaggcccggtgagaaatcgagcacagcagctgctggcccaggtgctaagctcctcactgcccggggcttgctgtcaggccggccgctccgagtgcggggcccgccgatcccacgcccaccgggaactcgctctggcccgcaagcgccgcgcgccgcccgggttcccgcctgcgcttcccccttcatatctccccgcaagctgagggagccggctccggccttggccagcccagaaaggggttcccacagtgcagcggcgggctgaagggctcctcaagcgcggccagagtgggcgccaaggccgaggaggccccaagagcgagcgagggctgccagcatgctgtcacctctcaatagggccccttactttccctgcctgatggtttatccgccttccttcagtcactcctcgaacacttaaccagctcccacagtgcagtgtaaagagcgaagcaaggtgttgctagagtggggaattcagaaatcgtgaagggacgtttttagctcattctcaaattctgatggagatatttttcatacagtttattccttagaaccttctacttacattccctaaaagaataagttgttatttacagcctgtattggttcccgtgttcaggaacacaggcagcctttccagaagaaaatcagtgtttaggaaacaaaatggatgagttgactttccatctccaaaagtcacggtggcttatggagaggcacgaagcacacacaacgcaacacaatccgtccaagttcacagccgcagaagaaccacacccaaaattgctgagagtgtgaaccttgactgccttacaaacacagaccgcaaagggaggtaaagcttattcggctacaaaagatgttgcttgtctcttaagtagttccttcattgacgccaaatgtcttttatttataatcacgtctctttttttttttttttatttgagtgtatgcttgcattcccaccttcaaatcattgctctccgcccgagcacagagctcccgcgagcctgcaggcagcccaggactcctgcgcataccaggctctctggtcttggctctcccagccccacgccgcccactcacatctgcccagctctgctgttcttccacgttcttctccacattgggagttttttgcaggcgtgtcctgtctcatgctccccatcctccgctagctctccttgctcatctcttcagctttgttctctttgtccctgaactctcatctcaaatcttttcatgcctaagatcgtgcttggcagagagtcgatgctcaggaaatgaaacagaaaaaaaaaatgcttttaggggctgttgcaagaatcctacctaagcagggccgtgcctttcttgaaagaattcttgagagtcgcttgggtaactgccaaggttccaactcctcaggactgaggcaggggaaacatggtgtcctgtagagacaggagccagagacatgaaaaaagagggagaggccgggagcatctcaccggctcataaagggctaagcggaggcggctgcctcttaacgcttcataaattctgtacaccttgtgaaatggtttgtaaggagatttcttaggacatctatgaaggggttaaactttgagccgagtgatacacggtagacgtaggatctcacgtttaagatcatatatcaggaaatgagcaaaaaaaacttggtgtggcttttaacattgggtttcaaactaggcaaggcaagagaatcacctggggagcatttgaaaaccaggcagcacccagacttattaaatcagactgtctggggtggaactcaggcatgggtattttcacagcactctcctattgatttcaacgtgcagccacattaagaaccatcagcaaagagcatcccaaccatgaggttatgttccaccaatcctgtttaatctcaagggctgggaggccccaactgacatctaggtttcatctcagaaatatctatttaacttaaagcttggctgaaggcaggctgcggtggctcacgcctgtaatcccagcactttgggaggccgaaacgggtggatcacttgaggtcaggagttcaagaccagcctggccaacatggtgaaaccccatctctactaaaaatacaaaaattagcccatggtggtggcacacacctgtaatgccagctactggagaggctgaggcatgagaatcccttgagcctgggaggtggaggttgcagtgagccaagattgtgccattgcactccagcctgggtgacagtgagatgttgtctcaaaaaaaaaaaaaaaaaaaagctgggcacaggcacagtggaccacatctgtagtcctagcagtttgggaggctgaggtaggaggatcgcttgaatccaggagtttgataccagcctgggcagcagaaccagaccctatctcaaaaaataataatacaaaaaagatgtatgaacttaactaaattattttaaacctagggtgttcttacattaaaaagaaaaatgttaaaaagaagttggtttcattttctgcaactgtaatgagaatagtcaatattgtaatatcttctttctaatagactccatcctccttttgcccaattattaactatctattatgtgcctagcactggccaagatgctttatatgcattatttttcttaattcctaataaaacacttcagtgcattttcctctatcccagtttcctttgggttgagaaaagcagcaccttcgcagagtgacagtgacctgcacaatctcagtgaagaattttatcaaaattgggaagcttgttgggtcttgtccctctctgtaagcaacttgaatcctaggaggaccaggttccggcacacatatctggactcgtttcgcctccatctaaagctctgcttctgtcttctgtctgcctcgctcatgtactgcagggtgagacccgcacagcaaccagggtgcagtgctgagggccctggaggctgagtctggagatgtgaggaagtcacttccctgcctgaaatctcagtctcttccttagcaaacagggatgttactaacaccccatgccctggccactctcaagactaatgagagaatcaacaattcaaattgcatttgaggacctcctggtacgtttggttcaaatccagcaccatcaatgagcagaccaggctggcctcagctgttacctcccagccagtttgtcagttcctgctcacccatccatcatattccacaacatcagatgccaaggacaacaaacaccttagctttttcttttaaatcatatctagttcatgacttctagaagcagaagggaattccttttcagcatttgcggcatgtcaagaaaagtcccagagatcatctttgcagctgtgcagtcacgtaaaccaccctgtgcatctggccctgtttctgtcccctgtcaagagacagacaaatgcgtaagaaccgcagacatgaaatacaacaggtgtatcctggttgtgtgagtgtcaccagtgtcatggttcccgctgtccctaagccaggctctcccttagaaggagtggtgaaatccacattggcagcggagaagcatgtgctaacgtccaatcttccattgtaaaaagagagcagactagcatttatccacttttctatcccacatggactgactccaaattagtaacagaaagttgaacaattaccaacaccaagccaaagaggcaagttcccctgatgcttctagacttgaggaagccctagtaatctggtcgctacttaaccaatagtagggctctgggtgaactggcctggtcaaaatgctccttttccacctcagttccaccacggctagcacagtgtccagcgcatattagacagttaagaaacatattgtaagaaagaagagtgacactgttattaagatggtgtttaaaatgaagaggggcaggcaaggtagtataaagtgaatccgtgggaaacatgccttgtctacagaagactataaaatgttgatgataatgagactataatgtgttgactataaatgagagatttagagtatatataaagtttgcatgcatcttttgttgagtttattattcagtagtgtgttatcataatcagatgatgaagtattatacatacgatgataccagaagcatttctgatttgtctatccccaagacctaatccccttcctatcacagggtaatgaatgatgagccaagttgctcttcctattgcatcctccagccactaagatgcactgtctctcacccataagacaggttccagtttcctctcaccttcatgttaggatcctatgctatgtggcgccatggcaccctcttggtaacacacaataaaatcttgcacttagtgcatttggtttttttgttttgttttgttttttgtttgtttgtttgttttcttgagacagtgtctcactctgtcgctcaggttggagtgcagtggcgcgatctcggcacactgcaacctccgcctcccaggttcaagcggttctcctgcctcagccttctgaatagctgggactacaggcacatgccaccacacccgactaatttttgtgtttttaatagagatggggtttcaccatgttggccaggctggtcttgaactcctcacctcaggtgatccatctgcctcggcctcccaaagtgctgggattacaggcctgagccaccgcgcctggctagcgcattgttgatctactcctaagatgcaaagatcagacaaaactgcctcaattaggtcattattttcctcaagacatttggcaagatattttgggcagaagagtgtcttcattgccactcatctgttatggtctctcatgtttatatcatgatagaaaagccatctcctcctatgctgatagaagccaaacttaggttattctgagaaagtggaacttagaggccagaggggccatgcaagattcctactccttttctgtcaataaaaaggcttattatgaattcaatttttttttttttgcaattaaaagcagacaagctagggatccagaattttgagtttagcagcccaaacataccttctcactcaaaaacatattcaccaaggttgccaggcagccagcaggatgttgcagattttaccatctcatatcacaaatagtcgatattccattatgatggtgttcattttatttttgttgcatttgatagcaagaaacatgtttaagtattttgaacacaccgtttacatatctgagatgaaaccggaagccagttcatacgtatgacttgaatgtgtgagtcaattcccgaggaaatgctggcataagagagtcaaatgggagtggaactactattatttgaaataatgacccattggggagccttgctgtgctacagtaataagatttgacaggtagaaaaaagaagagatcaggacataatagaaaaccacagctagaatacatttaccacattgtaaattatttctttttccacaaaggtggggagggagtatgaggggaggaggaggagggaacacagtggcattaaggacagaaaagaagaaagttaattttgcattgtgctggtaatggatttccagcaatgcgattttactgaagccttatgcatcatcctcctgtaaaggtctacggtgacccttgaacgtcatcctatgaattcgccaagaaaattaagacactccagtaaaagtacagccatgaaagaagacagacttctagatccatgcccaactagatctgtttgataaatagaacacaagctggcagaattggccatcagccaacctaaaagaagaaatcaaaagcaaggtctgtttgttattttgttacatttgggaaagaattctgaaagatgcagaggaatatctgctactatttggcccgggactagcagttcaaccacactcagacactctgtctccagtgccaagtggttctgtttctctagagaaccctaacacacccccccattattaaacaaccatccagtactgttttattgagcagtcagaagcagaccagctttattcacattctgttaacccaatttttccttccctccataaactgtttgctagaggcagtcttgccagtgcagctaagctgcctgtggctggtaaggtctcctgggccctctacgccctttctcctccgcaggtcgtgcctctattggaagcatgcttgtaatacctaacatcctcctggggccagcctgtgttctgccaaaagcacatgcaggaagcaataccagctcttagagtaatgtgggccacagggaatgagccatgaatgttaagatgtgtttgaagaaaagtcagtgttcttaatctcaggatggtagccagatctaagtactggtatgagaagaaaaagagaaacagagagagagaaagggagggagacagggagagagggaaagaatgagagacaggaagagagaagaggagagctaggagaaagggagggggagaaagactacctttacaaagcaggaaggacattgcaatcttggggttgcacttggccatgagtatgtggaaggctggtggaagtgagattggaggggggtcagctccttttcacagcgactctgctgtaagaattctaccttcccctgagaggaggaagaccaatttctaaccattttaaacccaagcaatagaaatgtaaaaaacaggcacatacatgcgcttgtacacacacacacacgaatgattgttaaactggtgacatctgaataaactttgtggattgtatcagtgtcaatgtcccagttttggtattgtcctccatgtaagatcttaccatgggggatgatggggaaagacatatgagacctctctgtatctttttgcaacttcctgtgaaaatataattatttcaaaatataaagctaaagaaaaacctcaagtagagctagaatatggaaaatgggactagctgtgtaagagttgggccctcctctatgcctcaaactaaccagccagcaacgcagaggccacagggggcggagctacatccatggcctccaggacttagggacatacatccaagctttccggctgcctgaagtcaaatcaaggattggtccagtggagtgtacccgggcccccaccatcctctgctgaggaatttcacttccagagtctgtgtcattggattttgtcttcttcctactgattccagttgaaagcccactgctagctgttaatagaagccattctgacaaggttgtcctcccctcgacagctgcccaggtctagcccagcctaggccactaatggagggtggaaggcacaacaatacctttggagctgatatttgttcaaacgctgctcactctaaacctggcttgtttatccaactctattttactccatgaatgtccaagaaaacttttctagaagagatttgattgttgctgccctttgtatgcaaaacagatgctgctggctgctctcctagagctcttcctcacttctggcagggttcacatgctgctggtttggagaagcctgccttcgagggcccacatgcccgggggagaggggagcaggggcagtttggggtgtgctggattcacccactataatgctgtcctcccttgggtggaagccatagaagtcaacaggacagacagcaagggagtgccacatagaggccaaggaagaaatattgaaaatgaacagtcttctatttcgtgatgaagttttgacttctttcctcaggtcatttgctgaaatacagtgaagtatctggaggaaacacttatctctgcccttgaattcccagaacgccaactctgattaactttccgatgttattgcttcagaaagtccaaagtcagatgatccgtcttacatgtattaaaagttactgaggcaagggtccaagggaaagtctctccgctctcagcctgtccgtcactgttcatactgtagaaggagaactactttaaaatgcaacctaccatcttttatattggtaggtgattctgaggcatttgcaggataggtaaagcctggaaattgatacagtgattatttaaagcagtgatcgccaccaggggtgagtttatccctcatggatactttggtaaggtctagagatatttttggtttcacaactagagggtatggggatgctactggcatctggtgggtagagaccagggatgcttctagacatcctatgatgtgcagaacagcacccaccacaaaggatatccaaaacaaaatgtcaatagtgatgacattgaggaatcctgctttaaggttctcggcaaatttactacaaataaccactactattcatccagcaaacaatcactggagatttagtatgatattaagacattatgtatagccctggcactggggagttagctttgcagtatctagtggaggaatgacagaggtatacaaacaaatataatgtaatataaaacatgcaaagtgcctgagtggaaatgcaaataaatacagagaaggatatgagtttgagagggtggggttgggggaggaggaagaaccaatgtcactttccccaagaggaccacaaactgcatgtttacactcaaagatatcactcttgcatataaatttgaaataactgctaggaaagctcaccaaacccttaagcgctttttaagcaatctgtctttctgcttttatatacatatcctcagagagatgcagcctacagctttctttgtgactttgttctttattgagattattttcctaacaacaatgtgtttctagtaccaagaaaatgctttatttccttctcccgcccttagttgattctttctatctatacctttaaaatattgataaacatacagtgtaattctatagctgctaatcaacaacacaatacgtacttagcctcttttattttgcctggatagcaacttaaatttatccacaattttgaggattcaccttcctaagcatctgttcattggcttctgtctttttcaatactgagtgccaaggatgtagcaggaactatcgtctccaaccccctgctcctattttccaggctgaaagaaaccctgggacagcacagagatacttaggaaggagtccaatgagcataagacaaaagggctctttcccacccttaggaaaattagtgactggaccaaaggggttttgatcaaacaaaagtgtacttacgttagatttgcaaggctgaaattgcctagtgatcatttccattgcagatatcatagacaatgatgcatcttccaggtcagcaatgtggatgataaaactgtctggaacactacattggcaaatgtgagctcatagctaagctgaaatggaaatcagttatgaaacagaactaccagatgccatatgcctgcacacaaaatattctgggcaatcttacaaatcaaataagtaacatatgtagttgaggttctactttgtgagtttcactgcacaatacccgggagcaatttgtttgtttgtttggttttaactctggctttgaatcttgactctgacactttctagtgtggggatctagataagttaatacaacatctccgagtctatattttcgtaacagtaaaatgaggtaaatcatacctatctcttcagattattgtttattctgcaggtctgggtgctgtcaggaaaacgaagaccatatcagttattttaacagagagaatttgatataggaagttggttagagaaccagttgctggagaaccaaaagagcaaagaaaggacccctgaaggctgggagagcaaaaggcagaggttgtggggattagaaactggatgcttgacagaaggaccctgtggagctgagacacaggctgctaaggaaagggtgacagcttctgatgtgctgttactgcagtagcttagggccccgcagagctgagtctcagctgaagctgggaaggtgcaagagagctggaaactggaaccaactgccactgccaacatgatgggccatcaccagtgacactcccagcaagtactcacgaaggagcaagtcccttcttcgactccagcctccatctctctgctaccttgactggcagacagtgaaggagaaacatgattaccgagagcccagtgaaaaagcagaggaaagagggctggatttggagctgagaaacagccccaatatatggcccatccattcactcaacatgtacatttatggagtgcttactgtggatcagactgtgaggctgtgaggctctctgctaggtgttggggaacctagagaattaaatggaaaacactcctaaagtacaaggctcagctattagtacaaggtaaaccctctgttaaaaatagctctcctatctccagtccagtgggaaacataaaggaaaaggaaatggaaagcaaaacaaacaaaacaaaacaagaaaccagctctggcctttaagaaatctcatgtttagattcagtgttgcaggataagccacgtagcaaagtgcagagtgatacatgtttgtacactttaccaagaatgccagacatcgctgttttaagagttcaaggaagcaagagaatatatgggggcagggaagccttcacaaagaagatgggaatgagcaagacctgaggatttagataatggccaaaaagactaagaccattgcaaatgggagaaagcacacaagcaaatcaaacatggtgggaatgtgctggtgtgtatgttgccactctggcctcaaggaatgaaggatggatttgtgatgtggaggatggaagttggagccagtcgctcatttctggactgtattctgaggcatagataagccattggagctttgtgaatgagcagaagttgtatgcagaaaatattatctttatagcccctatcatatctaacacaataccttgtacatagtggaatatttggaggaggaagcattacattaaatgggatgggatgggatgggatgggatgggatgggttgggatgggatgggataaaatggaattagaaaggcaggtcttaactttgaaaatctttttagaaaatattttgagcctaagtattaatgtctactcaagctctcctaacttttgtatctccctctgttttgataataataatagatactttattaaatccgctatgcaatccatgagcaattttaaggccaaacgttcaggaactaaaaaaattcaggcaatgataaacattttctatgataaaaacattaacaagtaaagatataacccaactagcaagaccctgtttattccatggatggaggccccctgttgtcagagtgaacatgatgttggctttgaagacacgggggggagctgatgaaaatatcatgggcttattttaaaaagtgttgggcaatatgcttttgaataaatgtagcaattcatgtgaaaacaatattgttgcaaattttgaatatgtttgcaaaatatacgatgtactcgcaactaatctattgttttcttcttcgtagatccattacaagattttggcttttctgttgaaaagtgttccaagcaattaaaatcaaatatcaacattagatttggaattattctgagtaagtaaaaaaaatgattagcatgaaataaaacattgcacagcctcttccaactccacacacccaatgacttatgttaactgtaatgactggctaaactactgttccctcaccactctctggaattaactctatttatatcttcattttcaaatctttctctgggttatattcaggtagggtagaactctcacttaaagctgtacttttgtattaaaaagactctaggcactcatttggatgatataagcacctggaatcagtatacccagcaaaaaaaaaggaaaatattttgagattaagtattaatgtctactcaggatctcctaacttttttagttatctcagcaacaaataaatctactaccagcggtacggtttgtcatttgtgttattttgtatcccaaatagttaatacaaattcttaaactttgacatcggcaaggaggagatgtaatattttctctcctaccccaatcagtaagctagagcactttctgattgtttaattttcatatgatcatgcaattatagttggtcaatatattttctatagctactagacgacctccttttccaaagcagttatatcaaaatcaaagtagagaggtttaataaacttagcatgtggaatcattccagagaaatggagggaacattcatagaaatcaagaactctcacgcatctttgtatttctagaatcttacacagtatctggactctagcagcagctggagaaatgttatggggagagaaaaagcgagaaaagagaaatagaagagtgggtggaacataaaagggaggaatggagaaaaagagagaattggaagccaccaccatggaacccgctgcagcttcctgtgcacctgtgctgcaatacctccctggcaacagcagcaggtgtatgtaggcgtgaccacaccccaccgccatcatggggaacaaatgatactatgcaactgagaaattccagaagccagacctgcagacatcacattaaaaggccatagcatcagggtggggagctcagctgattaactaccttgttccaagcaggtattttgagaaacagccacctttcatacgcagggccccatcataatcccctgtagcattgcctaaatgctgttttaccaaggaaagaagaaaactgttccccacacagagaagattaatggaaacaaaaggttctttagctcatgctgctgtatactgtgaatgcctctgatacacagtgaaacacgcagtaagagtaaagctgttcttctctttcctccaggagaggacatcaaagagctttttcttgacctagctctcatgtctcaaggctcatctgttttgaatttctcctatcccatctgtgaggcggctctgcccaagttttctttctgtggaagaaggaaaggaggtaagccatctgtcttgctcactgctggcaggggcctgcagagagataaactcgaacttgcatctgaggccaggacgcccagaccagagctctgtctctgcccctcgcctttggacgagcttatcctcacttatcagcatgtgttgcagaaaaataacaataaggcccattccataggcctaccttacagggctgttgtgaatatcaaaatgaaatgacacgtatgagatgctttaaaacagaacattgttactgtgagtagcagcatcttataaaaaagggctggcagcagaaagagccaagaggttccaaaaatccattgaggttcagagtgctcccaggttttccctccacaacttccttagtggcaggatgtccttaatatagtaatggacttcaaaaacgaaaaaaaaaaatgaagcttatgatatgtcaccacctttcccacgtgggtcattgactagcagggcatccgggagttacactcgaagtagagaaacggaaaccccattatattagctaccttttcggcagtgcaccaaccctctaccgcctgccatacagccttgaagaaagggcaggtcaccttcccccacctgtccccacctctcctttcctccttgtctttacccacagcttcaccaaggccctgagatgcttccgcggtgtggttaaaacctggctctattctctgactgtccttccccaggagtggttctctcccagctgctctcccctcccagggtctccttcctactcccactggccaaggcagggcatacccccaatacacccctcaccccacatctcagaaatactcctttatctattttctcattcaagagagctagaattttaaacagtaaattccttgtgaaatgctgcaattactccttttaaatgaaagatctagaagaaattggaatctcctttctacagtgagggatgcagacaaaagaaaacaaggaacttaagggaggattggccagatggaagtcgggggaactttgctgggatctgtagagggcagaaccagcctggctgcctcaccaccctcgccatccctcccgagtgtgtggcacatcactgtatcctagcgtttgccatgttggactgtcctggtttactgccgtgtatcttccacattggaccacgagctgcttgagggtagggtcatatcacctttgtctttttattcccagtatttcaaatgtggctgacacacagagagctctgaatacagacacacgcagagcaaaatgcctaacacgattgagcattcgtaccaggccctgttctaagagctttagacccaataagtcatttacttcccacaccaaccttacaagttaatactacattaatattccaacttcataaatgtgtaactgaagcacagaggggtttaggaacttgcaccaagtcacagagcttgaaggatccatggcttgaacccaggcaggctgactccaatcttagctttaatgaatgaatgaataaaagaacaaacaatacaacaaatgagtgtgtcttgcttttggccaaggggtttatttaaaattatcatttcagaaatctttctgcccagtgatctgactttgtttcaaattgggacttttttttttttcttagctaacccaccttaaaatcataagtcagttttcctctctcaacttactggagacatttctgattaatcaagtacgttcatgcatttcctcagaatggtgaactcatcattagtccgtccctatttaactttttccacctgccctcagctgggccaaccccgagctcctcaaccacagtcagtcctttctccttccctccctccctccctccccttcctccttccctccccttcctccctccctccccttcttccttctctcccttctctcccccatccctccctcccttcctcccttcttcagccacatcttgctccacccccctatacatacctgcggcatcagccttaagggatcctttgccactttctcttcagagctgcattttaacatgtgcaacattatttggatggtccccttagcatgtgtggcccacttgctatttgcttttcatccagacctagctcaagtatccctttctctctctgtctctctgtctgtctctctctctgtctctctctgaagcttcctctagccccaacagatgaagtgctccctctgggtgctctgggagcatcgtgttcctacttctgctgtagtgcttatctcagatggaattgaattttacggttagtgtgtgtccctcccaattaaactttaaactccttgaaggaaggcatatttcttgctcctatctgtctctgctgacatggcaaagagacctggcacaaagtaaagacacaatagatacttgttttattgcatttgcctgtgaacatatgatggattgaacacagttttaccagttcaccttaaaaatgactacttaaggctgcttatgcatggcacaaagacacaacatgcatcaaatcctagcagagagtacattttcctggtccttcaagtataagaaaaccttgctatttttgcctgcgtatggttttaataggattgataaaacagaagagagatggttccctaaatcagtttgaggtattcaattcagtttagcagctcaaaaggctgacatttgccttatttgaaggttggacagctctgcagctatttatctgctttattgcaatgggagtgatgactgcataggcaagctgagaagctggcattggggaaattgccagaaaacttcatatagtgtaaaatatcatatagtgtaaaatgatcagaaaagtgatatacaaatgctgcatgaacaaataattatgtaaactatgtaagtcagagaaactaaaatcttaaagtcagaggctttttggataattaaattgttttaacccacccacaaacctactgcaggaatgattctattccaaagaaatggttaatagtaagaccagaaggggaaaaaagaacaccagggagaactaaagtcaatccaaatccaagcacaagctgctgttgacatgttacacataaaaaggcttgctctggggcttgcaggtccttcttagcagagcggtgagaaaacttaatgtccactgtgggtggcacattgtggtgtcactggcagttgagctgtttggtatcattgccatggcattactatgcattcctctgcaaactgcatctcgctggcttttctccaagccaaataaaacacaaaatgggtcaggcttagtgagactgaaatgttgcctcctttccctctgccttgtcctcagctagctttaaggcaagcatcacattggattcaaagaccagctgatgctctttcagtatgattacttatgctgtgattgacaatgtggaggaaatagcgtatatggccaacgatagggcattgactaagtaggtcattattcagccaaacaaaggtacagtatgctgtgattttaaaatgatgccgtagattactaaattacatgaaaatatacttgtaagaatattatgtgacaaagaagcatgctataaaagtgtagtcactgttgaatcctattgtataaaatgtgtgtaagtgtatacacaaaaaaactctgaaagagtacacactttagtgctaagagtacttatctctgcagatctttatttttgtcttttttggaaatctcgcttgcttttatgataaatttgcaaggttactcttttaagtgttactttatcattacaggaaagaatagagagaataaattctcttcccctgggaataaatttaagagttttcaaagagaattacagcctatgtaatatccagcgatatttggactcgaatagaaagttctgaatcaaagagttgcgtagaatatcaagggatgatctaacagccatcctcttgcctgggatacccacagccccatttactcaggctgtgggctcactgagaaggagacaacattggccactgttttactttcttctctgttaaagctgccttggtccttctgtctcctctgatagtatcgagtcattcagatgtatttgctttagttgattgccatgctttcaaacaggttccataagctacacatccacttttaagactaaattgagcttcattgaatgtccttaatgaccacaactaattcctagcccaaaggagggaagctgcagccaactccctcaatcctcaagaacaacaatgccgatagaacccctgtgtgatccgggagctttggtctggtctgcaaacaccaagcgcgccgttaccccagtgggtctccatcttggtcgcacattaactgctcctgtgctttctgaagcaatgaccacaagccacaggtcgcgactgagccctgaaatgtagccagtctgaatagagatgtgctgtaagtgtaaagtacagactcagtttcaaagctttagtcttagaaaaagaatgtaaaatatctctatcattgttccactggttatgtgttgaaatgttaatatttggaatatactgagttaagtagaatttatcattaatatattattttaatcatttatcaatgataagatattaatattatattaaaattaatttcaacttttaaaatgtggctcctagaaaacataaaattatatgtgtgactctctttaatgtttttactggcagcgctgcattattatctccctttataattttgaagctcccaacatccaggccataccccagaccaatgatatcagaatctctaggagtgagagccaagccaggtggtgaccagaagtgctctgtgttgagaatatgggaggaaaaaactgttttttcctacatacaccctcatcttatcagatgaggaaattgagtctaacttacccaaggtcacaaagccagcggggggtggaactgggtttctgtccagctccaaacccctctgctgtatatcttctgtaaacataaagaaagctttgctagagaagaagtaaactcatttcagccctccactaagaccggaaaaagatttaaagggcataacaaaattatagaaatcaaaggatcatctttgggcataaccagccattattataaggcagtggttctcaaagtgtggtcctcagaccagcaacatcagcatcatctaggaaattattagaaatggcagattcttggtccctacccagacgtactgaatcagaagctctggggttggggcttagtgatctgtattttaacaagccttttgggccatgtgttggcaaactttcttctggaaagggaaggatagtaaacattttaggttttgcagaccatatggtctctgtggcaattgctcaacccttcccttgcagagataatatgaaaatgagtggacatggctgtgtgcccagattacatgaagtgaggtatgtctatatctgctgcatgtattttataattgatttggctttgtttaatttatggacactgaaatttaaatttcatttaattcttacatgtggtgaagtattattcttcttttgactgatcagtcctgctctaagtggttctgtggcatgttaacttttgtgaaccactgctagaaggtaagtcagaatccagggctcttagccagagttactgagcacaggtatgcgggggctgtcaccaggtggacacttgacctgagctgcagcataaattcagatccaggacaccaaggacaatgccacacctgtgctttgactctgctttataagacctgtgccaaaaaattagatttggggcaaaagggacttaacagataggctggtcagagtggcagctggcaggaggaagagcaccttaggaaaaagccagagagcaggcctggaggtctccttccctccccacagctgccatggacagtctggagggccattacatttctctatttctcaattactgcatctatcaaatgagagtggccataattcattattgggtaagagtggagactaaataagatatgtgatgtgtctgacgcgttagaaatcacagcactgagtccctgggcttcctcccctacccgagggaccttgaggcagagggttggagcattttgtgaaaactgcagggctgattgataaactctggtgggtctgtcatagaaacaggccagaggactcaaactggttcaccatagagccagaggagcagccagtccataacatctcacactgccaacctgctcaggatcccagaatttcctgaccagtaactgaacaagtctttcatggctatgttgttctgttctgttttgtcttcttcctttgatctaaggtcagcctctaaaatttttattttctaccactggcttgacttccatccagaatgcataatcttaggaatgtctactcccttcaagggaacctgacatctatcaaagtgtgatctgtcaccctagcccacaatagtctgacataaagacttttcccaaagtctgggtttgtcagcactcaccagcaccacacatgagacacccacagccctgtctagcttggaatggagtcaagttcactccagtctctttcagtctctgatttatcaagcgttcaacacatgttgatgtccactctcaatgaggttcattttgttcaagcagtttcctagaatattccacgtcaggaagatgaaagtgaaataagttaaatagagccaaaatttggttgtaagatgtactgtggagcctgaaactcaggtatcaccctgggaagtagaagcaacacttcattcttgctccacaagctctacccaattaaaaagtggagagaaatgacttaaaggtggctcatgtttggactgtcaagaatatattgtgtagggccgtggagacgtgaggttctcaactggaagtgaacctggcgatttgggtagagactcagattaaagccataaagtaaatagaatgaacacatgattttctttctttttaaaaattgttttatattatttccaacttctattttaagttcaggggtacatgtgcaggatgtgcaggtttgttacatagttaaacgtgtgccatggtgaataactgcacagatcatcccatgatgatctgtgataccatcccatgataacacctaagtattaagcccaacgtctattagctatttttccgatgctctccctcctcccatcccccaccctccaacagaccccagtgtgtgttgtttgccccaatgtgtccaaggaacacatgattttcacacttgataataagagacatgtcaactatcaaacctggttctggccaaatttctatgagttctgaccagggtagatcaacccaggcaaagtggccttggttccataacaccaagtgagtaatactctttcaaaaataatttgtgtattgattcacagactgacttgcagatatcaattgtacacaacctactgccaaaatcaactgaaattaaaggcttaagcgagttaaataaattgtgtgtgtgtgtgcatgtgtgtatacactgagtgtatatgattatgaattagagtatctgtaggtcaaggaatcttctttgagaccttgaaagctgcgattgatgtaattcaaccaatgaaaacctgagaggacttaattatgccttattcatgtcaggatccgagagaggtgcagaagataatggtgcccacaagaactgctgattcatggcgcatccatgcctgcacaagccacttctcagtatgagcaaaatccattatgaaacacattcaacagatacacatacctccctgtgtgcaaatgcaagctagagaaaataattaggtttaaacttgattttaaatgcattaatatttaaagcttgcaattaaaagaaatatgatgacaccttttgcaatctgaagaatcctctagttgagaaaataactggtccctggtttatcttttgtgtaaatctgaactttcctactgtttgaccgaagtgagaaatacattataatgagatgaatttcaatataaaacagagtagatcccctgagaactgtatttaaagtctggcataatattgcccataaggcagatatttttgtgacagcatccaagagattctgttgtaatgctcactgattttatacatacaaataagtcaaaggtgtaaccacggtgggtgcttgtggttacccatcttcccttccttttcattacgtttcttaattagatgtttctcttctggtcctggttcatgctgaacactaggacctgtgatcctcccagtatcattcattgcagagccttctcaatctcactgtctgcatcaattcaaaattctgtcttaacaataatatctagatcagcagtcagatcccatcagttagatttctatggcctcctctatttctgtttcaatgtgctcctttccacagatctaggaaatgaagggaatttggggggagtgctgggaatgcaatctgtttactgcctagatttggaaaaaatccacaaatgctttctgcaaaatgccttaccctctgcgctgctggagtagaagacagggctaaaccaccttcccagcaggtgctacttgaagaaattaatctatgctgatgacctgacaacctctctaaagcatgctcccagccatggccccactaccatgggcttcatgattcagttgtttcatgttcactgcacatacattaacaaatgcaagcccaggaattcaggcattgatttaggctataacagaaggggaataagcagcttaacagaagcctaaatttaaaaatacagtagtctcctcttacctgatagggacatgttccaagacccccagtgcatgcctaaagccatgaatagtaacaaattttatatttactattttccccatatatacatatacctatgataaaattcaatttataaattagccatagttagaaattaacaataacaactaataaaatagaacaattataacaatttactgtaataaaaatatgtgagtatggtccctctttctcttcctctctgcctttctctctcactctctctctccctttctctctctctctcaaaataccgtaacattttcaggccacagttgaccacaggtaattgagactgcagaaagtgaaactgcagataagggggactattgtctactgtacatgttttctagggtatcacctatgttatacttgtttgctcacctttgatttctgggccattttagacttcctgctccttcaaaagctgcaggctttccatccccgcacttcattcccaaccttccccaatcctagcttctggtcctgcccttcaactgctgccagtatccccagtgacaaagtggctgagatgggaactcatgtgccttggctcctcttctcgtggatggatctatagagccatggagggagtgctagctttctgtgacctggaaaattgcactatttcacctgccattattatccccactgtcattttgtagctgcaggcagcatgttaccaaaaccaatattattatggaagcatttcctgtcccctgactcatcagactgcagtgctgccgctggagagcagagaccttagcccagtccagtggttctcaaccttgagcaggcatcagcatcacccggagcccaggttcaaccacagttgctggacctagccccagggtttccagtttcgtacatcaggtggggagtctgagaatttgcatttcttacaagtcccccagtgaggctgatgatgctggcccagggaccacactttgagaacctctagcctggtggttatgcacaagatttgaagccagacctacatagagctgaatctttactgccacttaccatttatgtgaactcagacaagtaacttaatctctctgagcctcagtttcgtcatctgtacaatatagaaaatacaagtgacctcatgggatagtcataaggataaaatgggataatacacatatagcccatagaatggcgttctgcacacagcaagcattcaataagtgatccatggcagcaactttgtgcagctgatgacaggtttctcaagcaagggccctgagcccctcaagtcatcatctgtctcagactggaagtctgcattttaacaaggcccatgaagaggcagtggagtcattgaggcttagaagtttaagaccttttccttacaggtagcaggaagatgcctttggtctaagcctgcatattttctgatggttgaacaaggcgaagtttccctggccctcttgtccctgtggggagagagtgtcatttgcatctctcatggaattggaaatttgaagcaccatcatctccccttcattcctttcttcctttcatgtattattccttgtctccagacttcaatggtagatttcctgcttgtaaataccaggcagctgctgctgcagcaaattcatgcagaatcaccaaaaacaatggtttacttattgcattagccgaactcctaccctcgaactgcaaaaaaaaaaaaaacagaactaaaagcagtagccaccctctagagggtacaagcaatgactaagcaaaagagtactttttcttgctaaatggaatgaaaggaagcatattggtttttttttttttttttttttaatgagaaggagtctcgctctgtcgcccaggctggagtgcagtgtgatgtgatctcggctcactgcaagctccgcctcccaggttcatgccattctcctgccttagcctcccgaggagctgggactagaggcgcccgccatcacgctcggctaatttttgtatttttagtagagacagggtttcaccttgttagccaggatggtctcaatctcctgacctcgtgatcagcccacctcggcctcccaaagtgctgggattacaggcgtgagccaccgcacctggccacatactgttttttaaggaattctagagccctgggtgctttctccccatcctcaaatgcaagcatgtttgtaaatgagccaaccatgctgcaactgtactttgacatcagtcaattctttatgttccttgagcccagcatactatgactaaggatgacctaggaccagaaatacttttaattttctaagacaaacttctttacaaatccttgaccgttatggaatttcataaatccagctcagtgacatactttgatgtaataatcgtttaggaagctaattaagatggccaactcacgactcccccacatcacccacttggatcccagagctgctggtatttgcattttaagaaactaaacatcccgagagccctgagtgtgtgagcccggagccccccagtgtgagaaacgcagccctctgtgatgtctgtttgtttagctttccagtcgcattactctttcccagggttgcccaggtttctgaggatcaagtcaatttcttctctttgcttccatcatcatctacttcatttccatttctaggaatctaatcagcccaccaatttataagtcgtattttgaatgtcgtatgaagtatttgtccacaaaatttaggaactggttggtaggtggaacaaaaaaacttaaattctttttgttttgctgctggaagttaggtatctctcagagggggaagctggacagcagacaaacagggcttgcagacagaatgccactgaaaaagtcattttccctgctaggccccgcttcctcagcaacgactaaatagtcggcaccatccagacagtagctactggcccctgcagccattaagtactaggagcatggccagtccaaagtgaaatgtacagaatacacaccggattttgaagacttagtacaaagtatgaaaaaaataatgtaaatatctcattaagactctttatattggttccatgctgaaatggtaatatttttaataagtgggttaaacaaaatatattactaaattaatttcacttatttcctcttcctttttttgtatagttactagaaagttttatgtcgcatatatggttcacattatatttctcttagccagtgctgatctagaattgcactgtccaatatgacagccacaagtcacatgtggctatttgaagaatttacatttaagttaaattaaaaattcagtgcaccagtcctaccagccatatttcaagctcctaatagccacacatgcctggtgactactgtatttgatggcgtagacacagaacattcccatttttgtggaatgttctattgcacagatctgacctagtagtatctatactgctctatttttttttattattattatactttaagttttagggtacatgtgcacaatgtgcaggctagttacatatgtatacgtgtgccatgctggtgtgctgcacccattaactcgtcatttagcattagttatatctcctaatgctatccctcccccctccccccaccccacaacagtccccagagtgtgatgttccccttcctgtgtccatgtgttctcattgttcaattcccacctatgaatgagaacatgcgcccagccatcccattactgggtatatacccaaaggactataaatcatgctgctataaagacacatgcacacgtatgtttattgcggcactattcacaatagcaaagacttggaaccaacccacatgtccaacaatgatagactggattaagaaaatgtggcacatatacaccatggaatactatgcagccataaaaaatgatgagttcatgtcctttgtagggacagggatgaaactggaaatcatcattctcagctctaaagtatttttaacagtccatcctgagttcgtttgtgagtttatgttagaaattctactctctggcccagccctaaacccaagcactttctcttctgctcaaatcctaggttacatccgtgtcatggttctgaagggccctttgtggtgagcacaaatacaaacaagccacaagccttgtcccttctcaggctcatcacctggtccctcctttcttaatccaaggccgctgtattagctttctatagctgctgtaacaaatcaccataaacgtagccattgacaacaccatcaattgattctcttacagtctggatatcagaaagctagcatcaaagtatcatagaattgtgtttcttctggaggcccagggaaagccggctttctcgcctttttcagtttctagaggctgctgcgttcctcggcccgtagtggcatcactctactttctgcttccatctccacctggccttctccttctgatctcctacctccctcttataaggacctctgtgattacattggacccccctgggccacacagggtaatctacccatctcaaaatccttaattcagtcacatctgcagagttcctgttgccatataaggtaacatattcacagtttctggggattatgatttggaccacttttggggggtcctgcacaacccccaagtggaaaaccagcatgccttgctgaactctgtgtgccatgtgaaaaggcccaaaactgtgtataatacgggaaaaactcaaactccataggttttcaattaaaatgctttcatagaagtccaacaactctgagaacttcacagataatgcgcttgctcacaaatctgaggcaagagatgagtctttctgttaggagattgtatcattgctcccaagggcttcccttattgggccattattgtcactcttcccccataaaaccaccacctgcatgccctctaaccagaggagaaatgatttggctaggagtcaatgacagcccatgtgctgtgcccattcttggcaaagaaagatggtaagatggcaaggagtccttcatcatgtttgtcatggagagaaaaccagcttctattaggaataaaaagtgtagggagaggccgggtgcagtgtctcacacctgtaatcccagcactttgggaggccgaggggcacagattgcttgagcttaagaattccagaccagcctgggcaacatagagaaaccccatctctggaaaaaaataaaaataaaaaaaaaaggcaggagggggcagggatagctgggtgcagtggctatgcctctcatcccagcagctacagaggctgcggcagggaggatttcttgaagctgggagtttgagaccagactgggcaacataggaagacccccatctctaaaaaatttttaaaaattagctgggcatggtggtgtagtcctggctacttgggaggctgaggcaggaggatcacttgagcccaggaatttaaggctgtggtgagctatgatcacaccattgcactgcagccctgggcaacagagtgagatttctctctaaaaacaaaacaaaacaaaaaaaaaagaaaaagaaaaggagggtagagatgagtatatctctgaatcattgcagaggcctaaggagaggaccatgagtgaagaaacccaggaaaaattctaattttataaatgattcattacaagtacacagtgaatgttttcaagttgtaaataacattaaatttctctaggtagtgaaaggccgtaaaataaaatctcacatgcctcgtcaaacggacagggagagatatcaaagtagagttagctggaagcaaaactaagataacttatgtatagaaaaagtcatccaaactcacattatacagttatgagttctcaagtacacttgtgattccaaaaacacctcagcaactattcccagaacacgctgacccttcacacagccaatggggtgagaccaaatatgctggacatccccaagtaacatttagaaataaagttgagcaagttctaattgtggagcaacagaaataatcctccaacaaacggccatttgacttgccaaagagtcccaaagttttcaaatccactttattagagttaacttgatttattataggttattctacttatgcactattggacacttgtgcgctattcagggacagtaactctccatccaactgaatgaagaaaacaaagacagagttcaccgtgcccccctcctgcttcctccagtccctcttttctaaaactcacaggcttcctcgcataccctcttcctccccttggagcacagctgtgatcttcacctcttgtccctgtcactcagctcctgtcttctcccagagtgtgagattcagagaattcaaagagataatccagggcatgaaaattctcattcctggtctttggcataaaagtcaaggaacaggttccagggcattcgggtaccatttctgaactaggtggttccatcacaagaaacaggtgcaaacgtaccagcagccaggtggctagggccaccactagctcatccatggtcttggtatacattagaaaaaggggcaccttctgccaggaagtgtttctagtttggggtacccccaagtaaagccaggttcaaggacttgggggtgggttgtacactgggctggggtgccaggaagccagggtgatggggaaagccagtaagagatgcatcagggagctgattaccagcacagggagctagggctccatccctcagcaacccctggggaaccgcagcgtgtgcctcagaattgtccttctcagggtcaggaggcttcaggagttcacatccctgcacttcccagttgcccttcacgggcttctctgaagcaggaaagcatgcagaggggcagccccttgacatggagtaatgtcagaggccctgctgatgcccactccagcagccgggattccaccaggggctgagaggatgtggccccgacccctaaaagcatatgctgctgggattcagcccagtccttggctacaggccctgacccagtagggcacagctggatttctgatcccacttaaccctgagccaggcacattctgtgcaactgtatggggagaactggaagaaccccctctgaaatggagcagccaagcctgcagcactgagagtcccgggaggacccctccaggggagacacaaaggactcagaggctcagaggataagagttgaatggcccgggagcttgaggagatgccaaattaggacacactgaaaaataatactaaaaagttacaattaggcctggcttagcttggagcttacctacccacactgcctggaatccatggaaacctgaagaaacctccagcctttaaggcccactgggatctagctaccgtgacattcgccctgaaggcagtggacattcttatcagtccctactccaaggcaagtttgttattaccttaaatgagagccctaacttaccagctccaagtcttaagggaacagtaaggactacatcctcgagggtcagaaactgaagaaagcaaagcttcagatcagaggggatgggatgagaagcagtgcctgggccttccccatcttccagatctggttctctcgggaaatacccagaggtaaggagaggaataaagactgtatccagagctcactagaacgaagccatgcactccctccctcctcctcctccggagacgatgctcttggttggtctggaacatccttcccaccttcctcttcgtcctctggcccctcaccttggtcctccattcaccagatgtcatcacagactctgagcttcctcccactttgctcttggcctcacctggaggggagagtgagggctgcatcctcccaggttgacactgcctccctgcatgcaggtatcccttccagatactgatttcatctcctttggatatataaatacctagaagtgggattgctgaatcatatggaagttctatttttaattttttgaggaatctccacactgttttccacagtgtctgtactaatttacattcccaccgacagtgggaatttctcacagaattagtcacagtagccaagatgtaaaaacaacagcgacagatgaatggataaagacaatttggtctatacacacaatggaatatgattcagccttaaaaaagaaagaaattctgccatttgcaacaacgtggacaaacctggaggaccttatgctaaatgaaataaggcagacaaacattgcatgatctcacttacaggtggaatccaaaaataaaagtcaaactcatagtaagagtagatgagtggttggcagggtctagggagcatgggaaaggaagagatggtggtcaaagggtgcaaacttgcagttagaggatgagtaagttctggagacctaacgtacagcacagtgactactgttgatcacagtgtattgtgcgttgctaacggagtagctctccagtgttctcactacacacaaacacacatgcacgcacacaagcatgcatacacacaaaaacgcacatacattcacacacaaatgcatgcatgcacacgaacacacacgtgcaggcacacatgtgcacacaaacacacacacacgaaaggtgactatgtgaggatatgctaaccacgttatacaacttaaatatatacaatttttatttgtcaatcatttctcaatataactggggcaaaaaagaacactgcctcccctctaccctgccctactgggcccagcaggtgggaaagggactcaaaatgctaggtaaatgaatgaatgattttttaaacaaaaatatttgttctggatatgccaattggcctaggcatcataattataactcttgagcatttttatactgttaagcaccctaaaaatgcttcagcattaatgtacattttataataaatttgggaaatcggcaggaattccagcaagatcctagcaagggctaggaaatggggagagggttgcctaaaagagttcatgcagtcagcaggctgcatctgcgctggttattgagaacaaaaagaggcagaccaggacacaggaccagccgggtgcagtggttcaggcctgtaatcctagcactttgggaggccaaggtgggtgaatcacttgagctcaggagttggagaccagcctggacaacatggtgaaactccatctctacaaaaaactaggcgtgtatggtggcacgcacttgtagtctcagctactcaggaggctgaggtgggaagatgggaggatcacctgaacctggaagatggaggttgcaatgaaccgagattgcacaacctgggtgacagagccagaccctgtttcaaaaaaaaaaaggaagacacaggccctcgtatcaagttgatgtcacccaaaacccttgggaccttttatttccacaatttaaaaaccaattttcttttcaaaaagacactcagtgacaatcacccaaagatctgggtcaaaaaaaaaaagctgatattcagaaatgacttcaagtgttcagaaccagggaggtgaatttctttaatccactgcacattaaaaactgataaagattgcacatgaaaggaacggaagaaatgggtgcaaatatactggggctctttttatagtcctggagtgtgagaatgttaattaaaggaatctcagaattggagaggatctgagaaaggatggagtgaaaatttaattttaggtgttgttttatcaggttaaaaaaaaagacaatttcatgagttacttgcagttacctcaagaacttcatgagcccccaaaaaagctccaattgaaactgtaaactgtaagagaccaatttaatgaaaacctctcagcccagtgaaggacctcttaatggtgaagaacacaaatgagcaaaccccgggagcattaaataagcataacaaaatgttaggtatcattagagtgttgttcttcaaagagtcatactcatccattttttaaaacgaaagtttaaaaaaaaggcacagacagaacttagaagttacatacactggctcaagcaagaagctccaaaacctagtctcattgcgtatttcagcatccaccaagtgaatgtccattctgttactgtttttcacacctgggtaaataataatatagttaataactaattgccatttctacccttcctggggaccacattctgctcagcggctttacacacaagttctccagtcctctcagtgctctatggggaggcattgctatttcgatttgcaagcacaaaagctgagttgcaggatggctgagcaaattgcccaacatcacttagctagtgagtcagagagctgggtctcaaacccaagtctgtctccttcctaggtcaaggaaggaaggaaggaggctgtgccaccctacagcaatttgtagaatttgtagaatatacctgcacaatttgtagaatatacctgcataaagcaggtataaacatgcccaagggaacccagccagatcagacagggatggcacaccagtccttgttcttggattctgctcctgagccacactgtgtccaaaccctgatagccagcaggagtgctcttggcttgttcatgcccgtagcagccacatcctgagttgcaagcagaagacacccaatccagccaacaaaagcaaagggaatttcttgaaaggacatttaggagtcacagaattggcaagaaagctggaacaccaggcagaaagtgggcagctctagagactgatgagttctgcttctcttgccagaacagattgggaaggggtctctttgtctctctgctctgattgtcttggcttgggtcagagagtatctactgggaaaaagataacttccaaaaacgaaatcatgttccagtagctgaaccactgcagtgcatatctgttaggggcaccattagcatagattgcaatgcaaggggtgcatcctcaggctgggcaaagcaccagcatgacaaatgaaccccgggcaggatgtccctctgaaccctctatatgtaaccacatattagttacagtgcctacatgtactgctcagacaggttaagtaacttgcccaattaatagaaaaaagagctcagattcaagcccagatagtctgacccctggacgtgtgctcttagccacgatgcttcgaatacacaaagtttgcagtgctgggggatcacaggggaggcagtaatcactgaggggctgggcaaggcatcatccttcttgctgacttcaatactgatgtggatggcccaccaagcaccatgatgtctcagttctttcacccccttacttccaacaaccatttccatctttacacctcaaccaccatctcttatgtcaaccctggatatcttacagcctgtaaaaatgcaccctttctgaaatctaaatgccaagccctctgccatgtggcttcctcatatcctgccagctcaccaattctagcaccttgactgcaataatagaaactccattcaactcacttccccactgttacaatcaacaattccctcctgccttcactttcttccttactcgccatagattctacggtatattattataatcttttccttatgtctaacccaacagccttcactttctcttcttttcattcttatccagtgaaactccaacccaaccattgaccttcagtagcatcagagctgctgaatgtctctaagaaaatatacatctgggctaactggagtatctttaaatttatggccacaaacctcaaaaaaaagcactcaacactgcctagaaatcttactgtatttctcaagtagatttcttccccactgtccatgaatattgtattcctccttttgctactcaacacaacacaggcactcgccatctagtgccccctacctgtctgtgaccttcactgcaaaaatgaaagtaatcagtcaggagccccactattggtttactggcccatctacaaacgtatctacacctgaactcattctgctctgttttctctcctacaattgtgggagtaatattcatgcttctctcaaatgcaggagggagtgttaatagccttcctttccaccttcttaaacccttcatgtcttcagttattccctcttctgcatcttcaatctctctttctacaagattattcccttggaacaacaaatatggtacagtatctcccatctcgaacaaagaaacaagccattcttaataccacactctccttcagttatctttttttttcttttgctccctcttataacaaaactcttaattcctcacctccttatctctcttcagtccaccccattcaggcatctgtactcatctctccagtgttcttgtcaaggtcaccaaatgacctccatgttgccaaatccactgcacagttctgttctcatcttactcagactctcagcagcagcattcagcatggctggcaataccctcctgtttgaaaaacattcacctcctggcttccttgatccctcagtctctgactaccatccactccactgaccgtctcttcttagtctccttggttggcttctcctcaacccaacctctgaatgttggagggcctcaggaggtcctgtcctctcctctgttgattaattctatctcctttgggtgagggaggcatctcatcctgtcccatggcttaatcaccacatgttaataactctgatattcatagctccattcttaccttttccctaaaattccagacttgtatagccaactgcttccaaggattcttattaaccatctcccagaaatagagctcttcaatcatcacatacacacacacacacacacacacacacacacacacacacacacacttcctcatcaggcttccctaatctcaataaatggcacccccatctatccagatgctcaaaccaaaatcttcctggcccccactctctatacccactcatcagtgggtgctatcacccaacacagctgtgatctcattcgtgttctctacctccaccaccaccacccttcaccaatccatcatttaccttggccacagaagagccttcacacttggcctctcctctgcattctctacacagcagaatgtctctgcaaaacataaattagctattttgacatgacttttaacacatttccactgcctctggaatgaaatctgaactccctaccatttcctgcaggtcctgaaatatctgtcacccctcaatctttccaagctcttctcaacacagttcctcttgttcactgtgcttcagcagactcatctccctctatcctcctaatttcctaaactcttttccacatcaaggcctctgtccttattttgttattctgagatgatcttcccccagctatttaaatgcttggcccattctgctccttcaggacttggctcaaatgctacctccttacagacgcctccatgacctgccaccctgtggaacatggtgcctcccagttcctggcattagcaagtattcatggagtgcttcccaggcattgttattagtgctgtttattgattacctcttttaattccccaccaccctaggaagtagttactgttattgtcattatcttacccatcttggaaaaaagaaaaaaacaaggaaactgagcccaaagagataacaactgtccacagtcaactaatcttgggacttaaccctgagtaacctggatccagcctggcccctcccccaccacaccctcctgcctctctcatattacttggtgtctctttccagcacttgttacaatctggatatcgtcttgtttagttatttctgaatcatcattctcctcagtagaatatgcattagttcattttcataccactatgaagaaacacccaagactgggtaatttataaagaaaaagaggtttaacagactcacagttccagagggctggggaggcctcacaatcatagtggaagacaaaggaggagcaaaggcacatcttatacggtggcaggcaagagggcgtgtgcaggggaactgccctttataaaaccatcagatctcatgcgacttattcactatcgtgagaacatcacaggtaaaatccacccccatgattcagttacctcccactgggtccctcccatgacatgcaggaattatggaaactacaattcaagatgagatttgagtggggacatagccagaccttaacagaatgtaagcaatgtgtggacagagacttctttttttcatccaaggatccccagggcctgccacatggaaggtgcccgaccaatatttgtggcatgaatgaataagtgaatgaatggtaggtgtagatcaggaaatgaaaacatttctagcaatagctgctcttattttggtgccaataattgtcacacatctgtgtaaccacaaatcatgtgaatgaatcatttttttaaatgattgaataacatcatctatgctttatatattttttcagagcagatttactatgctgggcctgtcaataatcctgaatttactattcctcaggtaagatattacttacttcttgtattaaatagtttgtttcttgaagaagaagaagaaggctagaaggagggaaaggaggagaaaccaagaaagaagagaaggaaagaattaaacagtttaaaacttatccataggccatccctgcaaaaaccctttcttaataaaactgctgcttcagagtgggcacttgaaatttcttgacacactggctttgtcattttggcatttaatattttacatgtcagtgaaccttagggaatcctccgagtacaaacctcccactgagagggatgccggcgtcttgtccagcaggattacggcatttgtggggttccatatggcagtgctgctgggctgtgtgggcggcaccatgcatgtgctgggaccgagctcaggaggctggcggttcagagaaaggaagatgcacaagccatgaaggcatgaaggtcctccagttactgtcctttcattgttactcataagctgccactaagtcaataaaatgcccacatccttagcatttgctggcaaagctcacagctaagagtagaattttccactaattcctttctgttcaagataatgtgacattattaaatgactcaatttacatcactctgctataagcaataaatgttcaatatgctacccctcagataatggttttttttttttttgagagagtcttgttctgcctcccaggctggagtgcaggggcatgatctcagctcactgcaacctctgcctcccaggttcaagctattcttccgcctcagcctcccaagtagcttggactacaggcacatgccaccacgcccagctaatttttggatttttagtagaaacagggtttcaccatattggccaggttggtctcgaactcctgacctcgtgatccacccgcctcggcctcccaaagtgctgggattacaggcccctcagagaatcttatggaacaatatgaaaaggatcacaaaaatgtgattttttaaaatgcatgctgatgtattcagtacatgtgagatttggttatgtgtatgtaatatgtagtgatcaagtcagggtatttaggatgtccatcactgaatacatttttcttaactatagtcaccctactctgctatcaaacactgaatttatgtcttctattaactgtgtgtttgtacccttcaacccacttctctttatactctccctctcatcctctccctccccactctggtatctatctttccactctctatctccatgtgatcatgttttttagctcccacagataattgagaataaacaatatttgtatttgtgcctggcttatttcacttaagataatgacccccagttccatccatgttgccacaaatgacaagattttattcttttttatggccatatagtattccattgtgtatatataccacatcttctttatccattcatccatacatagacacttaggttgattccatgtctttgctgtagtgaatagtgctgcaataagcatgggggtgcaattacaaaaatgtaatcactttaaatagttttgtttacaacctcatcctttcagttctccaaaacctgtatttggctgaagaaaaaggtctctttctccataaagaatctctaacttagtttcacctctgggtttgtttcctttctttcccagcctctgtgttcctatgtcagagtgccatcttgctaccatctcagattcccactatcattgctcttgcagctgggaagtctccagccctctccctctggaaatctctagtttcctcctcaggcctttcagtaaaatacaaaagttttgcaagaaagaaaaactacacctgtcttcacttctagtatgagggccctaaactctcccagagagttccatttttctttaaatctttgctatttgaattgtttttctttccccattgttcttctgaccctcctcccaactagaggctgacttaaaatttactaacaattgactttcacttttgcattgttggcttctttttaaaccagttactcagcaactgttataagatagaggggaaaagaacttcttaaagtcagaaaacccctttgaaagtaagttgagaggccaggcacagtgcctcatgcctgtaaccccagcactttcggaggccgaggcagacagatcacttgaggttggaagttcaagaccagcctggctaacatggtgaaaccccatctctactaaaaatacaaaaattaaccagtcatggtggtgcacgcctgtaatcgcagccactcgggaggctgaggcatgagaatcgcttgaccccaggaggcggaggttgcagtgagccgagatcacaccactgcactccagcctgtgcaacagaggaagactccatctcaaaaaaaaaaaaaaaaaaaaaaaaaaggaaaaaggttgaccagataagtaaaaagctttattttaatcacctacagtgcatgaaggaagtgcagaacgtaagttcttcaaccgctgatggtactcaagcaaatattgcccagtgtgagggcatcgcatgtacagcagagagagctggaggccttaatcccaaaatgggctccctacaccggctgcaggtcagccgtggctggcccgcaatgcacggaggctttgctttcttaatatggaacagacacagttcaaagacttttggttgtaaaagacgtaccccatatcccctcctccagctaaatcctccagagatgggctctgggctaatggcagttcccatgtggccaaaaacgctcccactcagcgatcattctccagggtcttggtattatttccctctgaactcatccaaccccttggcccggattgaagccctacctgctgtcctctgtctatgcctcctgctttctgaatgaaaatttaggggatcctttgggctcccgaagcatgtggacaacaacttgtaggcacagcctgacccatgtattgccaaaggtgcacctacaaattcctaacttacaaactctgtgccctcctcaacagcagaaacgctgcactcagtccttccctaccctggcctcctggcctcccagcacacacctccatctgcctccagcctggcacgcttgcctaaatattcttatctcttataccagagtctgtgatatctgtaattcataatctagaaccccttccttcaaatacaacagctcctcttaggttcataatgtagtaatgaaaaattcttgtgttgttcaatacatttgtaggtgtgtgtctaaatgcacatagagattttaaagaaaagtacatgaggaggaagagaacgatgaaacacaacgagatataaatttgagccggtctttactcataattaattctctaacatttggactgctttggttatattcctaacactatttctaaaattacagctgctcaatatttgaggagtgtgactcatgggagcgtctagaatcatggaatcacacccaaggcaccatccagagcacagcctggttctcttgaatacaatttcagtgttggggactccactctctttggaagctctgctcattgctagaaagttgctcccttctaacaaaagccacctttcatgcagcttctctccggtggtctcacctactccttccctcttgctttatacagattaaactctttcctcctttgggtgacaggcagttcaaagatgtgccagcagtctcctggcctcctctgccacagtccctctgctccgcttgcgaccctccaaccaccccagagcattttcctctccagattcgtgtctacaaacacatcaccgctccgtggctgctggggtgcaggactggggtgctggcagcaaacaaaaccagaatggctcttctacagtcctcataggacctggctgccaggtggcttctgccaagctgactgcaaaggaagggagacctccttacagtgttgctgccagcaaggatccccaaaggcagccattctttctgtgatggtgcattttggttttgtgctggtgaactgtgctccccggggtcttctctgtctgagcatacaaacctttctccttccagttgctcaggccaggagccttggagtcacctttaacccatttctttctctcccacccacttgcgtttcctcagcggatcctattggctgttctttcaaaatctctctggcacccaaagccttcccccacctccacctctactccaagtcatcttcatctctcacctggattcctgcaatcgcctcccatctgggcttttcagtgaggcagccagagggatcttaccgacacaggcgccagggcaggccaccctctcctgaccagagtccctttcagagtggaagctgatgtccccaccatggcctttgaggccctaagagtctggcctcctgtgttgcccttacctcaccccccccatccccccactccctgcagccccactggcctccttctgcccctctaaggtgggggccccagcccatagcagcactgcaccttcttgcatctgcttcaggtctttgcctaaatgtcgtcgtctcagcagggcctcctttcaccaccctgctcaaaattgcagaccagcacttgccttgacccatccagtgcttccatccactcccttcctgcatgagttttctccatgacatgagcacctgacacaccatacatagtcacatatcataagggtggtctgtctctcccagagatgctgtcagctccacagggcaggggttggcttgtcttgttctacgttatccacaatgtccagaacagcacccagcacataaaagtttctctgtaaatatttgttaaatggttaattgtactgtgggtcacacgtctaatacttgacctgtgccccttgcagggagaataccaggttttgctggaactgtacactgaaaaacggtccaccgtggcctgtgccaatgctactatcatgtgctcctgactgtggcctgtagcaaaaatcacagccagctgcatctcgtgggacctccaagctcctctgactgaacctactgtgggaggagaagcagctgatgacagagagaggctctacaaagaagcgcccccaaagagtgcagctgctaattttagtcccaggaccagacatccccagactccacagatgtaatgaagtccccgaatgtatctgtttctaaggagcctcttggcagtccttaagcagtcttgagggtccatcctttttctctaattggtcgcctcccaccagactcacctgcttttcaactttttaggagtgcttcctcacagttaccaagaataaagaaagctggccaccat

SEQ ID NO: 70 - DNA, 82105 bp, Homo sapiens
gtggttctgcgcttgtcatcatggcgacgcggggccatgtgcaggaccctaacgacaggcgcctccggcccatttacggtgagtgtcttggaccagcccgctcgccagcccgacgcgccgagggctgccgaggctggggcgaaagcccaggaggggtgctgagggccggcgcgcgggccgggcaggcgcaggggggcgggccgcgcgggccactaggccgcagccgcgggcctcgcgtaggcgccggcccaaccttcctcagccttggggtggtagtggcgcggtctgggcagcagctggtcggcagagctggcctgcttggcaggccccgtgggacgcgtggttctgcagacacctgcgctacccgcaggctgcatcgttaccgccgctcctagggagaccggagatctccccgaaggtggaagccggctccggcacgagggtgggacgccctgcctgagggaagattccctaccagagatttttttttatttacgggaattgggcctagagggttgtctgactaggtgggcttcggtgcataggagaaactgaggtccggagtggggaaggggctgacgcaaggtcacccagatcgagtcaggagcaggcccgagattccaggctcccaatccagagctgttgggtggagaagcagctactctggtcacacgtgggaggcggggggagggggtcttgggcctaaaatagcggtgaagagattgtgatagctcgtgtcagaggggcatgcagagctactggagggcttctcctttctgcagcttctctgtggttttctctgcagctttccttccctgtgctaagcagatccctctccacaactcttacctcaacccgcagacttgaagaccttgatgtcatctcatccatttaccctggtagtgaaaaatcacagattttgagtttgggagaaacccttttccaataaccgaaatgtgtaattggattggtcctttttgcatttcctttcctcttagatggttttatggtcttggtctatctcacttaatggtgaggaagcttcaaggtcagtggtttttacaaaagtagacatcgtatttatagacctcatgtggatgttactaaattggaggcttctctccaaggtgggaatcgttttgggagcggggggcggtggttaactttgtttctggccacagttagtccggcttttatttcataatttgtgtgatttttttttttactctcacatctcatttgattttagcaacaatcctatagctaaggtttatagatgactcattatgacagtcactggccttggccttttatatgggttatctaatataatcttcacccattctcaagaggtggctactgttttttcctgcccctgaaccctttaacaacaacaacaacaaaaaaaaaaacagatgaggaaactgaggctttattgttgttgtgtaatttgtctaaggccactcagttagtatttcttggagctagaatttgaacccctgtggactgtttcaggctcaccttttttttcttttgagatgagtctcactctgtcgtccaggttggagtacagtggcacaatctcagttcactgcaccctctgcctcccaggttcaagcgattctcctgcctcagcctcctgagtagctgagattacagttgcacgccaccaggcccagcgaacttccatgtttttagtagagacaggagtttaccatgttagccaggctggacttgaactcttgacctactcagcctcccaaagtgctgggattataggtgtgagccaccatgcctggctccaggctcaccttttttttttttttttttttttttttggagacagtctcattctgtcatccaggctagagtgcagttgcacaatcacagtgcactgcaaccagcctccgcctcctgggttcaagtgattctcctgcctcagtctcctgagtagctgggattacaggtgcccgccaccatgccggctaatttttgtatatattgtagagaatgggtttcgtcatgttgcccagtctagtctaaaactcctgagctcaagcagtcctgcctcagcctcccagagtgctgggattacaggtgtgagccactgtgcctggcccaggctcaccttcttaaccactgtgctagaaactacctcactttgagctgaagacactgatttgcctgaggtcacacagatggtaagtggcagagaaaggactctgatttcctatttccccggggctgcatattctcatgcccttgccctccagtgtatattttcagagggcagagatatatatacaaggtgggtgatggaaggtgagaactgaatccagggttcatagtttgtgactcattacagctttgtgcagcagctgcctgcagacttttttttttttaaactaaaaacactcaatactttcaagaataatttgatttttaaaattgttcttgaggaccaaagagaatttctttggtcccatagttatttagaattaatagtgttttgactgtctaatgggaaacaccatgtccatttcacatcactaaacatcaggatatattaacaagttatattctcaaaactgaagtcagaattatgtagcttttgtaacatgtacatgggaagaggattagaagaggctttcttcagtaattctaaggcgattagtataaactggcaggactaggaaaagaacggtacagactgtccgtgaattcagcacttaagcacatttgacttttgaactccacacttttgttgtttaaatacattactacccccaaacaaccatggttccttgaattcagacattctgacaaatgaacaaactcatctatggtggtacttgcccaccagccaaaaattcaacaactatcagcattaattagtgtttactggtgggctgactgccctattaggtaggtaagattattgtgatcaaactgaagcctagagattaacttgctcaaggttgtagctaccaagttgtagagctgggatttgaacatagacattctcactgagagctcagctcttcaccaagttcagattcagtagcatcactgtctttgtacaacagtatttgtactgccaaggtttcaggatttattttacaattgtgttggaaaccttgcttggggcctcagctcttgctggaattcattgagggtatatgtggacagggctatgtggtgataaattgtggtgggttgaaattttactggtggtgtctagggttggaatagcttttctgtgtgcatagatttgaaacatcttcccagtgcatctcacattactaataagtttgggtattgcatttttcgtttttgaaaacctccacccatgaccttactggaacccatacttgattatttggtctccttttgctaaaattattctcttttgctacgtagttcccagcagattttgtactcttgtgtgacttggtaagccccagtgccttctttcgttatttttttgagacaggatctggctctgtcacccaggctggagtgtcttggctcactgtaacctccacttcccaggctcaagtcatccatccacctcagcctcctgagtactgggactgcaggcgggcaccaccacgcctggctaatttttgtattttttgtagagacagcatttcaccatgttgttcaggctggtctcgaactcctgagctcaagcaatctgcctgccttggcctcccaaagtgctggggttacaggcgtgagccactgcgccctgcccattattattattatttttttaagaaggagtcttgctctgtcacccaggctggaatgcagtggcgcgatcttggctcactgcaacctctgcctcctgggttcaaacagttctctgcctcagcctcctgagtagctgggttacaggcatgcaccaccatgcccggctaatttttgtttttgtttttgttttgtttttttttttgagatggagtctcactctgtcctgcaggctggggtgcagtggcgtgatctccgctcactgcaagctccaccttccgggttcacgccattctcctgcctcagcctccagagcagctgggaatacaggcgcccgccaccacgccaggttaattttttgtatttttagtagagacaggatttcaccacattggccaggttggtcttgaacttctgatcatgtggtccacttgcctcagcctcccaaagtgctgggattacaggcgtgagccactgcacctggccccattattcttaattttaaaacattttcagtggttatggattagggaagggaagggatggagggagataataaatatttgactctgttttgttatgcagcctcctctaccccatacttttatttatttatttttctttcttttttttcttttttgtttttaatttcacgctcatatttttagataattggaagtggaattgatggtcaggtatggcacttaataaatttgtatagaatatgggaattgctaggtcagcaaattgcataatagaaatagagaaagttcaaagtagaaaaaatgtgtgcatagtctttagaatatacacacatacacaggcatgagatcccttgttttaatatgtcgtactgacctgcagtcttggattagcctggatcaggtgtaagatattttccagtgtgtctcccgggtgacagtcacttctttgctgagttaggacatttctcttgggtgcctggctcaggtaattattccactatagttcatagtttaggagttcctgaccccaggatggtgtgtgatactggtctgtggcctgttaggaaatgggccgcacagtaggaggtgagcagcagggtgttgtgggggagagcattactgcctgagccccgcctcctgtcagatcagctcttaggagtaggaacacaaaccctgttgtgaactatgcatgtgaggaatcgaggttggcgctccttatgagactctaactaatgcctgatatctgaggtggaatagttttatcccgaaaccatccctccctgccatctgtggaaaaattgtctttcatgaaatcggtccctagtgccaaaaaggttggggaccactgctctagttcataaatgaaaacttgcaggtcctcaatcaaaagtggtatttattctgacctcctcttggacagtgtggtagctttgtgagtctggtcctattttgcctcagaagtgacagggtaccttggtgagtgaagactatcttgcgtttctgtagaaaagtcacttggcacaacctatttttttccattctgaaaatatgaccatttaaaaagccctgacttactagaacttctctcaatgaatctagaacttccatcaccattggatggctgagaccacctctgccataccaaaaccttgctcataaccaaaacagtccctgttggtcttttgccctggacctgtgacattctggactatttttgtgttcagttttggccaagtgttaacaagcatacaaagctgggcacagtggtttggctgggtgaggtggctcatgcttgtaatcccagcactttgggaggccgaggtgggtgggttgcttgaggccaggagttcgagactagcctggccaaaatggcaaaaccccatctctactaaaaatacaaaaattagccaggtgtggtggcaggcgcctgtaaccccagctactcaggaggctgaggcagaagaatcacttgaacccgggaggcggaggctgcagtgagctgagattgtgctactgtactccagcctgggggacagagcgagacttcatctcaaaaaaataaaaaatagggctgagtgcagtggctcacgcctgtaatcctaacactttgggaagccgaggccggcggatcatgaggtcaagagtttgagacgagtctcaccgacatagtgaaactccgtctctactaaaaatatacgaaaaattagccgggtgtggtagtgtgcatctgtaatcccagctattcagaaggctgaggcaagagaatcgcgtgaacccaggaggcggaggttgcagtgagccgagatcgcgctattgcactccagcctgggctccagtgcgagactccattgcggggggcgggggggcagctagtgtgatggtgcatgcttgaacccaggaacttcaagctgcagtgagctgagattgtgccactgtactccagcctgggcaacagagcaagattctatgtcaaaacaaataaacaaaaaactattctgctgtcttagctgaataattcaaacaaacaacaacaacaaaaaaccctgacctagacttttaaactgaaaatgaaggttttagtgcacaaaaatattcttagatgaatacatagattagagggtagttgttgaaacatagggcaagatgaagagattagtacatttctttttttttttctgtttttggagacaaggtcttgctgtgttgtccaggctgcagtgcagtgatgtgaacatggctcactgcagcttcgacctcctgagctcaagtgatcctcccgcctcagcctctggagtagctggcactgcaggcacatgccaccatgcctggctagttttttaaatttttattttattttatttttttgagatggagtttcactcttgtcgcccaggctggagtgcaatggtgcgatctcagcttgctgcaacctccgcctcctgggtggatcacttgagtccaggagtttcagaccagcctggccaacgtggtgaaaacccatctctactaaaaatacaaaaaaattagctgggcatggtgatgcacgcctgtaatcctagctactcgggaggctgaggcaggagaatagcttgaacccaggaggtggaggatgcagtgagccgggattgcaccactgtactgcagcctgggtgacaaagctagactctgtctcaaaaaaaaaaaaaaaagttgaaaagatttggaaaaaatttaatagctggtagccatcactaatcactggttctttgaacttcctgttgtgatcactttgtattatcttttttttttgatagattttttaagatgcagtctcactctgtcacctgggctggagtgcaatggcgtgatctccactcgctgcaacctccgcctcctggattcaagtgattctcctgcctcagcctcccaagtagctgggattacaagcacctgccaccacacctggctaatttttgtattgttagtagagatgggatttcaccatgttggtcaggcaggtcttgaactcctgacctcaagcaatccaccttcctcggcctcccaaactgttgggattacaggcatgagccaccgcacccggcctgtattatcttatatatatatctttcatttttctagcagactgcccttttttcccccatacaatttgttcatttatgcattccttcattcaacatttattgagggcctgatatgtgttaggcacaatatagatgcaggaaatgagtactaaacagcacagacatagtttctgctttcaaggagcttatctccttgaaatgacagtacacatcaccattacagttatgttaagggatttgaaggaataggacagtttgccatgagagcatacaataggggcatttggactgttggggtcaggtcaagaaaaggtttcctgtggaaatgatgttttactttggacatgaaaagagaaccagggttaggcaaagagatggggagagggtggtgaagaccctgagaaaaggagcttggtccacttgaggatgtaagcaaaggcttgtgcagttggaatgaagaaatgagtgaggaagtgagatgaggctggggtgggcagcgactcagctttgtaatccattttaaggatattgaaatttgttttaaagacagtggaatcaggccgggtgtggtggctcacgcctgtaatcccagcactttgggaggccaaggcaggtggatgacgaggtcaggagatcgagactatcctggtaacacggtgaaaccccgtctccactaaaaatacaaaaaattctccgggcgtgatggcgggcgcctgtagtcccagctactccggaggctgaggtaggagaatggcgtgagcccgggaggcggagcatgcagcgagccaagatcgagccactgcactccagcctgggcaacagagcaagactccatctcaaaaaaaaaaaaaaaaaaaaaaagacaatggaatcaatacctgtgaaaagaaagaaaaggacagtggatgacattaaaaggatttaaccagaggagtagagtgataaggtgtgcatgtaaaaaagatagctctgaatactgtgtgggaaataaacctttaaactaaaagggaagcaaggccaggtgtggtggctcacgcctgtaatcccagcactttgggaggctgaggcaggaggatcacgaggtcaggagatcgagaccatcctggccaacatggtgaaaccctgtctctactaaaatacaaaaaaattagccaggcctggtggtacgagcctgtagtcccagctgctcaggaggctgaggcaggagaatcacttgaacctgggaggcagaggttgcagtgagccgagatcgtgccactgcactccagcctggtgacagagcaagactctgtcataaataaataggaggcaaatgtagaatgggtcggtcagttaggaggcattattcatttttaggttcatccttgtcccttgcaatcttgcacatggtaggtatttaacaaaggcttgctgagtgaaggaatgtgtcttctgtaatttgtattcatggtaaaagcaaggctcctattctccaacttttagaatttttaagtaaaggatattgtgtttaaagatggagctctcttctatttagcgtttttataagttgtggcaatatctttaatagtctctgaaattcttgtaggaagtggaaactgagcatactatttcagctgctaaggagaccattcatggcagctgcaagaacatgcagatgaaaaactttcctttttatttgcaaaattgatacttttcctactgtcagtatccatccctcagtaagattggatgaacaaatcccaggacctcttctccagggcatgtggacagcaggcctgcatgtgtccaggcctgctgctgcctgcatctccaaggactagtagcttctttgggaagtgttacctcaggagtgcagcttgtgcgttcattcaacaaattttgatagtgtcttgccaatgatttatcccagttcttcccaaatttctatcgttcttttacctaatctcattattttagctgcattatagtattatctgtgctatcagttaatatttttctccaaggtgacttttaaaattaaatttattttataattatattattgctatgagtggaaaacttgtatcacttgctgtaggaaaataaaactgtaaaagtaaagtacaatgaaaactaaacaatgttattaaccagattctgatacttgtgaaacttcaggacctattccttccttctggaaaaaaaaaaaggccgagtgcgacagctcatgcctataatcccagcactttgggagaccgaggcagacggatcacgaggtcaagagattgagaccatcctggccaacatggtgaaaccccgtctctactaaaagtacaaaaaaaattagctgggtgtggtggtgcgcacctgtagtcccagctactcaggaggctgaggcaggagaattgctttaatctaggaggtggaggttgcagtgaatcgagatcatgccactgcactccagcctggcgacagagtgagactctgtctccaaaaaaaaaaaaagatactagcaatttttagagaaatagtaggctagcaccaaactgacactttctccttaatgtaaaggaagtattagaaaagagattagggccaggcgtggtggctcacgcctgtaatcttagcacaatcccagttgaaccttggaggcggaggttgcagtgagctgggatcgcgcaactgcactctagcctgggcaacagagcgagtctcaaaaaaaagaaagaaagagattgactttttcactgtgagtattatctagggctgtctgcaaggactaaaaacatttcatttggaatggcactcacccgtgctttggaaaatactgctttaaccaatacatcttattgtttccattgcctgatctgtggatggctgattttggctgactcctgttattaagggaacagcaccattcctcatggccaaactacaattccccttgagtagctttttaaaaagacttactaagaagacagatttaggatatcgtttttattggcttgttttctccaaggactacttaacttatattacagatttagtaatgtaaaatgaaaataaactttcccaagagacttagcagctaattaatcacactctcctaggtccaggaaatgggagcctgatacctggctgaatgtggtaaagtgttttaaactctttcaggtgaagaaacaatctctttgataccagcgcaagtaaagacggttactgtaaatccttgtgggagccaaggcaagagtgtagtgccccaggacctgatggaaatgagaaagttgtcaggacctgaagcttctttttcagttgctcatctctgcttttctctgtgtctattcatttctctgcttggttttttttttttttttttttttgagatggagtcttgctctgttgccaggctggagtgcagtggcacaatctcagctcattgcaacctccgcctcccgggttcaagtgattcttaggcctcagcctcccaagtagctgggattacaggcgtgcgccaccaagcccagctaatttttgtactttttttggtagagacggggtttcaccgtgttggccaggctggtcttgaactcctgacctcaagggatctgtctgcctctgcctcccaaagtgctggaattacaggcatgagccgccgggtctgctcggttcttcataatgttttttcctgcttactcatcaacttacccagaacccaacatgttgacttttgtagccacaccaagctgtggctggagaagggagggttcattagcctcacccgtaagcttaatttctctagattttccaataaaggtaattgacatttttcatttttatataaatgctgtgtgaataaagagtcaagagacaactctttttttttttttttttttgagacggagtctcgctctgtctcccaggctggagtgcagtggcgcaatcttggcttactgaaacctccgcctccagggttcacgccattctcctacctcagcctcccgagtagctgggactacaggcgcccgccaccacgcccggctaattttttgtatttttagtagagatgggctttcaccgtgttagccaggatggtctcgatctcctgacctcatgatccacccgcctcagcttcccaaagtgctgggattacagccgtgagccaccacgcctggccgagacaactctttttctttgctgcacatcaatcaacttgcatccccgaaagtgccttcaaaatagaaattctggagctgccactggtaaactcagacttaaaatttttaagattttccacctgaggttccttgtaacttactgactctggctttcagttttatagttagagagtaccaggaagaaacctgatttacccagcttggatcaaatgtccaacctggggtgggctgcagttacatggtctagacatggtcatctagtcctaccccttcagcaggggcactggaaaccatttccagacaagagggcatgggcaagtaggtacattatatcagaacctcgtcaactacagaggggaagggaaaaatacccttatagtcctaacctctggtctgatccatttatgggcagaccttcagagatgggtctcatcaaagatgtttaccctttgagaaggcttcaagataggttctatgaacctggaaccttgcaggaccactgagtcagcaatgacttagaactgactcagaatgagatcagcatcaagttatgaggaagagagggtgtcgtttattgagctggtttatctttgtcagatagtttataaggacaaatgatggcctgtcagttcagctaaggatttaagaaaactggtattagatgtttaggtatttaggccaagattatgtgcttttagatatctgtgattctccaatgcctctccagaatattaggtctttggccttcctctctaaattgtgatttcctacagagtaaggcttcttatctttttacctagcattattggtgctcatcaatattaagtgcattaagtgcattgaactcatgcattcatgagactaagttttagttaagtgttaattgcagaaaaatttagtatagtaaaatgaaagtttatttctgttctgtgggacactctgagccaccagggtcatagattattttaagttgtctgtgcctttgctgatagggaactttgatgagcaaagaggaacctggtagtggtagaggattgtgaactggcctgtgttcagtcatcattgtatatttagaattgacagctactgtactgttttcccatttataacacttctcatttttcttctctagaaatgaatctttgcttttgttagactttttaaaagaattaatagactgtttttagagcataaaactgctttatggtttacagaaaaatgagtagaaagtacagagttcccaaatactccctctccccatccccatggtttcccttattattaacaacttggattcatatacgtttgttaccattgctgagccaacatgatacataattgttaattaaaatccgtaaatagtttaggcttcattctttgtgttgtgtattctctgggtttgacaaatgtatgaagacctatatccaccattacagtattatatagaatgtttcagtgccctaaaaatcccctgtgctccacctatccatcccaacctccatcctctgtcaaccactgatgattttactatctgtatagtttttcaccttttccagaatgccatgtaggagttatatagtatatagccttttcagattgggtttttttcccttagcaatatgaatataaggcttcctccatgtctttttttttctttctctctgtcttttgtgcttgatagttcatttcttgtttttttttttttgtttgtttgtttttgttttttttttgagacaaggtcttgctctgccacccaggctggagtgcagtagtgcaatcatagctcactgcagcctctacctcccaagctcaagcagacctcccaagtagctgggactataggcatgcgccaccgtacctgacaaatttttttaattctttttttttttagacggagtctcactctgtcactcaggctggagtgcagtggcgcgatctcagctcactgcaagccccacctcctgggttcacgccattctcctgcctcagcctcacgagtagctgggactacaggcacccgccaccatgcccggctaattttttgtatttttagtagagatggggtttcaccgtgttagccaggatggtctcaatctcctgacctcgtgatccgcccgcctcggcctcccaaagtgctgggattacaggtgtgaaccaccgcgcctggccaaatttttaaattttttctagagatggtgtcttgctgtgttgcctgggctggtcttgtacttctggcctcaagttatcctcccgcttcagccttcctaagtgctgggattgcaggcatgagccaccacactcagcctaacacaattttatggtgggtctccatattccttaaaacttgaaatgtatcagctgggcatggtggcacactcctttcacacatgtactcccttcactttgggaggctgaggcgggcagatcacttgaggtcaggagttcgagactagcctggccaacatagtgaaacctcatctctagtaaaaataccaaatttagctgggcatggtggtgcacacctgtaatcccagctactcgggaggctgaggcaggagaattgcttgaactcaggaggcagaggttgcagtgagtcaagattgtgccattgcactccaacttgggcgactgagcaagaccctgtctcacacacacacaaaaaagtactattttccctacatccttgcctactcctgctattattgaaattcattccctacctcccaatcttatgggtaaaactttctcttatttttttcttcagcaaattagacttaactctgtggcaaagtcagtactcattaaatatatttcattgaaggaacatagtccacttggtagatttgaggcctgaatactagaaaggtttcttttttggtttttattttaatttttaaaagattttaagattttggtgactaaactcattacttatccatggataaaaatattaatgtcatctcatctaaatatgtatagtcttgaatcttcactaaggactacatagtgtgattatattacttgtagatgagagatgactatagggacgtaagtttgtattcttttttttttttttttttttttgagacagagtctccctctgtcgcctaggctggagtgcagtggcgccatcttggctcactgtaagctccgcctcctgggttcacgccattctcctgtctcagcctccccagtagctgggactgcaggagcccaccaccacgcctggctaattttttgtattttttagtagagacaggttttccaccatgttagccaggatggtctcgatctcctgacttcgtgatccacccacctcagcctcccaaagtgctgggataagtttgtattcttgaccgtcctagccatttatagttaaaattagatccataatgtttttatttgttgaaaaaaatttttaaattaaaaaaaaaagtttttttgaatcagggtctcactcagttgcccaaactggagtgcagtggcacgaccgtggctcacactgtagcctcaacttcccaggctcaaatgatcaccccacctcagcctcctgagtagctgggattacaggtgcatggcaacatgcctggctaatttttatatttcttctagagacagggtctcactaagttgtcagagctggtctcgaattcctgggctcaagtgattcacccaccttggcctcccaaagtactgggattacaggtgtgagccactggactgtgcccatgatgtttttattattttgttttattattattattttgtgttattacttttttctgaggcagggtgtcactgttttgcccaggctggagtgcagtggcatgatctcaggtcactgcaacctctgcctcccaggttcaagcgattctcgtgcctcagcctcccgagtacctggggctacaggtgtgcatcaccactgcctggctaatttttgtagttttagtagagttggggtttatccatgttgcccaggctggtctcgaactcctggcctcaagtgatccatctgcctcgggctcccagagtgctgggattacaggtgtaagccaccacgcccggcctccatgatgttttatatagcaaattaagatattttccaaaatatctcataccagttggtgcattttttatatttgttattgaaggaatataataactgtcacataatttgttttttcatagattatcttgacaatggtaataataaaatggcaattcagcaagcagataaactgttgaagaaacataaggatcttcattgtgctaaggtaacttcatttgcccttcagttacttacctgtggcgggttatatttgtaattccttaccttaaagagaaaggagggccgggcatggtggctcaagcctgtaatcccagtactttgggaggccgaggcaagcggatcacgatgtcaggagtttgagaccagcctgaccaacatggtgaaaccctgtctctactaaaaatacaaaaattagcctggcatggtggcgtgcgcctgtaatcccagctactcagtaggctgaggcagcagaatcacttgaacccaggaggtggaggttgcagtgagcggagatcgcaccattgcactctagcccaggtgacagagtgagactccgtctcaaaaaaaaaaaaaggggggggagaaaggatgttaaatctctttagtgactattagtgtcttttgtttttgagatggagtttcactcttgttgcccaggctggagtgcagtggcttgatctcaggtactgcaacctctgcctcccagattcaagtgattctcctgctttagcctcctgcgtagttgagattacaggcatgcgccaccacacccagctaattttgtatattttttagtagagatggggtttccccatgttggtcgggctggtctcaaactcccgacctcaggtgatcctcctgcctcagcctcccagagtgctggggttacaggcatgagctactgcgcccaactgactatttgtgtttttttctcggtactttataggtcagttatttccatagtcacttacatgccacaagtggtatttcttttttcgttttttttttcttttttgagatggagtcttgctgtgttgcccaggctagagtgcagtggcacgatattggctcactgcaacctctgcctcctgggttcaagcaattctcctgcctcagcctcctgagtagctgggactacaggcgcgtcctaccacgcccggctaatttttttgtatttttagtagagacggggtttcaccgtgttagccaggatggtctcaatctcctgacctcctgatccgcctgccttggcctcccaaagtgctgggattataggcgtgagccactgtgcctggctgtgatatttcagtaaaagctagctgtttatttctttgcatattacttacctaatttattttcacagaatccttttaagcaatattgtgcacttctttttttgagacaaggtctctatcacccagcctggagtgcaatagcacaatcatgactcactacagccttggccttctaggctcaaatgatcctctcatctcagcctcctgcatagctgggactacagggtgtaccaccatgcctggctttttttttttttggagataaggtctctctcaccctgttgcctaggctggactgcagttgcctaggcatgatcacagctcactgcagctttgaccccccggactcaagcgatcctcctacctcagcctctcgagtagctgggaccacagatgtgcaccaccacacctggctaatatttaaactttttgtaaaaatgggatctcaccacgttgcctacctaggctagtcttgaatttgtgggctcaagcaatcctcccgcctcggccttccaaagtgctggggttacattcgtgagccattgcacctggcctatttttttccttcaaattttttctagagatgaggtctcactgtgttgcctaggctggtctcaaagttctgggctcaagtgatcctcctgccttagtctcccaaagtgttatacgcatgagtgcaccatgccagtcctattgttcactttttttttttttttcgagacaggatctccttctgtcacccacgctggagtgctgtgacgtgatcaacctcccgggctcgaggagtcctcccatctcaacctgtcaagtagctgggtgcacaccaccatacccagctaattttttattattttttgtagagatggagtctcaccacgttgcccaggctggtcttgaactcctgggctcaagtgatgtgcctgtcttggcctcccaaagtgccgggattacagatgtgagccgccgcacccagcctgaaactagtatatcagcaacctaggcataacttaatacttgttctttcagatcggctttctttggttcatatttccttttctgtctttttaaaaactgatttttcttttgttgctatcaggttttaaaggcaattggtttacagagaactggaaagcaagaggaagcctttactcttgcacaggaggtggcagcccttgaacccacagatgacaactcactgcaggcactgactatcctttaccgggagatgcaccgacgtatgtttctttcttttcattgtttttaaacttgagctgaaaattttggatatttctgactgtttgcccttgtctgatttctcactcatgatttgaatggatacagtaggtagaataacgcattagccagggtttgcgagaactgtagatagaaaggatagtttacatgcattaggatccttgaattggaatgagaattaaagtgacttcatttgtgatattttgatctgctaaatggaggcttcacccttattttcactttttaatatggaaaatttcaagcagacaaaaatagaatagaataataaaccccattgttctcattatccaccttcagcaattaacacatggcccattttattttgtttttaccctttcccctggcagattacttcagagcatatcctaagtagtccattgtttcttctgaaataaaggtttttattgttaatttcttaaatattttattgtgaaatcatacatatttttcatagtacatattatacaataatcttgtttatgtaacatataagtacatttgatgtgtaataatgaaaactcatgaacctaccacctaatttaagaaatggagcgttgccaggcgtagtggctaaaacttgtaatcccagcactttggatggccgaggctggcagatcatttgaggtcaggagttagagacagcccggccaacatagggaaaccttgtctctactaaaaatacaaaaattaactgggtgtggtggtgcacgcctgtaatcccagctacttgggaagctgaggcaggagaatcgaaacttccaccttctgagttcatgcatcctctcctgcctcggcttcccaggtagctgggattacaggcatgcaccaccatccccagctaatttttgtatttttagtagagacgggtttcaccatgttggccgggctggtctcaaactccttacctcaagtgatccacttgccttggcctcccaaagagctgggattacagccgtgagccaagtgcacctggcctcctcaatcaatcttaattctccttttacctaccaagagttactcgctatcctgaatattttttattctcttgcttccctttaaatgtttattacatttatttctcttagtaatacattattagttttgcttaattttaaacttttgttagtgcatctgtactatgtatattctatgacttgcatttttcatctaatagccaagtggctatagttaatccattttcactaccacaaaatatttcactgggttacattacaatatctaggagtagaattttcaagtcatggggtaagtgtatgtttagcttaaagcaagataatgtcaacttcttttataaatagaatagcagtttttgagttctgattgcttacatgcttgtcaacacttggtattctttctctcttcattcattcaaatagctcagattgtaacatttggtatttgtaaccttaatcatttttgccaatttcttttgagacaggattttgctgtgttgtccaggctagtttggactcttaggctcaagcaatccgcctgcctcagcctcccaaagtgctgggattataggcacgaggcactgtgctcagcttcaattttgtttttaatttttacaaaagataaaacctaagagttgaggtattatatctgagtatttacagattgtgttgatttagggatatggattcttctccagtgttttaaaaaaaatcatttactccacaaatattggtggcatgtttctctatgactggtattctatcagagtcaaagataaaaaatgcactttcagccgggcgcagtggctcacgcctgtaatcccagcactttgggaggctgaggtgggtggattacctgaggtcgggagttcgagactagcctgaccaacatggagaaaccccatctctactaaaaatgcaaaattagccgggtgtggtgatgcatgcctgtaatcccagttacttgggaggctgaggcaggagaatcactcgaacccaggaggcagaggtttcagtgagccgagatcgcaccattgcaatccagcctgggtaacgagcaaaactctgtctccaaaaaaaaaaaaaaagcactttctgttgtcatggcactcattgtctataaggggaaatagatcactagacagtatactacattatgtgttaataaatgctatagtacagcctgggcaacatggcgaaacactgtctatataaaaaataagccagttgtggtggtatgtgcctgcagaacagctacttgggaggctgaggtcggagaattacctgagcttgaaaggtcgaggctgcagtgagccgtgattgtgccattgcactccagcctgggcgacagagtgagaacctatctccaaaaaaaaaaaaaaaaaaaaaaaaaactacaatatacttacttatataagattccaagatggcagagggaggcagtggtcaaattgcagtggagaagcagagatggtgttcagagaaagtcttacagttcagcttacatttgaattgggtcttggctgatgttcactaagataaaagagagaaaaggagaattcaggcagagcgaagagtttagaggcatagagttatgtatgatacatcccagagaatctggtggaactacaaatagtttgtggctacatgataaagtgctgagggaaagaggagacagaggccagatcctataaggtcttatatgttgtaaatgctatgagaaggcttgacctattccatgcttcatttaaacaccacctaaccaagagatgaatgatgattggatgaggcaaagcagatacttcttctataatgataggagacatctatttctgccaaataggaagaacattaaatgccattagaatgttcttgaagtataacttaaatcttatttctctttatcttagcggagttagttacaaaactttatgaggcagctgtgaagaaagttcccaatagtgaggagtatcactctcacctcttcatggcctatgccagagtgggtgaatacaagaaaatgcaacaggtaatttgatccccaaacctactgggctatgggatttactattagaggcaaaagtctctttcttgtgatttaactgcactgggtatgtgtgtgtgtagaattgaatttatggatttttctgtgtggaggtcagtcagttgttttccttatgtgtttaaagttgaactattattcaagatctttaaatgttttatttggaaataagttgattgttcttttgtggcctgatgttatgttttgtttggttttggtaattcagcttcagattgtcctactgcatcagattgctgttaaattttcagaaaatgagcagatataccagagcaaaaaatgaacaactatggaaagagtaactttaaagtttacatctaatttgtaaatttaaactgttgatagcctgctaagatttttaagtccaccagggggaaaatccttgttgcctgggatgtttctttttaaatttattttttgttttttgttttttggtttgaggcagcttatttggcagctaccatattgtagatattctttacatacatctgaaggagcctcatttgaacacatttgaattaggttgcgggtaaagctaacatctcagagaaatataatcagcattattaattccataaatggctctgatgttaagctagtatttttttttttttttttttttggagatggagttttgctgttgttgcccaggctggagtgcaatggtgcgatcttggctcactgcaacctctgcctcctgggttcaagctattctgcctcagcctcctgagtagttgggattacatgcttgcgccaccactcctggctaattttgtatttttaatagagacagggtttctccatgttggtcaggctggtctcaaactcccgacctcaggtgatctgcccgcctcggcctctcaaagtggtgggattacaggcatgagccaccacacccagcccaagctagtacttttttagaaatgctttctttgtgggtataatatcttctgaaggcaaaattttttggatttttatcttattctttacattaaatatcaagttataacaatagataatttgggcagggtggcagatactatattaatataaactctttcttaaaatcagtctctatattttaagtttatgcaagttttaacataggagaagtttttttcttcttttttcttttttgtgatggagtcttgctctgttgcccaggctggagtgcagtggcacgatctcggctcactgcaacctggcctcccaggttgaagcgattctcctgcctcagcctcccgagtagctgggattacaggtacacaccaccatacctggctaatttttgtgtttttagtagaggcgaggttttaccatgttggccaggctggtctcaaattcctcacctcaagtgatccacccaccttgggctcccaaaatgctgggattacagatgtgagccagtgcgcccagctggagaaattttttgaggggtcccaatgtaattatttaataacattttgttaatttatttactgaaaggtatttagacattataatttttaaaaatgtaaaatggttatgggtgtgtgtgtgtgtgtgtgtgtgtgtgtgtatatatatatatatatatatattttttttttttttttttttttttttttttttttttttgagacagtctcactctgtcacccagggtggaatccagtggtatgatctcgtctcactgcaacctccacctcccgggttcaagcgattcttctgcctcagcctctcaagtactgggactacaggcacatgtcaccacacccggctaatttttgtatttttagtagagacggggtttcaccatgttggccaggctggtctcgaactcctgacctcatgatccgctcgcctctgcctcccaaaatgctgggattacaggcgtgagccactgtgcccagccataaaatgggtatattttttaaaattggcaatgctaacatatatacatataaatccttaatatcatttttatttgtaagattatgttttaagcaaagtatattaaatattcattcataaggatagagtaaaagaagttatagttcatccctatggtacataaaatacattcccacatctctccaaataatactgggtgtctttatatggttgacatataaagatgttcctagtatatgttaattgagacaagcaggttgtaaaatgaccttctcttcccattcttctcatgttgtcctcaaaaaagatatacttcttttctttcttttttctttttctttttttgagatagacagactctctctgtcacccaggctggagtgctgtggcgtgatctcagcttactgcaaactctgcctcccaggttcaagagattctcctgcctctgcctcccgagtagctgggattgcaggtgcctgccaccacacttggctaatttttttgtgtgtgtgatatagtcttgctctgtcgcccaggctggagtgcagtggtgtgatcttggctcactgcaacctccgcctcctgggttcaagcgattctcctgcctcagcctcctgaatagctgggattacaggtgcacaccaccatgcctagctaatttttatatttttagtagagatggggtttcaccatgttggtcaggctggtctcgaactcctcacctcttgacccacctgcctcagcctcccaaagtgctgggattacaggcgtgagccactgcacccacctaatttttgtatttttaatagagatggggtttcaccatgttggccgggctggtctcgaactcctgacctcgagtgatctacctgcctcagcctcccaaaatattgggattacaggcgtgagccactgcacctggctaatttttatttatttatttatttgatatggagtctcgctctgtctccaggctggagtgcagtggtgtgatcttggctcactgcaacctccacctcccaggttcaagaggagatcctcctgtctcagcctcccgagtagctgggactacaggcacgcgccactaagcccagctaattttttgtatttatagtagagatggggtttcaccatgctggccaggctggtctcgatctcttgacctcatggtccgcccaccttggcctcccaaagtgctgggattacaggcgtgagccactgtgccccgcccacgcctggctaatttttatactgtcattattgctgcttaaggaagttacaatttcttagcttaagtatgtttattttgagtgtggaatgtcagtctgaggtaataggtatttcacacatttaatgtcatgtttcatatggatgaaggtttttgtttgatttgttcattgttgattttccattgcctagaatagcatctgcacaataatttgttaagcaaataaatgatttgtataaactcgtggaggtaggagggagggaaacttaagagcttctgctgccccaaataacatctctggctggtgattttgaaaccaccataaatgaagagtagctagttattcatatggtgataaggcttttcttttcctgtaaatgacattctcattctgagtcaccaacttagatccatgtttttaaacttgtctgtcatcaaaaattttgtttcagcagattatcagagcctgcaagatcatagggtatggacatgaaatttttgccttgcattttatattaattcatattctaatgttatatatttttatctctgtatgtcattgtaaaaatgttttcccatattctcaagtaaaatgaatttcctaacttttatttatttttaagcatttattcattttttgtagagttgggatttcgctatgtttcccaggctggtcttgaattgctgggctcaagcagtcctcctgccttggcttcccaaagtgcagggattacaggcatgagccactgtacccagccggttttctaactcaaagacaaaattattattttttcttttgattgtaaaatcttcccagggatcaatggaatttcctaacatttttcattttatacctgtggagtatacgtaccccagtgttagaagcaggtgcctcaagccatcttagactctcctatcctgtatgtccttgtcgtctctagatcatgtttattctgccgctgctgtatcttttttttttctttgagatggggtttcactcttgtcgcccaggctggagtgcaattcagcaccagctgaattgcagtggtgcaattccggcccactgcaacctccacctcctgggttcaagcgattctcctgcctcagctccctgagcagctgagattacaggcacccaccaccacgcccagttaattttcatatttttagtagagttggggtttcaccattacttttatcttttaccttaactttattggccaagttggtctcgaactcctgacctcaggtgatcttcctgccttggcctctcaaagtgttgggattacaggcgtgagccacggtgcccagcctctgctgtatctttccaggtttcttttctatttgatctaccccatcctggttttgtgcctcatcacctcaccttttctttcttcctattttgtctcttcacagtactgctgagatactgttcctagaagagtatagatttataaatatcacttctctattctgtataggctccttttttaataccttacaacaaaagtaccttggtctacctttcaacacttttcctgctactcttaattgttttagccagacatcctacttgttttatcagcatacatccctttactttcttgaatgttttttgttcagactcatttttctcctacttcgcgttgatacatttacccattcacctcaaatatttgtagttttatatgtatcgttaccacaccccgcaccccccaccccccgccccctgccaccatgttatgtttgaccttcaaagtcatctgaaagatggctactttggaggggctttaatgataatgttctcctctctactttcccttaaagaaagaagaggtaagaaaatgaacaattttgccttccttggaaataccctaggatggtgttttatataggacatttatttttatatttagttttattattttgattttgagacagatttgattttaatttgttgcccaggctggagtgcagtagtgtgatcatagctcactgtagccttgacctccctgggcttaggtgatcttcccacctcagcctcttgccagtagctgggaccacaggtgcttgccaccaccctggttaacatacatatatatgtgtgtgtgtaaggttttacaatgttgcccaggctggtctcaatctccttgggctcaaatgatcctcctgtctcaacctcccaaagtgttgggattacagtcatgaatcatcatggctggcctaggacatttattttttatttttatttatttattttttggagacaaagtcttactctgttgcccaggctagagtgcagtggcacgatctctgctcactgcaacctctgcctcccgggttcaagcgattctgtcttagcctcccaagtagcttggattacaggtccctgctgccacgcccagctaatttttgtatttttagtagagatggggtttctccatgttggctcagctagtctcgaactcctgacctcagatgatctgccagcctcggcctcccaaagtgatgggattacaggcatgagccattgcgcctggcccaggacatttatttttattgctaaatacatttcagtcatttatgtatttgttttctcccccgcttttaaatgcctttgggacagggacgcgatctttgaatctttgtcaggaatagatagtttcttctacttcataggacctccatgtaatttttgaattagattggcagtaggcaaaagattaaaaaacatatgaaaattacctgatggagtttttagcatcaattactagttggctaattatggatagagtctcaattatgcttgaataggtctattcttttttaaaagcatgttcttgcttttaagtatttgcatattatacatttcataatgaaagatttcagttctaattattggaatcttgaaggaaccatattattttcctaagctaagaagaatttttgaattatggcatggtaatcttttctgatattgaagtttaagtatattctctgggcatgtttatttgtttttgctaataactggttagtatggtatcttaagtaaagtttattgatgtacacttacaagccaaattttgtgtttgctttgtagtctcctagaactatattggattgcagcatattctggaaatgttggactttaattttagtaaattctggttcaaaaagtaaagtatcactcataacatgaaaattcacctttgtgattactgctgttgctaaagccatcaagtcactaggaatttacactaactgggatatgtaaatatattgctgttctcccaagaaactttttgtcgtgtatctagatcattaatccccttctgtatggtgttttctaaataaaatatttatggttctcttttaggctggcatggctctatataagattgtccccaaaaatccctactacttttggtctgtgatgagcttaattatgcaagtgagtatggcattcagaatgggattgaggtttggttttattttttatatagttattgtcctcagtgtgtcttctgaactggttttttttgtttgagacagggtcacgctgtcacccaggcaggagtgcagtggtgcaatcatagctcactgctgccttgacctcctaggctcaagcaatccctctacctcaacctcccaagtagctgggactacaggtgcacaccaccttgcctggctaattaaaaaaaatttattttttggtcaggtgtggtggctcacgcctgtaatcccagcactttgggaggccaaggtgggtggatcacgaggtcaggaaatcgagaccatcctgaccaacatagtgaaaccccatctctactaaaaatataaaaattagctgggcatggtggcatgtgcctgtaatcccagctactctggaggctgaggcaggagggtcgcttgaacccaggaggcggaggtttcagtgagccgagatcatgtcactgcactctagcctggcgatagagcgagactctgtctcaaaaaaatgttgtagagacagggtctcactcttttgaccaggctggtcttgaactcctggcctcaagcaatccttctgcctcagcctcccaaagtgctgggattacaggcatgagcctctgtatctgactgtgaacattttgtgtaatgtgttgcagcatgtcaaacagggactttgtgttgtcaattgacttaagttaggggttttgagttttttgggttttttttttttttttttttttgagacagagtctcgctctaacccaggctggagtgcagtgacgcgatctcagctcactgcaagccccacctcccaggtttacgccattctcctgcctcagcctcctgagtagctgggactacaagcatctgctaccatgcccggctaatttttttgtatttttagtagagatggggtttcaccatgttagccaggatggtctcgatctcctgacctcgtgatccgcccgcctcggcctcccaatgtgctgggattacaggcatgagccaccgcgcctggcccttgagtattctttatgagttggtatatcagtttatttgtgggtagcatggactgtatttcccctgaatctctaatctattgctgggttgcttgatcaagcatgagccttgaaatgtttgatattacaacttgaggtttgcttttaagacaatattgctgattagttaatggctcattgaactgggtggccttcttttatcacttctcctttctgagcctcagtttgctcttttgcagaaaggagacacttttctcccagggaccaaagtgagattctgtataggagaggatggggaggaaggatttaaaagtagtgtttaagaacagatgttatggggtcagacaggtctgccttcatacattagctttaccgcatgtctggtaaagctgtctggggaatttcttaaccttagtttttttttttttctgttgtccaagctggagtgcagtggcatgacctcagcttactgcacctcctaggttcaagcgattctcatgtctcagcctcccaagtagctaggattataagcatgcaccaccacacacacctagctaattttttaaattatttttcagtagagacgggggttttgccatgttggccaggctggtctcaaaatttctggcctcaagggatccacctgccccagcctcctggagtgttaagtttacagtcatgagccaccacgcctggcctaaccttagtttctttgtaaaataagcataatatctaccttgaaaggttgtttacaagggttaagtgagctgtgagcagaatctggtgttattaactttattaatttcatgtgttaattgttgttaccaatttaaggtaactagctactagtaaactgtgtaatgaaaggaattggcatttctcttctagtatgtgaacatctcaaagatacctggaaggctttcctcttcaaatacctgataatactcataaataataaacagcataggcatgctccctctttacattcttctagaaaaatgtataaataaccgacttaaatgctaggttgtattgtggaagctcagtatttcaagaacacataggataatgaatctttagcaaagaaatcttttgtaaaacaaactgctccgtaatgtacctccttggcagggaattcatattaggtctgatatttgacatggtggattgataattatgtgcccaattaacagtaatgttaatatcaatagtgcaagcaggggagaattagaatgaaacattatttttcttctttcagtctatatcggcacaggatgaaaacctctcaaaaacaatgtttctgccccttgctgagagaatggtcgaaaaaatggtgaaagaggacaagatagaagctgaggctgaagtgagtattttaagccttacttttgtgttttcatttttttgctagtgctacaatattatgttataatactatgaactgttgttttgttccagtttgatagctgggtcctcacttttggcctttgggtaaatctgaagccctcagcgtaggtctaatcactgacctgtttccagcaagtactctaggctgagatgtgtatagacgggagagatatagatggagaagatcctgttacctgcttcgtactgtcagtttcatctcatttgaagacatgctctattaaataactttttaaaaacctataaatgactgtctttttattattgaaaagtttcagaggttgcacttcttgttttttttctgtaaggttgaactttattatatgatcctggaacgtttgggaaagtaccaggaggccttggatgtcatcagagggaaattaggaggtaatttttaaacattttcttaaagctttttttttttcctatttaaacatgaaaaatgtttattgtagaaaatttccacataaggatataaagacataaacacttttgatcattttgttatattcttccagacttttctgtatgttgtaaatttatttttaaaaatgtttttacttgaaaataacagattcagaaacttcaaggagtgtgaaaggttatactccagatctctagccgtcttcccctaggttttcctccagttacactttatattcttgtaaagattcatcttccccacttttttttttaaacacgaatgaaaacataatatacctggctcatagaataatcttattcagttagcacaatgtttttatttaaaaaaaatttttctttaaaaattttaaattaattaatgcccctctagtcaggatttgtactctgtagataccgcaaacattccttctttatttgtatgtctgtcttatgaaggcatttgagtttgtgacctctgctgtgcatactcttatacccatactttatttttattatttatttatttattttaaagagatgaggtctcactgttttgcccaggctggacttgaactcctgggctcaagtgattctcccatctcagcctcccaagtagctaggacgacgggcacacaccaccacactgggctccattatttctttctttctttttttttttggagacagagtctcactctgtggccaggctagagtgcagtggtgcgatctcggctcactgcaacctctgcctcctgggttcaagtgattctcctgcctcagcctcgtgagtagctgggactacaggcacacaccaccacgcccagctaatttttgtatttttagtagagacggggtttcaacatgttggccaggctggtttcaaactcctaacctcaagtgatctgcctgcctctgcctcccaaagtgctgggattacaggtgtgagccaccacgcctggcctccattattttattattattattattattttaactaaatagtatttcctagagataaagttcactacctcactcctttaataactgtccagtgttccacagtgtgaatgtagaaatttacttaaccagtttttgatggatatttaggctactcacaagaaacttcttgtttttttttgttgttgttgttgtttttgagacagggccttgctctgttagccaggctagaatgcagtggcatcatcacagctcactgcagccttgatctcctgggtttaagttatcctctcaccacagcctcctaaatagttaggactccaggcgtatgccatcaaacctggctaatttttatattttttgtagaggtggggtctcaatatgttgcccaggctggtctcgaactcctggtctcaagcgatctgcctgcttcagcctcccaaagtgctgggattactacaggtgtgacctgtcaggcctggcccttttttttttttaaactacattatagctctatggatagtaaaaagttagattctcaacaggaaattcataatgtaatttttggtatccttaatctgctaaacagttgggcaaatctaatttggtcagaactatcatcctagtttttttgttttcagttgtttggaaagatttgattcctctccactcttttttgtcttcttccaacatctcatctttcttagctcatgtcagctcagtcctctttgatgttttggaactgtatggatgggcagcttgtctatggactaaatttactagtccctagatgctgttgggattttataagtatatcccatgtactattaatagatgttcaacccaatacattgtgaaacctatccttttacaaagaaaatgattataaaaatttactgtcagtaatgtacttttttctttgaagtaaaataatctttaataagatagtagtagtttgtatgtaatagtggtcccattttctaagagagtgaataagaaaatgtgacatttaggccgggcccggtagctcacagctgtaatcccagcactctgggaggctgggatgggtggatcacctgaggtcaggagtttaagaccagcctggccaacatggtgaaatcctgtctctactaaaaatacaaaaattagccaggcgtggtggcagatgcctgtaatcccagctacttgggaggctgagacaggagaatcgcttgaatccaggaggtggaggttgcagtgagccaagatcgtgccattgcactccagcctgggtgacaagagtgaaactccatctcaaaaaaaaagaaaagaaaatgtgacattttccttcttgtggttggactctattctggttattgagcagaaatgaaaccagcttaccaacttttataacttttgattttagagaagttgacaagtgagattcagagtcgggaaaataaatgcatggctatgtacaagaagctgagcaggtggccagagtgcaatgccctttcccggcgcctcttactaaaaaagtgagtaaaagctttcttttgtaccatttgactgtagtgaggctttaagacctcactattgattttcttggtgtctgtgttttgaagtttctgggcataaagtcttcttatagtagttgtgtcctgcatgtttctaaaagtttttaaggagccttcatctttcagtagagtattataatggtacttgtaggctgggcatggtggctcatgcctatgatcccagcactttgagaggccaaggtgggcagatcacttgaggtcaggagtttgagaccagcctggccaacatggcgaaaccctgtctttactgaaaatacaaaaattagctagttgtggtggtgcgtgcctgtagtcccagcccctcgggaagctgaggcacaagaatcgcttgaacctgggaggcagaggttgcagtgagctgagatcatgccactgcactccagcctgggtgacaacaatgagactccatctcaaaaaaaaaaaaaagatacttgtgccaccatggtgctgaattctagttagggcttaagaatgaacactgaaaatcattaatttctcaaattcagtattcccctaaaagagagaggcttcattctttgctacaacacttctctccccttccctctattttggaagtgcttatgtggggacttttctgttatgaatattagttttctagacctggtcattttattgaaggaaagagtagtttactactctttacaaatacaaagtagtattactttgaaaatgcccttttagatttgcaaaggaaacatggagtgggtgggggtaagccaacctactacatactaaaatataacttacaaaataaattgaatatcatggttcctaaggaagatctgtcacaacttgggtttaatcctgtgtgcatcattcaatctgattttagctcagatgactggcagttctatctgacttatttcgattctgtctttcgactgattgaagaggcctggagtcctcctgctgaaggtgaacagtaagttgtcttctttcctgaattataacagcactttttaatatagtgtagtgaaaggatttcattataagccaattgaattctctttttctgtctcaataaagtattcctttcaaagtaagacattttttcatattttttaaagtataaaatacacaagttcattctaaaaatcatgttagtgccaaaatatgtggtgtgctaatttccacttatcctaccattccaaaaataactcttgttaatagtttggtgcctttccgtgagatttatttccatctttatgctaagataatttttctttttctcctttttttttttttttttttttttgagatggagtttggctcttgtcacccaggctggagtgcaatggcacgatcttggctcactgcaacctctgcctcccagaagcaagcgattctcctgcctcagcttcccgaatagctgggactataggtgcccaccgccgtgctcagctactttttgtatttttggtagagacggggtttcaccgtgttggccaggctggtctcaaactcctgacctcaggtgatccacccatctcagcatctcagcctcccaaagtgctgggattacaggtgtgagccattgcgcccggcttaattattcttatatttaatataaaaatgggattgtattagacacgatttgcaacctgttatttttcagccttgaaatatatcttgaacatctttcatttctggtacatgtagatctctttcattttttttccccccagtggcttaagagtactccagatgtaccataattcatttagcattttccctattgatgatacttggatttttgaagatctctttttttttcctttgtccttttgttattggctattgtaggcagtactacaataaattttttttcctttttataggcatctagagttaaatgaataaatggggccgggcacagtggctcacgcctgttatcccagcacttcgggaggtggaggcgggcggatcacaaggtcaggagatcaagaccatcctgtgaatggtgaaaccccatctctactaaaaatacaaaaaattagctgggcgtggtggcgggcgcctgtagtcccagctactctggaggctgaggagggagaatggcgtgaacccgggaggcggagcttgcagtgagccgagatcgtgccactgcactccagcctgggcgacagagcaagactccctctcaaaaaaaagtgaataaatgggatcttttaaaaaattaatacagaagtaaaattcaagatgacagttatgagctgatgcttgcttcgtaatattaactaggttacctaatttttctcagttttcattcttaaagcaataaaatgtacaagaccccatctcaaaaatatatgtgtgtgtgtgtgtgtgtgtgtgtatttaatttttaatttttgttttttttgagacagggtctcactctgtcacctaggctggagtgcagttgtgtgatcttggctcactgcaacctctgcctcctgggctcaagtgatccttttgcctcagccccaaaagcagcttgggactacaggcatgagccaccacgcctggctaatttttgtattttttgtagagatggggttttaccatgttgcccaggctgatcttgaactcgtgagctcaagtgatccacctgccttggcctcccaaaatgctaggattacaggtgtgagccaccgtgcctggcctttttttctttttgagatggggtcttgctctgtcacccagtctggagtgcagtggtgtaatcttgcctcccactgtaatctctgcctctcaggctcaagtgatcatcccacatcagcctcccaagtagctgagactacaggtgtgtgccaccacaattggctgctttaaattttttgtagagatggggtctccatgcattgcctaggctggtctcaaactcatgggcccaagcagtcctcccacctcagcatcccaaagtgctgggattttaggtgtgagccaccacacccagccttatatttttattaggcaatttttttttcttttcttttttttttttttgagatggaatctctctctgtcacctaggctggagtgcagtggcgtgatctcagctcactgcaacctctccctcctgggttcaagcgattctcctgcctcagcctcctgagtagctgggactacaggtgcatgccaccacgcccgactagttttttatacttttagtagagatggggtttcaccatcttggccaggctggtctcgaactcctgacctcaagtgatccgcccacctcaggcttccaaagtgctgggattacaggcgtgagccaccacgcccagccaggcagtatttcatatatacaaaattatgcattctttttttaaaaaggtaagttatgctgcagtaatcaaatgccaaaattgagagtaatcttataacatgttatctgttagaatatgttcatagttctcttttattcctttttctattattttatattatcaaagtcgtttttctctttttaaatgagtttggcttgactttaagcttcgggaaggacaatagaggcaataaaattcctttttcatgtgcttttcctcagctctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtaagaaaccatgatatctggtaagcctggagaatgcccttaatacccaagtgctatattcattagttgagatctacactggacagagtcatgtttgggaagcagatgtcttcatagcctgaaaatatttgctaatgaatggatcacttataaaattagtcctttatcatatattcaccttggcttaacattaacttatctccctgttccgtcagagtctttgtcaggcattctgttgctgacccaacaataaagtcaaaatcagctggttgcggtgtctcacgcctgtaatcccagcactttgggaggctgttgtgggtggattgcttgagctcaggagttggagatcagctggggcaacatggtgaaaccccatctacaaaaaatacaaaaaaattagctgggcataatgacgcacatctgtagtcccagctactcaggaggctgaggcaggagagtctcttgagtccaggaggcagaggttatagtgatctgagatcgtgccttcactccagcctgagcgacacagccagaacctgtctcaaaaatttaatttaaaaaaataaaaaaacctggctgggtgcattggctcacacctgtaatcctagcactttgggaggccgaggtgggcggaacacctgagctcaggagttcaagaccagcctggccaacatggccgtaaccccgtttctgctaaaaatacaaaaaattgggtggatgtggtggctcatgcctataatcccagcactttgggaggccgaggtgggcggatcacctgaggtcaggtgttcaagaccagcctggccaacatggccgtaaccccgtttctcctaaaaatacaaaaaattgggtggatgtggtggctcatgcctataatcccagcactttgggaggccaaggcgggcggatcacctgaggtcaggtgttcaagaccagcctggccaacatggtgaaacaccgtctctactaaaaatacaaaaattagccaggcatggtggcacacgcctgtagttacagctacttgggaggctgaggcaggagaattgcttgaacctgggaggtacaggttgtgatgagctgagatcttgccgctgcactctagcctgggtgacagagtgagactctgtctcaaaaacaaacaaaaacaaaaaattatctgagcgtggtgtcgtgcacctgtgtctcagctactcgggaggctgagacacaagaatcgcttgaaccaagagatggaggttgcagttagccaagatcgcgccaccgcactccagcttcagcctgggtgacacagcgagactctgtcgcaaaacaacaaaaaattaaaaaaaaataaaaacagtcaaaaacaataaagtcaaaatcaacttcaaagtaaaattgccagtttgggaaaagtttcatgaagtggatgaaaggtttcttgaaaatctgcttgaagcactcacaaaactattgacaaaagaatatttggtggaattagcaatttataactgaagagaaaatttactaggataatgacaagatagcagaaaagaatgatgtggatagtaaagcattgagagaatccttcaggaaatttgatgaagcccttagatctttttataaaatgattctttatgatcttattgctcaataagtaaaggatatcgtcattgtactagttcacaattttgctggaaaaactaccacctccctaaaagaaagcagtaattctttgctcatactaagaatttgcttacaggtttttattttattattattatttttgagacagtgtctccctctgttgcccatgctggagtatagtggtgtagtctccactcactgcaacctctgcctcctgggttcaagtgattctcctgcctcagcctcccaagtagctgggattacaggcgatcgccaccacacctggctaatttttgtattttcagtagagatggggttttgccatgttgcccaggctggtctcaaactcctggactcaagtgatctccctaccttggcctcccgaagtgctgggattacagacatgagccactgcacccggcctagcttacagttttgtttttttttttgagatggagtctctctctgtcgcccaggctggagtgcagtggcgcagtctcggctcactgcaacttccgcctcccaggttcaaacagttctcctgcctcagcctccctagtagctgggattacaggtgcacaccaccccgtccagctaattttgtatttttgagtcaagacgagtttctccatgttggccaggctggtctcgaactcttgacctcaggtgatcctcctgccttggcctcccaaagtgctgggattacaggcatgagccactgcacccagcctattttataatctttaacttaatttaatttaatttttgaatggagtcttgctctgttgctcaggatggagtgcagtggcatgatcttggctcactgcaacatccaccttctcggttcaagcgatcctttgccttatcctctcaagcagttgggattacaagcatgtgctgccacgcccagctaatttttgtacttttagtagagatggggtttcaccatgttgccaggctggtcttgaactcctgacttcaagggattgcccgccttagtcttccaaagtgtgggattacaggtgtgagctactgcatccagcctatttttttatcttttaaagactagtcaggtgcagtggtgaaaagggggaaagagtagaacaatgagttcagtctgtaactgaacaagtagttgagataacccgctatcttgggaccagttgcaagcaaaattttgttttaattgaaatgaatgttttcaaattaattctcacttaaatagaaattgcttctgttcatgagtaataaagtgattttgttccccgtcccccaggtgatccagaagaattaatgttccagtattttaaaaagtttggcgataaaccttgttgttttacagaccttaaggtgtttgttgacctcttacctgctacacagtgtacaaaagtaagtactatacagtttagaagtttgttgggtgcctctatttgttgaaacacagaggttaaatgtttgggtttcttttctaaaatgtgcggaattgataatcatgagatacaatgataactgccctgtcaagctaagtactctatgtgttacaacactgaaggcataatttctggttaagtcacaacgggagtaaagccctaacagatggtggattctcctttttttgactgtcttattttgagataattatggatttacatgtaattggaagaaataacacatctcgatttacatgtaattggaagaaataacacatctcatatatcctttatctgtttgtcccaatggcaacatcttgcccaattatagtgtaatataattaggaaattgacattgctctcatctgttgaacttactcagtttttgccagttttgcatgcactgatttttgtgtgtttgggtgttgtgtatggatttagtgcagtatgtggcacatatgggtgtgtgtgtgactattaccgtagtcaagatacagaacagtcccaccaccaccagaatcccacatgctaccctttaataacaatagccacctccccctctcccatctctatctatgggcagctattatgttttccatctttataattttgtcattttttgaatgtgaagtacagccaggtacggtggcacgtgcctgtagtccccagctacttgggagactgaggcggcaggatcgcttgagcccaggagttcgaggctgcagtgagctgtaatcatgctgctgcactccagcctgagcgacagagtgagactctgtctcttaaaaaaagaaaaaaagaggctgggtgtggtggcttacgcctgtaatcccagcactttgggaggctgaggtgggtggatcacctgaggtcaggagttcaagaccagcctggccaataatggtgaaaccttgtctctactaaaaatacaaaaaattagctgggtgtggtggtgagcacgtgtagacccagctacttgggaggctgaggcaggagaattgcttgatcccagaaggcggaggttgcagtgatctgagatcacagcaaccacatgattgactctccaggaatttatgcggagtgaaataagccaatctcagaagttacacatagtatgattccgtttatttaatttttttctttttcttttttttgagacagggtctcgctctgtggcccaggctcattgcaacctctacctcctgggttccagtgatcctcgtgcctcagcctcctgagtagatgggactacaggcacatgccaccaggcctggctaatttttgtatttttagttagagacagggttttgccatgtttgccaggctggtctcgaactcccgacctcaagtgatccacccgcctcagcctttcaaattgctggtagtacaggtgtgagccactgtgcgtggctttattctataaaatagaacaagtgttccctactgttgagtttgcagagatttttatatatcttagatacaagttctttgtcagatatgtggtttcaaatgtattctcccagtctgtagtttgctctttcatctttttcatgaaattctgcagcacaaagtttacattttaaagtctagtgggctctccttttaatgtcttgtttctttgtttctttttttttgagacggagtcttgctctcgctctgtcgcccaggctggagtgtgttggcgcgatctctgctctctgcaacctctgcctcctggttcaagggattctcctgcctcagcctcccaagtagctgggattactggtgtgctactatgcctggatgatttttgtatttttagtagagatggggttttaccatgttggtcaggctgggaagattggaagtctttctataacagggctgccatcatccgttctcccagaaagccttctattgtccccatgtggaatgaatgaagtgcactgggagcacagtggatataattagagtatttttttagtgaccacatttgtagtccatgaaggttcagtactttggcagacttggggttacacatttgggcagatagagcagtgcattccccaactgataagtaaccagtggtctctggggttctgaaatgactgctgccattcacgttggtttagtaaagctctgtttgagttgctgtggttatagggctcaggccaagcctagaagtttctggataaattgtaacacatccagaaaggagagttatgggttataggaggatttaaaagcatataagagggaaaaatggttgagtggaggagaggtttggtctgtcaaggtcagagtgatattgccgttcacttatttgaaaagctgtctttagaagagggaggaaaacagggaccagcaggaagttctacagggagctcagaatttggctcactgagaaaaatatctttcttagtagtgagaattctctcaaatactgtgtgtgagcttcacgttactggagggattgaagtagaatgtagataaaccaggtgggagggattcattcagtaagtgtcgagcatattgtgtgctaagccctaagataaggaataactgatcttgtcttacagtgcttattgtcttgctagttgaagcatcaaatggtgggggtgcattagaggaacactttgctacttttagatgagatttatgaaggtttgctaccatgaatctagtaccagtaaccttttctgtacagctctacttcattggtgtgtttgagaatcttaggtcatctcatgtgatcccacatagtaagaatcgtctattcagatgacccttactggaatgctagcagtgataagctctagtcactgctctgtgagaataaggatttaaagctgttacattgagtttatagtcctagtctatgtaaattttacttgagagaggtaattttgctgccactttttgactgtaggataacttcagtagctaaatatcctgccagtcagcaagtatgtttgtcagaggattacgaactgtccaagtcaatctgagaattgtcctaatgaattatgaaccaaatctttctaaagtctgactagcccctaagagtgagccagtgagttcagttatcctgaagtggctcgccctgggtgatgttctaatcttttgtttcatttgctttggggttttagctaaacaataaaatgattctagttttttatttatttatttatttttttgagatagagtcttgctctgtcgccctggctggaatgcaatggcacaatcttggctcactgcaacctccacctcccgggctcaagtgattctcctgcctcagcctccccagtagctgggattacagacgtccatcaccacccctggctaattttttttttttttttgagacagtttcgttcttgttgcccaggctggagtgcagtggtgcaatctccactcactgtaacctctgcctctcgggttcaagagagaacctgcctcagcctcctgactaactgggattacaggtgcccgccaccatgcctagctaattttttttgtatttttagtagagatggggtttcaccattttggccaggctggccttgaactcctggcctcaagtgatatgcccgccttggcctcccaaagtgctgggattacaggcctgagccactgtgcccagcctaatttttgtatttttagtagtgatggggtttcaccatgttggccaggctggtcttgaactcttggcctcaggtgatccacctgccttggcctcccaaagtgctgggattacaggcgtgagccgtgagccaccatgcctggctgattctagtttttatttttttattttattttattttttgagacaagtttcgctcttcttgcccaggctagagtgcaatggcgcgatttcggctcactgcaacctccacctcctgggttcaagcaattctcctgcctaagctgcccaagtagctgggattacaggcatgcaccaccatgcccagctaattctgtatttttagtagagaccgggtttctccatgttcgtgaggctggtctcgaactcccgacctcaagtgatccaccagcctcggcctcccaaagtgctggtattacaggcgtgagccactgcacccagcctcaacgattctagtttttaaagaaattttttgcacagcagtaaaactgtacagactaaaataatgagcagattattttgtaacaaaaccttgtcaggaagatgtttctttagaattcattaaagaaggccacagtaaacctaactaatatataaaatggcttgcaagaatagaagaactggcagtagaaactatagaagcatttaatcaaaaacatgaaaataatggctgggcatggtggcttatgtctgcaatcccagcactttggggaggatgagacgggcaacttgagttcaggagttcgagaccagcctggccaacatggcaaaaccccgtgtctactaaaaatacaaaaattagccaggtgtggtggtgcatgcctgtactgtagtcccagctactcgaatggctgaagcaagagaatcgcttgaacccgggaggcagaggttgcagtgagccgaggttgtactacagcactccagcctgggcaacagagtgagactccgtctcaaaaacaacaacaacaacaaaaacatgaaaatcagtgctgcagtttgttaaaattatgaaatatatatatctgatcataatgattaaaattaatagaattataggtaaattgaagcaaattcattacagatgttaaactgcaggatgagtaggattttgttttaatttttttttatttgtatcaaaaaattacatatactgaagctgggtgcagtggcacacacctatagtcacagctactcaggaggctgaagcaggaggattgcttgagcccaggaattagagtccagcctggacaacatagtgagtccccctcccaaaaaaggaagaagaaatacatgtactgtataaaattgaaaaagtcaaatagtatcgcaaggcttatattgagaggcagtagtcactccttttgttccagctcaacagatgcaaatcactttcaactaaattttttgttattttcctccatatttctaaattattttcttatttaataatttatttttatagttatagtcttatcctattggtgcccttctgtgtaaggtgattagttgtttataacaaatcaatttcccccaatacacttaggataaaacatgagattttgttctctctacccttctcttcaccaatgtaagaaatgctttccattccaaaatgcctgtttgctactatctgtttaggaacttacatatttgtcggatagcattctccgatatggttgggagtatagggtgggagcctgaaattatcactgaataagcaaattttactttattcccctgttttcagctatgactgctgtctctgactctgtctctggttcagtgccttatggctgtaaaacccaggctgttctactcacacttagaaattccatctgtgaacttttggaggggcctaacttcttagaaattaatatattctattttagtcccatcagcactttagcctttagggacacctggtgcccttagtctctgagtcttccaagattctgtgactagagtgcgcttcctgcttattggggtctgcctcattgcatactgttagatttcagtgttcttggcaacgtaagttactacttaaccacctgttcttgtatcttttgaaatcttcatgatttttatttgctgtcatctctcatttcttcatgtattattcttttcttctttttttttgagacagggtctggctgtgtcacccaggctggagtgtaatggcgcaatgatggctcactgcaggctcaaactcctgggctcaagtcatcctcccgcctcagcctcttgagtagctgggactacaggcgtgcactaccatgcctggctatgtgttttgtttgtttgtttgtttgtttttttagtagagatgaggtctcactatgtgccgaggctgatcttgaactcttgagcacaagtgattctcccatctctgttgggaatataggtgtgagtcactgctcccggcctcttcacatattcttgatctgtgtggatttattcttttttttttttaatacggagtttcactcttgttgcccaggctggagtacagtggtgcgatctcggctcactgcaaccaccgcctcctgggttcaagcgattctcctgcctcaccctcctgagtagttgggattacaggcacccaccaccacacccagctaattttttgtatttttagtagagacagggtttcactgtgttggccagggaggtctcgaacccctgacctcaggcaatccacccgccttggcctcccaaagtgctgggattataggcgtgagccaccgcgcaccacacccggcctattttttcttttataactttttttttttttttttgagatggagtctcgctctgttgcccaggctggagtgcagtagaacaatcttggctcacagcaacctctgcctcccaggttcaagcgattctcctgcctcagcatcctgagtagcggggattacaggtgcgcgccaccatgcctggctaatttttttgtgtatttttagtagagatggggtttcagcatgttggcccagctggtcttgaactcctggcctgaagtgatgtgcccaccttggacttccaaagtgctaggattacaggcctgagccactgcacccagcctcttctttttttattccttactggcatcttaataggattttagaagtgagaggaaataagcgtgtatttaataaatacataactagaactggtatgtgggttttatttttaaatttttatccaaatttaaaggatgaaaaacattttaaggcaagatgtaaccattcggagaaaactggatgaatggtacatgggatctcatttctcatagctgagtatgaatctataattataagttcaattaagaaaaatgtagggtcactgacataaggtaaacagtatctttccatgtataacctttcctttcagaatttatcagcataattacagattaatttttttttaattttttggtaatctgctcttttctatagtcttcctaatgttttcattgctgtaatatatattatgttaatatgctgtaagttatggaacattttcagaagtataaaaatctttcactgcctgtagtacgtggtattgacaaatacttttggccagtaatgaatgagtgtgccagtttcattggagcttcaccagtgttgtgtgctgtcacaaattttttttgttttagctattttggtagatagaaaatggtttatgaaaggaattttagttttttttttcttgatgtctttttctagaccattcaatttctgttaattatggcctactgaagactagttgtgttttgagacctttgctccttttttccccactttgcagtttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttggtgagcaaccattcaaaatgtgcagtagttccctgatctacactaagacttagaaggcagttttttaagcacctgtagcaccctgttttaatgagttttgtaaggagactattttgtctgggaagaccatctaagtaatatgatgtaaagcctttcttaagcctggagttttaaataattctgattggctttcagttgtctgtattcttcttgatctgatgagctaactttttattagattggggctcatatagattgcatagtttatgataattatcacattttctgcttgtaggcctaaatattcttaatatatagactgtaagtgaacaaaaagaatattgtaaattgtaagataaatatttagtttagaaatagatgatcttcagataggtgtggcctttgctagatatatgtgatagacatataattgtctgactataagatgtcagtatttatctgtagtctaaagaattagatgaagtcaggagcatattgtgaatttagttatacatggcacttggcttatgttcttttcttcacctcaacctccttcaaatcttccttctctccctttgggaccatcatggataccacctctgctctggaaccctaccttctgttccagctgagtgtggtctcaccttcttttgaaccctttgaatcgtggcttatatttttctcctggtacttatcttattcttaattttcttttacttttcctcctctccctcctgtcactttcctgcttttaaaaactcctttggggtcagtaatagttgaacaaatgttaaaatagatatgatttttttcccccatagggaaaacctgtttgaaaacagaattgcaattttctgactattactgtctccttgctgtccatgcgcttattgatgtatggagggaaacaggtaagtagcagtgatttcagttcaactttactttttgcttttattgattataagtactgcattctttcattagactaattttacaatccacaaattttatttatgcttttaggttctgcttttcttgatatttctagggtgcttccagaaaaacctgtcttggccaggtgcgatggctcatgcctgtaatcctagcactttgggaggctgaggcgggtggatcacctgaggtcaggagttcgagattagcctggccaaaatgcaaaaaacttcgtctctactaaaaatataaaaattagctgggcatttgggcgcatgcctgtagtcccagctacttgggaggctgaggcaggagaattgcttgagcttgggaggcggaggttgcagtgagctgtgatcatgccactgcacttcagcctgggcaacagagcaagactccgtctcaaaaaaaaaaaaaaacctgtctccagtttatccccttgtaaccaggataatgttaaatgaatggatatctgttctgtttttaagtgtttgtgaataataagtaatgactataaaaaaatactatgacaaagctacaaaaattaaaatacaatgaaactgactaaaaaatacatgcacaggcctatggaacagaatatcttttattcacttcaaaaaattttatatacagaaaaatgcattctttctggaatatagtttgtctcatttaagataaaaatataagacatggtaaaggaagcatcatgagtgattgaggaagagaaggatgattcagcaaatggtactgggattgccttttctttaggtcccaccccctgacattttctcttattagcagttttggagaataaataactttaggtgcttatggcatattattcatgagaattgaactatagaagaaacaaagggctgaagagacagtggtaagcaagataaacacaacccctgccctcatggatcatttcacagagcactcagttttgttttttttgagatggagtcttgttcttgttgcccaggctcgagtgcagtggcgtgatctcagctcactgcaacctccgcctcctgggttcaagcgattctcatgccttagcctcagagtagatgggtttacaggcacatgccaccaagcccagctagttttttttttttttttttttttttttttttttttttttttttttttttgtgagatggagtctcgctctgtcgcccagactggagtacagtggtgcaatctcagctcactgcaatatcctcctcccaggttcacgccattctcctgcctcagcctcccgagtagctgggactacgagtagctgggactacaggtgcccgccaccatgcctggctaattttttgtatttttagtagagatggggtttcactgtgttagccaggatggtctcgattacctgacctcgttatctgcccgcctcggcctcccaaagtgctaggattacaggtgtgagccactgcgcctgaccagtttttgtgtttttagtagagacaaggttttgccttgttggccaggctggtctcgaactcctgacctcaggtgatccacccgccgcggcctcccaaagtgctgggattcaggcgtgagccactgcacccagccttatcatgccattcttaaaatccttcagacctcaggaagccaaggcttgagcccagtagttcaaggctgcagtgagctatgatcacaccattacactccagcctgggtgacagagcaggaccctgtctctaaaaaatttaaaaagaaaaaaaatccttcagaggtaccctgttttcctgaggataaaagtcaagtgttttgggatagtttataatgctgtttataatctggcctgtgcccacatctccagattcttaggtatttatggtcttgaatctactttaaaatttttttgctactatcacttaacatcatgttgcctctctttgaaataactttcttacctccctcatctaagttttactcaaatggtgcctttaacaaagcctgtcttgattttaactccttccccactggggattttatgctcctctgaacttctgtaggacattgtatgtaaccatatggtagtgtttttttttttttagtttgttttgggatggagtctcgctctattgcccaggctggagtgtaatggcacaatcgtggctcactgcaacatcctccttccaggttcaagcgattctcctgtctcagctgcccgagtagctgtgattacaggcacgtgccactatgcctagctaacttttgtgggttttttttgagacaaagtctcgctctgtcgccagactggagtgcaatggcacaatcttggctcactgcaacctctgcctcccaggttcaagtgattctcctgcctcagcctcccaggtagctgggactacaggcgcccaccaccacacctggctaattttttgtatttttaggagagacagggtttcaccatgttggccaggatctcttgacctcgtgatccacccacctcggcctcccaaagtgctgggattataggcgtgagccactgcgcccggcctaatttttgtatttttagtagggatggggtttcaccatgttagtcaggctggtctcaaactcctgacctcaggtgatctgtctgccttggcctcccaaaatgctgggattacaggcatgagctactgcacctggccagtaatacttctgacactatattgtaccagggatgagagtgaaatccttgtcatcagagaacttgttatttgagcccctagattcatgaggctgcatagggtagcaaaagtcattttaacatgaaaacattaatgaactgatcatgtagtaatttgatccccacacagataggctttcttactgatgcctaacatccgttctcaccaatagtgactatggctttgctagtctcttatattaatattttgagcaatatatgtggccatatgataatagtaacaactgacagttgattattaggcatgtgaaagtactttacacaaattaaactattttattttattttattttatgttattttattttatcttattttacttttttgagatggagtctcgctctgttgccagggctggagtgcattggtgcgatcttggctcactgcaacctctgcgtcccaagttcaagcgattctcctgcctcagcctcctgactagctgggattacaggcgcgcaccaccacgcctggctaatttttgtatttttagtagagacggggttttaccatgttggtcaggttggtcttgaactcctgacctcgtgatccgcccgcctcagcctcccaaagtgctgggatttcaggcgtgagccaccacacccagccgatttaaacattttaataatacagttattgtcacagttttataggtgagagaaatggagggcagagagaaaaaaggtaaattgtccaaaatcctgcagtgcagacaaatacatgggaatcatttgcaaaatgaaattgtagatcttgtgaagatgcagggcttcttgaagtcagtgatagggatgttgaagtactccagtcacagtcataatcattgttcaaggtgcacctggcagaacttagaaatcaatagaaagttgatgagggcatttaaagagattgatttaaattcaaaaggattgagtgttttaggaagttggtgctctcaaatattttttctgaaaggctatttttttattttgagacactgtcatccaggctagagtgcagtggcaccatagtagctctctgtagcctcaacctcctgggctcaagggatcctcccacttcagcctcctgggtaactgggagtataggcacatgccaccatgcctggctagtttttgtattatttatttagttaattttaaatttttttaaattttttatttattattaaattttatttttattttgagatggaatcttaactccgtcccaggctggagtgcagtggtgcaatctcggcttactgcaacctctgtctcctgggttcaagcaattcttctgcctcagcctcctgagtagctggaattataggcacccgccaccacgcccggctaatttttgtatttttagtagagaagaggttttaccatgttggccaggctggtctcgaattcctgacctgaggtgatccgcttccctggcctcccagagtgctgggattacaggtgtgagccactgtgcccagccagtttttgtattttttgtatagttggggttttgccatgtttcccaggctggtctcaaagtcctgggctcaagccatctccctgccttgtcctcccaaactgctgggattacaggcatgagctactatgcccggcctatctttcttttcttctggaaaacagcatatagaatattaccttaaaatcttactgcatggtgctttcatttttgctgttgttactgactgtaaaagtagcttgtataaattttggaaagtagtttacttaaaatctcacttttttggacctcaaaagcactcttatcacttttgcatttttttttctttttttttttccttttctattcttgagacaaagttgcactctgctgccaaggttggagtgcagtggcatgatcacagctcactgcagcctcaacctcctaggctgaagcaatcctcccaacctcagccctcctgagtagctggaaccataggcagtgtgcaccaccacatctggttaattttttcaaaaatgtttttagtagagacgaggtctagctatgttgttcaggctggtctcaaacttgtgggctcaagtgatcctcccacctcagcttcccaaagtgctgggagtataggcatgagccaccatgtccagctaacatttttgtttgttttcttcttctctctctctttgtgcatattttaagagttgagatcaactctttgtactaacttgaattttctgtgtgtgtgttttactgaacattattgcacattttcctttgtaattaaaaactcttcattaacgtcaagtagttatatgacatttccatgtgtcgaagttaccataatttacctactcatcctcccatcattacatcactagatagtacgataactatttttgtatataaagctttatctgtatttcatagtattttctttagatggatcctaaagaataagtaacttaatcttgaagactagagatacatgtaccttttgaaatttcatagacccaaaaaaagtatcattttagtttgattattgagtaaatattttcaaacatcctatttgccattctgttagtagagttacatatggaagaaaaatgatgtctatagataacatctgtctggggttttatagaggaaatcctgcaggggcaaggtgctgagctccagttttccttcaaagtccatctcttcccagaatctgagattctgtgagattctataacatccccccacaagacctggccacttaaaatctgcatcgtttttgctgtgggcatgtttaagaatagacttaactattgaaggactctctgttgaggcgaaattctctattttggttacaggtgtatatctaaaatttgttctctgtcatttaacttcatttattggggggggtgatgatgtcaataaggttttgttttttgtttttgggaagctttcatttgctgtcaagatcagtggataatgctgtattttggttctaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattgggttggtagtatatactctgaataatgagcagccagctataccagtgtggggtacacaggactctaacttagattttaaagttgattgtgacattaagcctttctgattaaataataacctgttatgatccattgcaaaccagaaagatttttatatctcccagcattttgtggtaatttgaaaatttgcacaatttagaaatgtaagagagttttccccagagatagcaaacacctatatactttgaacccttattcttagcacacattattttgaagtgttcatttccgctttgcagttgaagttgacacatgtaatttatttattgacctcaacaaagtttgaatttgtattttgaacttgtatttagactactctttattattatgctagtatcacttaatggcattttctctgtttgtggtgctgttttaggaagacagcattatgttctgttagaacttttatgtgtcattaatcatcagagtgtaagaaagcctagttacagaactttaggtctcccacaaaactgagttaacttttggcttttttttttttttttttttaaattttaactggtgaattagatcatttctgtgggagtatgttttagtgttttcttatgcctagctatttttttgccaagtaatttgaagcgtaatatttgttacttgagctaggtaagtaagtataacatgtctttttttttccttctttccttctgatctagttatcttttgacccgatatgctgaatctctaggtcagtatgctgctgcgtcccaatcctgtaacttcgcactcaggttttttcactccaaccagaaagatgtaagtgaaaaactattttttaactgtgatcttgtctgctgactgcacactattgaggagcacgtcaccacatgtcacaagtacacatgttaaggtgcaccatgctgaactagcaagtgcccttagaccaaagcttactgtccaaggctggtagggagaggtagagagttatttgtgtttgttagaatgggcgtgtttaatagaatccttggaaagttgcatttaaaaactggtatttactgactaggaagtgttagtcctcttagacctggcttttaatctctaagagacttttccaagggtataagaaacagtccataagcgttcatagcctgggatgccgtgtaacatcctgcaatagcagctgctctctgttacttttatttaactctgaaatgtatgtccattgtgctctttgccaaaggtgaatgtacttgtattttcttagaaaattaaaaggcattccgagaaacctaggtgaataatatgttttttaaagtagcaataaatagagcttctctgtgccataatgaaaggatgggatttgcaccatatttttcactgcaagcagacttgggctctacttgttggttaagccgaggtttttgtaggaaaaccatacggtctgtactcagttgaccaattataaaaaactgcccaacaatgaatgtgaagaaaaggaatgtctccagggtggtcactgcctacttggttttcacagacttctaagcctcatcgcctgaagttggctgtgccagctatctgcccatagctttccattctcatggtctaccagcaattaaggaactagcaaggaagctagtttctggggttcttcttggcaaacactcgtgaggattttttttaaacccttttgttttactgtaacaggatgactaatctatcttccatctaattctttaagggtgtattgtattaaatagaagcatttctgaacatgggatataggtttgttctcagtttatgataattacattctgacaagttttagggaatggcctagagggctggagtagcaaaggacagctctaagcaggtggaaagcagcctcttgtgcttagataatgagctgtgtaccattagttggttcttagtcctgtatcccctccccaaagtggcccccttaacctctgcagtgattggtatctccgttcagacctcattttgtggcacagcatctgatcagggagagaggaaaatgagtatcagcatctgagcatgttactcagaaggtgtgctggcctggcttagaggtcagaaggtcatctctaggatgttgggtttctaaaacctagcatggatgagctataaacctatgaattttcattgtgtgttcaagtatctgtacttgccctcctgttttcaagaggtttcactaactcaaaaaaaaaatcaaaaggattggtttcctcatctcattatttatggcctcatttctgtatttataagagagatgaaagaaacatttgatttactgaagattccttttcaaaggtttgtttctcaaatagctttgaggtagtgggagtaaatcagggattaattccagcccggtggctggttttcctctagctttcaatcatgcagcattctagaagaactgtattactcatgaagatgtggtcaataaagacacattactttatatacatcagaattaggctttaattttttcccacaaatattgtgtctgaagagttgttttgaaagaaaatctaaaaataaaattacaaaagtgttgcaatataggcaaaggagacccctaggagcaatttgaggggatgtgtcatcctcagagttttttttgtatctttgttttatgttttgctgatggttgtgtgtggcaaaagtgactaattcatctgaatgtatgtgatgttgaacctgataaaattatagcattttattgatcagagactaggacacttgaaatatattttgattaccgctaagaagatagagcttattaaatctgctgacaggagataatcttgaagagtcctagaggcaaaagaaaaatacagtacaggctgggcacagtggctcacgcttgtaatccaagcactgggaggccgaggtgggtggatcacctgaggtcaggagttcaagaccagcctggccaacgtggtgaaaccccatctctactaaaaatacaaaaattagccaggcatggtggtaggtgcctgtaatcccagctactcggcaggctgaggcaggagaattgcttgacccgggaggtggaggttgcagtgagctgattgtaccattatactccagcctgggtgacgagagagactctgtccccccaccaaaaaagaaaaatatggtacagctaggaacatgtagcttgaccttaatgttgagtgccagatagagactgtggtgtgaactgtttcctaaagaaatctaaggctaagaaagattatgattgtagtgtcttactgtgtgtgttcaaccttgtgcttagagtatcagaaatatctctcttcaaatccagagctctatactatgcatcttttattcttggtagtttttgggatccccggatgctttttccttgggtgactgatgcatttcaattcccacctagctctttgacaggacacttttacttaaatggaaaatctagtgttttgcttagtaatgttttgtgctatgggattgaaagttgtatttggaaggtctgcatagggattttctttctagaaaggttattttctgttgtcatcttactttggaatagatttttaaaaatatgaaaataagcactagattttcatatctttaaaagtcacttacgtgtttttacttcttaaaaatttccctttaaaatctctattttatacaaaaattatctgggtgtgttggcgagcgcctgtaattccagctacttgggaggctgagtcaggagacttgcttgaatctgggaggtggaggttgcagtgagctgagatcataccactgcactccagctgtcactcttggatgacagagtgagactctgtctcaaaaaaaaaaaaaagtaaataaaagaaaatataatctctaggtattcacaaaggtcattattcaggggttttatgtccatatatttcactaatttttacagtgaccagggttcatttcaggaatccattcgggatctaaatagcctcattggtgcataaatgagtagaaaataggtacggacaacatactttgatattcaaaagtctttaaagtgcctgtggctttcagttttgcctgcagttccagtagggggttgtttcttcacgtagtactacttccacagccttggtcctagtggttgcatcccaggcccttgtctagctctgcagtggtactttactgcagtgttacagaaggactatctaaaaaagataagccagagaactgtgactaccttcttagtttgttaaagactatactctctttgttgccccttatttttctctttgaaaagctattgccttttttttttttttttttaaataaagtggtgttccacggaccacttagaaattaaaactgcctctacacttggtaaggctgggttccctccttaaatcatagcatactttggaactgtaattataactttgattggaattactaaagtcatattttctttttgattaattactgaatcatgtgttcctaaccagctgtttttttttccccagctgtaagttcctattacaagggctaatagtagtaaaccttgctgtgttttctaagccaaggggccataggataggcatatgtgtttagagtatcctggcctcctcttgatagggtgtatcactgtcctttaatcaagctagaaggtatactcgagctttttcaggtagtccttcttgaaacctgcaggatcacaagtaatctttttaattttcttgtgtccgtccgtctttaatttctccagatactgcaggcaaacagctcgccgaggtgtcccatgggggtttaaaagccgcatcgaatgcagttgaattagcgcccgtggcgcaatcccgcggcctgaaatgaaccctgcaaggctgtatatcagagggtatgttgttgactattggcctattttcctactgggcaaattattcagacgtaatggagatgggggcagagctgattaactgaggctgtgtaaaaagactgttttttctagaaaggatcttttttgggggcagacatcagctttgagcataatagtttccttggcccaaaggggtaatctcctgtcttctgatcctgatggcatagacccacacccatgaaatgttcttccctgagattttcttctattgtgccagaatttctgcttagaattctttatcttgcctctgttctgtaatgtttgatctctgtatatgtattaagctacaattaaagcacatgtggtgaatgttcccttcacatacttgtttaaggaaatttccagcagaggtcttacgtaatgtagatggacaagaaacttggttcttgaagtctttgtcctcagaatagattatgacatgaattttgataggtcttttgtttggtgtcttacttctatcctgacgtaatgctcatatgccctgtgtttctaatacagtattcagaaataagcaaaaccaaggagcagcctgtctttttctgaaggagagtggtttttatttgggggggcggggggcaggtggttctattattctggtgcttttggaacctttgtatgaaacacagtttatcttagatgcagaaaaacatggagtaacatcccttccagaatggcactaaccaaatttttgactgatgtggcaaaacaaaacctcagttcctattgaattgaaagacatgactgccaagagaaggcttatgtgatggtggcagaagctggttattacaattagtaatattagtaaaggagacatttgtctaaagtataagaaggaagaaaaacattttaaaaagctaatattctacttggtgaccaagacctttaaagattagatttaaaacttaattttagtttgagtgttttgttttggctggcaaggtttgcttacattgcctgacttgtgaactatttataccaaggtgatgtctttccttctcagacctcagaatatattattcaagcttacaaatatggtgcatttgagaagatcccagagtttatcgcttttaggaacaggctgaataattctcttcattttgcacaagtccgtactgaacggatgctgttagaccttctacttgaagcaaatatgtaagtattgcatgagagctataaaggaactaagggattagatcagttgttaagagccattaatgggctcatgggtgttattggcaggcttaaggtaaaatagggggaaaaaagggagagagacagtggggaaacagaacttggcacatgtcatggggaatggtagagtactgccagcaacatcttgagaccattacagaagccatttaggtcatggtcatcaatgcctggtccatattgtgcttacgaaggttccgcctcccctacaaatcaagagatttcaggaattaatgctgatcccctttgttttgtgtgggcttccagaagcctttttcttgccatgtagcaagccagtttgatctgcgcttggttctatttcaccttattatgagcccttccttcctctttcccttcctgtctagtaaaacaggaagtcctgattaataatattttctggctattttactattaaaataatatgtggatttttctctatcacagatcaaccagtttagcagaaagtataaagtcaatgaaccttaggccagaagaagatgacattccatgggaagatttgcgagacaacagagacttaaatgtttttttcagctgggatccaaaagacaggtaactggaatttaaccccaagcaatttttaaagtttttgtttgttttttgtttttttaaagagaccaagatcatagctcactgcagcttcgaactcctgggtgaagcagtttatttttaaagaattaggttgggctgggcacggtggctcaggcctgtaattgcagcactttgggaggccgaggccggtggatcacttgaggtctggagttcgagaccatcctggccaacatggtgaaaccctatctctactaaaaatacaaaaattacctgggcgtggtggcgtgtgcctgtaatcccagctattcgggaagctgaggcaggagaattgtttgaacccagggagcggaggttgcagtgagctgagatcgcaccattacactccagcctgggcaacaagagcaaaactccatctccaaaaaaaaaaaaaaaaaagaattaggatgaatctaaaattaaaaaaaacaaacttcactttacacaaatataaaataacatgtgtttgttgtagggatcagaaaatataggtaagccaaatgaagaaagtatagctcacccctatgctgggactgctggttaatctaaaagttagatctacttcacagcatatatgagaattccagatcgattaaagactgtatgctaaattctagattccttagaaattctagaagaaaatatagaaaatatttttaaataggtgaggaaagcctttcctagtattataccaaatctggaaacataaaggatttaacttctgtaaatagaaataataaatttgttaagttctaaaggtttgtagtaaatttcttcatacaagtatccttcatatatagagagaactcttaataagtcaataagaaaataagaaattgggcaaagaaacacatcttacagcaataaagattttgtttctagcaaaaaagatgaatacttgtggtcagcaaggctgtgtggtaaatacttattatgcatttacacagggataaattttatacagtcttcctatagggagttgtagtgatatgtatcaagatttaaaatgccacataccatttaatttggcagatctgcttctaggaaagtagaacctaaggaaataaatgcagaaacatgctaagaagtgtatatgaggtagttctgaaaattctgtgatttgtgggttgccaaggccacattcagtgatttaggattgttgagtcccagaaggattcacagggctgagcatatagttgcactcaacggctaaggtttattacagtgaaaggacacatgacagaatccggaagggaaaaaggaacaggcacagtcgggagaactcagacttccagtgctttctccctcctctgaggggaaacactgagtatgctcctttctccagcagggaaaaatgcagtaacacaggtggaatgttcctgctcagggaaacccagtagagacttggtgcttaaggtttcattgttatgtgggtacactctgtctatcctgagtggaaagaaagcaggtattcaccataaacaacatggtttatataaacaatctaggcacagcgagtcactcttaccattttagggaacagttggagtgcaaagttcccagacatcagccaagggccaaccttgcaagtaggcctttctaacgataatagctgcaggcctgctatgttaactcttttctacacatactgtcataaaaagatgaagtttgcaaaataatgtaattactgtaaccaatttgtttaaacttaagttgcatacatactatttttagttacttttttttttagatggagcctctgttgcatactgtaaccaatttgtttaaaattgttaagttgtgtaagtattatttttagttactttttatttttgagacctagtctgtctctgtcgcccaggctagagtgcagtcgcatgatctcggctcactgcaacccccacctcctgggttcaagggattctcctgcctcagcctcccaagtagctgggattacaggtccctgccaccacgcccggctaatttttgtatttttagtagagatggggttttgccatgttggccaggctgatctcaaactcatgacctctgttgatccccccatctgggccactcaaagtgctgtgattataggtgtgagctatcgcaaccagcccctattttttttttttttttttttttgtgatggagtctcactctgtcgtccaggctggagtgcggtggcgcaatctcggctcactgcaacctccgcctcccgggttcaagcaattctcctgccttagcctcagctgggactacaggcgtgtgccaccacggccggctaattttttttgtatttttaatagagatgggattttactgtgttagccaggatggtctcgatctcctgacctcatgatctgcctgcctcggcctcccgaagtgctgggattacaggcgttagccactgcaccgggccacacccgctatttttagttagacttttatacatccacattacaaaagtctaaaaagatctataccaaacttgataatactgtgagtattggttatcagggcaccttttctacgttttacatttttctatcatttgcattttttatgttgtgtattatttttattagagacaggatcttacccaggctggagtacagtggcgtgaccatatctcactgcagccttgaactcctgggctcaagcaatcctccaatctcagcctccctagtagctgggactacaggtgtgtgccaccacgtccagccaattttttgtatttttttttttttttttttagagactgggtcttgctatgtttaccaggctgttctccaactcctggcctcaagcagtctctcacctcagcttcccaaagtgctgggattacaggtgtgagccaccacacctgtcctcatgtattatttttataatcagagaacaaagtgtcacttataaggaaaatgacctgttttttttgttttgttttgttttgttttgttttgagatggagtcttgctctgtcgcccaggctggagtgcagtggtgcaatcttggctcactgcaagctccgcctccctggttcatgccattctcctgtctcagcctcctgagtagctgggactacaggcgcccaccaccacgcccggctaattttttgtatttttagtagagacggggtttcaccgtattagtcaggatgatctcgatctcctgacctcgtgatctgcccacctcggccttccaaagtgctgggataacaggtgtgaggcaccgtgcccagccaaaaatgacctgttaaataggttatcattcccattttattgatagtgaaatggggtttgagaacattttggcttgtcttaggtcattcagctagtaaatgaaagctggaacccttcaaaggcatcttaactggtgaaagttaactttaaatgatttgaggccaggcgcggtagctgacgcctgtaatcccagcattttgggaggccaaggcaggcagatcacgaggtcaggagatcaagaccatcctggctaacacggtgaaaacccgtctctactaaaaatacaaaaaaaaaattagccgggcgtggtggcaggcgcctgtaggcccagctacttgggaggctgaggcaggagaatggcatgaacctgggaggcagagcttgcagtgagcagagatagtgccactgcactccagcctgggcgacagatcaagactctgtctcaaaaaaaaaaaaaaaaattgaaagcaatggattgaatattgaataagttagataatttggggatgtttctgtttaagggacgtttctgaagaacataagaaactttccttagaggaggagaccttgtggttaagaatccgatccttaacattgaggctgataagtggacttccaagtctcaaccaccctgtggagccaaagaactcggagaagactgccgagaatggggtatcctcccggattgatattcttcgtttgctccttcaacagctggaggcaaccctggagacaggaaagcgatttattgagaaggatattcaggtaccatcaatacatatttaccatcaaagttgcaataattatatttatgactgttttataaacaggagtttggggtgggtgagtagtaaggaattgttttgtcccagtttatggcttctgcaggagaaagaggaatattttagactcagagggaattgcagaggcttcctcaatatccagactagtgagggagaaagcaaaataactttttgtggtgttaagtttttaatagctagcaacaaattaatataaatgttctgtttttactgtaatgattcagttattagtttgctgattagtggcttttagctgaaccgctgagacaggtttttatctactagttacctgattttcttattttgtatgcatttagatggatttaaaagagcattatttttctcccttttttccagtatcctttccttggtcctgtacctaccagaatgggtggattctttaattctggctgttctcagtgccagataagctctttttatcttgtcaatgatatttatgagctggataccagtggtttaggtaagtgtacactgtgtgtttatagggtctttgtcatagaaaatgtagtacacgtaataaaatgtctataacctcacatctggaaaattttagagtacatggaagctggaagctgttctgcaaatgtgtggtgtagtgtatgagagggtacagtcgtaggttacaaagtaatgttttagaagcttaagtccattccatatttaaaatcacttgttaggtccaaaagttgaagaaattcttcatttgttgaaaggctgttggattttaaaaatgaagcagtaggctgggcgcagtggctcacgcctgtaatcccagcactttgggtggccaaggcaggcggatcacctgaggtcaggagttcgagaccagcctggccaacatggcaaaagcccgtgtctactaaaaatacagaaattagcgaggcaaggtggcgggcgcctgtagtcttatctactccagaggttgaggcaggagaatcgcttgaaccagggaagcagaggttgcagtgagccgagatggcaccactgcactccagcctggatgatagagcgagactttgtctcaaaaaaaaaaaaaaataaaaataagaagcactaaactttgtagagaagagatttcttttgtaagctcctagtgaaaatcacaaatactccatagaccttttccttttatttatttattttttaaatcataaggttagtagatcctaccattcagagtgtttgaagcacatagattttaagctctcttaaggaattttaggtagtacctctggcaaaaaggtaattagtgcctttctttttattcttccttttcctttcattatcattttctttttgtctcaaaataatgaaaaatgcataagggtctgtagagagaagaaaatgtccttgcccatgaacttcttgcaggtatttatcttgcttctttatcttactaaaaatagaattgaaagtttttcattttttgtttttcaattttagaggatacaatggagattcaggaacgaatagaaaatagttttaagtctttactagaccagttaaaaggtaagttttcctactgtagattcctgtatttgtatctggttgtatggcaatagcttcgaagttctttcccctattcccaagcccaatcacccagagataagtaagtagttttaacactttggagtcaatactcctagatgccacctaaacacatatgtgtgtgaatgaaaatacagataaaaagtaatctttaaacataggaaatggtgtaatccatgcttttttgactttaatttttttgttattttggatacctttccatgtcagttatatataccccatttattttcaagactgcgtaatattctatagtattgtattaacattttttatgttatcgcaattggtgacatattatgtatatgagttatttcttctactgatgctgaaatgaatatcttgggacaaattgttagggtattatttgagtccttccttgggattaaattcccaagaatttaatagaattattaaattgttaaattcccaataatttaatagaattgttaaagggcacatatatgcatcttgtatctataagagtctttctggccgggcatggtgactcacggcctgtaatcccagcactttgggaggctgaggcaggcagatcacgaggtcaggagattgagaccatcctggctaacacggtgaaaccccgtctctactaaaaatacaaaaaaattagccgggtgtggtggcgggctcctgtagtcccagctactcgggaggctgaggcaggagaatggcatgaacctgggagttggagcttgcagtgagctgagatagcgccactacacttcagcctgggcgacagagcgagactccatctcaaaaaaaaaaaaaagtgtctttttaggaccctaaatgattttttttttccccccaagaaatgaggtcttgttgtgttgctcaggatggactctaactccttggctgaagcaatccttctacctcagcctcctgagtagctgggactactggcgtgcaccaccaagcgtggctcggtcttatattttattgtccaggtgaagaatgtctgaaaatgattaagattatgataataaaatttattatctgttatgaagatgcatttctacaatgtacttttttggtctttcagtccataatggcataagtcctctgaatcattcacttagagtcttagtcttattgtgctgatggcctatctgaaaaggcttcgctggtgtttagacactagaatgtataatttttaaggctaccttttatattttgaagactatagagcaacagcatggctttttaaagaacttacaatggatagtctatcctttggagtttggttcattatggaaaatgaaaaacaaatagctttctaaattaaatttttatttgcttattctttatttgtgtgttgtgttccttaaaatagcattgaaacaaaagctgaataaaactaaaatgttttttgttttcagatgtcttcagtaaatgtaaaggtgacctcttagaagttaaagatggtaacttgaaaacacatcctactcttttagaaaatctagttttctttgttgaggtaagtttttgttctcttcctaaaagacattgttgttcttaatggtctacaggattcatttttcaacagtgaacaggtaataggcaccttatacctgtaacttaaccctccatccctgtttttgttaattgaaaagcaatttaaatcattttctaaaccaatttcttccaagaattctaagatgatttcattcataatacttaggtaaaacttcttgaaatttgctgtactcatctctaaacttccccagattcacctcaaatctagctgttttcattctcctttctgactcactctttattatgtagtttaattcctccagcttcttttatttgttgtcatttattaattgctaagatattatgcattgtgatagtgtccagcaactgatacagcaaaactccctcctctttttttgccagagggaagagaaggaagattgcaaacactcataatctattatcttttcttttatttctgtcacatatttgttgactgttctccccttactactctgtgtggggagtgtacactgttctggtgattggcaaactgtaagtgcctaagagatttttattaagtgaatgagtaataagcggacatatatgtacatgcacacactgtagtataggagaagacatataaacagctaatttgatacagtgcaggatatgtactgatcaactgggtagattttgccatacatatgtaagttaagatttgcaggtaaggtggtatcttacctgcttggagagatgtgacgggagaggcatattgtaaagaacctttggattccatgcctaggaatttggactcttctctgagtgaaaaggatgttaaatcagtccccacttcttcagggaagtgacagaaaattggagtgaagtggaggatggattttgagctaggagagccagaagaaatgctgaagagttaggccattgtagtattctgagcaggagatgatgaaggcctggatcagtagagtgattgcagaaagtagagtggagattcacatgagaaattgaagggatttacatagaagaactgcgttagaatttgttgaatccattgcctctaatttcctgatagatatttttagtgtaatccttattggtgaatttgcaatttttcctttcagactatttctgttatcctttgggtatccagttactgtgagagtgtcctacgaccatacaaactaaatttacagaaaaagaaaaagaagaaaaaagaaaccagcatcatcatggtaataacagtaacacaagtgatatacaaggaacaatctgaccacatgctactttttcttttcactgttttcctccatgttgagtccttaggatcctatatgccaagcttctccaacccatggcccacgatgactttgaatgcgtcgcaaacccgtaaactttcttaaaacgttatgagattttttgagtttttttttaaagctcatcagctattgttagtgttttttttgttttgttttgtttttgtttgagatggaatctcactctatagcccaggctggagttcagtggcactatcttggctcactgcaacctctgccccctgggttcgagtgattctcctgcctcagcttcccgagtagctgggattacaggcgcctgccaccacacccggctaatttttgtattttagtacagacgggatttctccctgttggccaggctggtctcaaactcctgaccttaagtgatctgcccacctcggcctcccaaagtgctgagattacaggcgtgagccactgcacctggccaacattagtgtattttatgtgtggcccaagacaattcttcttccagtgtggcccagggaagccagaagattggacatccctgcatatgcgttgtttttctcccctaacttaaaaaaaattaaattatacacctacagaaaaattgaaagattaatatgacacccataaagatctttacctggattatcaatttttaaccatttatctcatttgttttatctctcatttgttgaaccatgtaaaaggaaagtacagacttgtgacatgtaacacatcaggatagaacaaggacaggtctctgcaaaaccataatactcaagaaaatttcaaactcaagaaatttagcattgatacaatgatattatctaataaagtccatattcaggccggatgtggtggctcacacctgtaatcccagcactttgggaggccgagacgggcagatcacttgaggtcaggagttcaagatcagcctgaccaacatggtgaaaccccatctctactaaaaatacaaaaattagtcgggcatggtggtgagcatctgtaatcccagctacctgggagactgaggtatgagaattgcttgaacccgagaggcagaggttgcagtgagccaagatagcaccactgcactccagtctggatgacagagcgagactccgtctcaggaaaaaaaaatcagtattcaaagttttccacttatctcaattatgtcttttatacctttttcaaaatactagaatgccgtcagggatctgacatgacctttagttgtcatgtgtgtttacccttctttaatctagaacgcttccttaaccttttactttgtttttattgttgaagacactagcttgctttttggtagaatgtcccacaatctggatttagctgattgctaaatgtaagctgattgcttatattgaagttaaatatagacatgttgtcctttttagtgagttaaatcaggagtcactaatgttgttgtgtcccataattaaataatgaaatctgaaatcaccaataatgggacactaatgtgattaatgttgttgtgtcccattattggtgatttcagatttcatatatgattaaggacatatctaccagatttctttataaaggtgcctttttccctctgtaataagtaagctataggataatgcttgagtctatgaatatcctatttcccaatggcccttcacccactggttttagcattcattgttagttcagcgcctgaattagttattacattgacgtgtcccaaatgatgatttttaaaaattctgtcttttatcatttatcagctgctattattttgtaaaataagagatgtcccaacccattcatacatatttgaatatattccaatttgaatatatatatatatatatatatatatatatatatatatatatatatgtattttttaaaatatcgctatctgagtatcaccatggactcttttttaaaaagttcactttattataagccattatcataattttcatttggatgctcaaattatgccaaatttggctagctcctttaagctggtttctgtcctttaacatgtcctcatcagttttagggcgctttctggaacagcataaatgctccacatacttggtattttttcagtgaactgaaatcagacattttttcaagagcactggttcctttctggggaatgaatttcaaaaccaagatctaggtgttagtgtgctcattgctattggggttcactgcttctagtttatttctatgacgagaactagacagcgtttttatgcacacgcgcgtgcacacacacacacacacgcacacacagttttacgtacttttttttttttttttgagatggagtcttgctctgttgcccaggctggagtgcaatggcgcaatcactacaacctccactttccagtttcaagcgattctcctccctcggcctcctgagtaggtgggattacaggcagatgccgctctcccagttagtttttgtatttttagtagagatgaggttttgccatgttgcccaggctggtctctaactcctgacctcaggtgatccacctgcctcggcctctcaaagtgctgggattacaggcatgagtcaccatgcctggcctacataaagaatttttagtgatactttcaagccagcattttagtgatactctcagtttcaagagttctttccactctttccctcattccctttttgtagcttccttttctcagagtgagaaccctgcatccaaatatcatcaatatatttatttgttgtttcacagtaaatactaaatagttttgggaattcatacgtcagttccactactagttccaataacaaactcattaaagttcaaatgttttgcaattctttttgtccttagaatacgttccagtgagtatagacagttaagatactctgtaaactggaattaaaaactgagattactttttattaatatcatataaagtttatttccatttgtattcagttttagggctctccccatctttattgatttaatttttgaatgtgaaaaacagtaacatttttttccatttcacaggaaaataatttagtgctcattacagctcatgatgtgctgttttattaaggtttgagtttatgctgttactatcaatgggggtcttttgtttgctatagcattataataatcattatcatttgaaaatgttggctgggtgctgcggttcacacctataatcccagcatttggggaggccaaggtggggagattgcttgagcccgggagttttgagaccagtctgggcagcataatgagaccctgtcttaacaaaaaaatttttaaaaattagttgggcatggtggcacatgcccgtagtcagtcttagctactcaggaggctgaagcaggaggatcaccagagcctgggaaattgaggctgccgtgagctgtgatcgcaccactgtacaaggctggatgacaaagcaagaccctgtctcaaaaaaaaaaaaaaaagaaagttgatgtttcagttgtaaattgactttctgaacaattcagttaaatccaggagttctttagattggatgctctgctgagtgttactattcattcacaaacaaagggtatttagatatgaatgagggtgctactctccttcactctattcaggagaattaaacaagaacaagaacagagacaaagatgatttaactgatcaagagtacaaagttcgaggctgggcactggtcgttcatgcttgtaatcccagcacttaaggaggcagaggtgagagaatagcttgagcccaggagttcaagaccaggctgggcaacatagcaagacaaaaaggaaaaaaaaaaggagggcaaagtttgaaagtataggtcagattggctttgttgctctccttctaatgaaagctttcagccctagaacatgtcagatagctttttgggaattgtcttttgtagtgttttttgttgtctttctggtttctaaaaatgagaatggtttttctgatatcagagtaacccataaaggtgtgaataaagtgaagatcattcatatacttaccagtcagtaataaccactgggaaaattttcgtggtaaacaaacctgctatccagaaggttctgtaacttgcctttttgttttcatataacagggtatcttggacattttttcatgtcagtaaatatagatatatctcattacttttaatggttatatattgtactgttatattaatatgctataattatattgatgaattgttggttctaatttttgaatattataaatatgctgctattgatacagacagattcacaaagatacatttataatataatttcttttcttttctttttttttttttttttgagacagagtctcactgtcgcccaggctggagtgcagtggcggcggatctcagctcactgcagccgccgcctcctgagttcaagcgattcttctccctcaggcttccgagtagctgggactacaggcgtgtgccaccacgcccagctaattttgttgttgttgttgttgttgttgttgttgtttttgagacggagtctcgctctgttacccaggctggagtccagtggcgcggtctcggctcactgcaacttacgcctcccaggttcaaacaattctcctgcctcagcctccggagtagctgggattacaggcgcctgccaccatgcacggctaatttttgtatttttagtagagatgggatttcaccatgttggccaggctggtcttgaactcctgacctcaagtgatccgcctgcctcagcctcccaaagtgctgggattacaggcgtgagccactgcgcctggccatatttttagtagagatggggttttaccatgttggccagtctggtcttgaactcctgacctcaagtgatccacccgcctcagcctcccaaagtgctggcattacaggcatgagccaccacacctggcctataatatagtttctttaggatagctcttagatctgaaattaactgtatatatacatttatacagttaataaatgtatatgcatatatacatttgtactcatccccaacagtgttgagtatgtatctttaaccatctggtaggtgaatattggtatctcctttttctaatactgatttttaaaattttattgatattgaactgtccaagaatacttcttgagtgaaaagctagctttattaattgattggctaggttttttagttgtatcacatgtttcttggatttctttgatatgtcttctattctttgtccaagtttcttattgtggtagtaatatttttcctatttatatgtgttgagctactgggttcttaacataataatgttactaatcccctgtcataggtgatgcagtttttttttcagtttgttatttgtcttttaacttgagtgattttttttttgtcaatgtagtaatatttttaaaaacaaggataatctttttaatggtttttagctttgtgtgatgtttagaaagggtttttcagctgtcagtgtcatgattgcagaagttgttacctaattttcttccagtgctttgatggatttttttttatttaagtatttaatctatcggaaatttattttaatattactgtgttattttgtatctccaaatgtctagctggttattttagtaccattcattcacttgaaaccactggtttgaaatgccactatttaaattccctcacatctttcagtagcttttgtgatgtagatatgggtaatatgtttgataatgtttcaactcttttttaatctttttcccagccacctgtctttaccagtttccaagactatgttactgggcttcagactttaatttccaatgttgtggatcatattaaagggcttgaaacacatctaattgcacttaaacttgaagaacttattttagaagacacttctctctcaccggtaagagattgtaggcaatcggcaatgttttctacacacacacaaacactctgtctctctctctcatctttatcacaaggacaagttaaagttcaatttatcatttcctctttataagacttgtgactagaaggtgcttggcagtagtttcttgttgtgttgttggtggtaggttttttcccctcttcatttctccccatacgtcctcctttctatgcatttttggggttgttcttttactatgaaaactaatgccagcattttgagcaacatggaaccagccatattttgaaatccagggacaatcttcttgaatagaatttacctgctgctgagttagctgtcttccttgccacccagttatcacctgagaaaggagaaatgctggacatgagaagtaattatgtcagtaataattaggctagagcaagccaaccaaaaagggaatgaaaccaagtatggaatcaaaggtaccaccatcaaatgtcttctgatattattttaggtcttttcaaattctattagttagcaaaatccttataaagcctttgcccttaaaatgacgattcttttttgtaaatgttaattcaccggcctggagtaggtttaggattttggtaggggcaagaaggacagtggtggagtcgtctgtttctagcctgttggtccagtgatgaaactgatcttaagaaaatgcttccctccgggagtttgtctgagctaaactgctgagctaaactgctgatgagggaatttatccagtaacctgagggcagccatcatcatagccccagaccttcatagggaagggaatgaatagaattttccttagcacaccagccttaagagattgtaagcccctcttttgtaaagcttaaaaacgttagactttgaacagagtgcttactgtgggaaagggctcagagcagttcacattaccaaagattgattaaaaaaagcagacatgggctgggcacagtggctcacgcctgtaatcccagcactttgggaggcggagggaggcagatcacgaagtcaggagatggagaccatcctggctaacacggtgaaacgctgtctctactaaaaaaatacaaaaaaattagccgggcgtggtggtgggcgcctctagtcccagctactcgggaggctgaggcaggggaatgttgtgaaccccagaggcagagcttgcagtgagccgagattgcgccactgcactccagcctgggtgacagaatgagactccgtctcaaaaaaaagaaaaaaaaaagcagacatgttcatattgaacctagtgagtgaaaaagtacctcctttcaaaatgaacatgtctgctttctttaatgaagagtggggacatttgaggaagattaattggttttcaccaggtagaaagaaatgtaggaaaaggatcccaagcagaaggaggcacagataaaagcacaggggcaggaaagtgaattctgtggcgcagtgtgacacagttggcagggccagagcttatggtatacgggaagtactgttagatatgaaggtgataggcacaatagccctgttgtgactatcaagtggttgtttatgttaaaagatctgtctgcatcctggaatgatgagcaagagttcttgttttcagagttctagaggttatccttaacttggccatactctctggatttttcaagccctagcttctgttcttgtcttttgaccttgggaaagttacctaacctctctaggcttcaatctctttatctgtaaatggaaatgataataatgcctacttcataggattatggcaaggattaaacaaagcaataatcggccttatgttgttaaagtcatgtttcatatagttactgagcactaccaaatacctgatgcatatagttttggctaattgtcttttaaaggtaaaaatctcttcaattcagtttccattaggctcctctgctttctttcctccctttctaaatttgaaacactgtgaataaggcctctggactgtgacctctagtcctgattccctttcttccttcctatggggtatcccagtgaaactggctgtgtgttaggacctttttgtgtgtatttatattcatagagaaaatatacagtattattgtattattttgtactttaaaaaatgtaaactcggccaggtgtagtggctcatggctgtaatctcagcactttgggaggcccaaggctggaggattatttgagctcaggagttcaagaccagcctgggtcacttagtgagtcctgcctcttttaaaaaaaaaaaaaaattttaaattcagttttatattcaagagatctgttcaagctaatgcctgtggatcaatcttgttcattaaacagctgcagaatataaatgcaccactgctgttggacattttaggttgtttctttatatttgcttttacatatgttaccgagtgaaatgtatttgtgcacacctttctatgcacatttgtatttctaaggaaaattaggtctgaagtactagtattgttgggtcagaaagtatgttcccggtttcttctacagttctaggctctgcagcactcaacttcatgtaaacctaatcagtcttcagccaacctcctttctctgtgagaactcaccccttcccttttgttttttgtgatctctactacagcaaacatttgccagcaaataataactcatattgaagaatatatagttggtctcttgaactcaggggctttgtcaatatggaggagacttgttaatattgtaactggaaatgatggagttggtaaagttgaggccattattaaaagtggctatgatgatgtacaaattagtaataaatttctacttttttctgatgaaaacaatcagaaatctcaaaatttccactttgcacaggttataacaaaatagtagggattttatgtccaaactagtcataattttctgtttttattgattaaaaagtagtgatcagaaatctcagtttttcttctaatttttttttttttttttttttttttttgagacagctttactctgtcgcccaggctggtgtgtagtggcacgatctcagctcactactacctctacctctagagttcaagcaattctcgtgcctcagcttcccaagtagctgggattacaggtgtgtgacaccatgcctggctaagttttgtatttttagtagagatggggtttcaccatgttgaccaggctggtttcaaactcctgggctcaagtgatccacctgcctgggcatcccaaagtgttggaattacaggcgtgagccaccgtgcctggcccagtttttctaccttatataacttacaacaaagggtacttgaaagagtaatgatgctaaagcaatagggtttccatgaagaatcacatcgaaaaatacccattcgtgatgaccttttgccttctttgcattttatgcaattgaaaatgacccactgtgttctgatggagcttgcaatgagaccaaaggtaatggcagctttaacttttatctgagaactagaatctggggggatggtttttaaacaagactaattattcttgtctcctcctttataggaagagagaaaattttcaaagactgtgcaagggaaggtgcagagcagttatctgcactcacttctggaaatgggggagctgctgaaaaaaagacttgagaccacaaagaaactaaaaatttaaggaagtatctatcatgggcactgatgactctgcaacagaatatgacaccatcttcccaggcaaaagcaacatctggttgaccatgattttaatccagaacttcctcataaaatgcatgaaggactttgatcgtgaatttttttaggtgttaaatatatacaactgattaaattattgtatataaaccagaagcgggaccctcatctgggtttgaccactttttatacatgttcatatgcatatggcagcaacaagagaaccctacttttcttcttcccatcaccagaaacatcttttcaggggagcggggggtctataaaaacagcaatagaaattaagcataaagcatcaacctcatagcaactgaatagcccttccattataaataacattgagagtttttggtctggtccttgagccacaagaagtggaggggagaccatgcctgggaacagacccccttttcacagcagtaagtttgttttgaggctttctcagctacttggctcccacagaacccaaggcaggtacacaaaggaccttagatgagatctggcatatgcacccgcaatagaagggcaccacttggatgaccacaggcacttagtttttggctagtttttgtctgatagttaagacatccccatcctagcttctgtgagagttaaaaatctcaggtaagaaggcaaggaaggctctgttaatttatagctgtttagaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaatattatggatttagccttaggctttaagttttaggctggcaaaagaaatgttattcagtgggtttgaggtttggactactttcttcaaacttagagaattataacaggatggtgtttactttgttcacctggatgtccccaagactctagcttcttctatcagtggttggtctgatagaagaggtaaaaattgctcttgaaaatgtcctacaatttatgcagtttctttgataatatttttctgtttaaatccctgcttctgtttttggtctgttacctaaatatagttcaagtttaattctgtaagagcaaagaaatgaatttgatgaggaaattaagcatccaatggaggattggtcttgaagaccttaaaggtgctttccaacctgcactgctccagtgaaatgtggtacttttttcttttaaaagcaaccaagagagctgggaatatctgtgtacgcaaagtaattgcattttgtcccttcattttgactttcttagattcataatttgatacagtgcttaaacttccaaggaaattttaaacaattactacattacctgttcaaaataaggcttgttggaaatcctagtccatcaactaatttcaaaaatttatttttgatatgagtagcaacagctggtcatataccctatcccaaaaggaagaactgtcttgaacaagatgaatggaaaattgtggttaattctgaatttcatgtaatgacaacatattctttcataaaactatggcctgtttaagatggaactttgtgtgtgtctgctggggagggtggggtacatgtgtatggcgtgtgttcttgaaatgatgtctctctgaatatccaaaaaagtactgtactgtagaaatgctctttgaaaaagtctatcgactgaccatgatcaatctagcatatgtatgttcagtgggctagccttggtcctcagggacagtgtgtgactctagtggtcttcctaaccagtctcttgcctaaagatatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatatatatatattcttacatgagtaaaaagcaccctctcccagcaatcgtatgccattggtatttgaagagaattcccaaataacccattgctgctgctgctgtttttgatttgtatgggtttttttgttttgtttgtttttgtgtggtaaactgatatttaaaaaaggaaaggagaaaaatcacgactactgtttacagactgaaaaattattgctttttatactactgagatcctaagttaagactctccaaagcaaacatttggtttaaatcatttatctgatgtagataaaaggtagagaaacttgtagtgttctccacataatggaaaatgtacaaatgcctagttgtgttgcccatcaattttgtatattttcataattttaattgttgaaaattgcattatattttgcaatcactatgttcaatctggatttgtctttcattttaacttttaatataaaaaggggtttcaatgtatctacaggcttgttattgaaacttcctacttatttgatgtgatttattaatataggaagtatatattcttccttaagtaagtgaagcatagcaaatctactttaaactggatgggttaatttatataaacattttcattttaagttggca

SEQ ID NO: 71 - DNA, 15272 bp, Homo sapiens
gcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggaggtaagggcggcgggggagtgacgcggggtgggccggcgggtggggctgcggggcgggggctccgggcccggggctgtgggcgccccaccgtctccacgcctatggctatctggcgctctggccgcgcaggtcctcgggctccctgcttcttttcaaactccatctctgcctccccaaatcatcccttgttggattagcgtggacctgtcattgcaggtttctacccgtcagcgagccgtgaatgattgagtgggtggtgaccagccgtttctctaacgtagtggaatagactagaaagcattattgcttttattgcagttattgcgagcatgcttgtgtgtttgagaggtctggatcacgatgtcagaggaattttttatcttggattttcaaaccaatttcaagctattgccatgctctatcctgttagcgattagtgtttcttccatgtttgacagccctgtctagacctgtgttaagctgtctgctccatatttgcgcttcatttttactcctcagcccagctcagtctggcgtccacgacacttaaatgtttcttgtcttgatcagcagtgatctccattctaccaaatccaagggacataagtcagcatttgttggactggccactcctttctttttgaaacatggtggtaggattttttttccctatttcattgcctgatttttcttttctatccagtctctaagtgttgagttcctcaggatggggcctaggtcatcttctgatgcatttaccctgaagtgtcatttatttctatgattttaaatattgcctgtattaggacaactaccagatctgcagctccatcctagatctttcctccaaatctactttacatatccagctgctctcttgacatctagtgggtgtcacgcaaacatctcatttaacatatttaaagtggaactcttcatttttctgcttaaaccccagcttttcccatctcggaaaatgacaccgctgttcaaccaaaagcaaaagctaaatgtggctatagtgaagccccatgcttaacactcagttcatccatgaattccatcagttataccaccggaatatcacttgaattcatctgttgtccattttatttggtctaggccaccattgtctctggcctggatttgtgtaaaaccttcctatttgggttcccttatccctgtttttgtcccgtccaattcgtgctccaaccagcagcaagtgtgactcttaaaaattaaaatctggccacagcactgttttctgcctaaaatcaacccctcagtggctttccattatgcccagaataaaacccaaatttccttctctgaacctggctctgctctccattttagcctcattttgggctgttttgtatcttgttcttttgaaccagtcaacctatggcccctccaagctttttcttggtggaagatcttcatgctttctgcccccacttgggaatcttcttttttgtttttatttatttatttatatattttgagacggagtctcactctgagacggaagtgcagtggcgcgatctgagctcactgcaagctccgcctcctgggttcacatcattctgcctcagcctctgcagtagctgggactacaggcgcccgcctccacgcccaactaatttttttgtattttagtagagacagggtttcaccgtgttagccaggatggtctcgatctcctgacctcgtgatccgcctgccttggcctcccaaagtgctgggattacaggcgtgagccaccgcgcccggcctcttttttgtttttaaataaagagggacttcatatggcaaggaaaaggagaaaaaaaaaatcagagaggaggatcttactgtgttgcccaggctggtctcaaactgctgtgctcaagcagtcctcctgcctcagcttctcaggtagctgggactatagctgtgcaccaccacacctggctgggaatattctttcaatgactgagtttgttttcttttctttttttgagatggagtcttgctctgttgcccgggctggagtacaatggcagaatcttggctcactgcaacctccgactcccaggttcaagcaattctcctgccttggcctcccgagtagctgggattacaggcatgcaccaccacgtccagttaatttttgtatttttagtagagatgggtttcgccacattggccaggctggtctcaaactcctgacctcaggtgatccagccagctctgcctctttccaaagtgctgggattacagacgtgagccaccacgcctggctgactgagtccttttcattcttaaggtcttagtgtaaatgtcagctgaccaccctatctaaaatagtcctctccatctcagcaccttacacactttagaatgtttatcataaaccatttaaattttttttttttttgagatggagtcttactctgtcgcccaggctggagtgcagtggcatgatctcagctcactgcaagctctgccttctgggttcacgccattttcctgcctcagcttcccgagtagctgggactacaggcacctgccaccacacccggctaatgttttgtatttttagtagagacggggttttaccgtgttagccaggatggtctcgatctcctgacctggtgatccgcccgtgtcggtgtcccaaagtgctgggattacaggcatgagccaccgcgcccagccaaaaaaaattttatttatttatatgttttttttttgagatggagtctcactctgtcacccaggctggagtgcagtggtgcaatctcagcttgctgcagcctccaccttctgggttcaagcagttctcctgcctcagcctcttttttttttttttttttttttgagacggagtctcactctgtcgcccaggctggagtgcagtggtgcaatctcggctcactgcaagctccacctcctgggttcacaccattctcctgcctcagcctcccgagtagctgggactactggcacccgccaccacgcccggctaattttttgtatttttttagtagagacggggtttcaccgtgttagccaggatggtctcgatctcctgacctcatgatccacccgcctcggcctcccaaagtgctgggattacaggcctgagccaccgcgtccgatcctgcctcagcctcttgagtagccgggattacaggcgcctgccaccacgcctggctaatttttttttttttcttgagacagagtcttgccctgtggcccaagttggagtgcagtggcacaatctcggctcactgcaagctccatctcctgggttcgcgccattctcctacttcagcctcctcagtagctgggattacaggcgcccgccaccacgcctggctaatttttttgtatttttcagtagagacagggtttcaccatgttagccaggatggtcttggtctcctgacctcgtgatccacccgcctcggcctcccaaaatgctgggattacaggtgtgagccaccgtgcctggccccagctaatttttgtatttttagtagagatggggtttcaccatgttggccaggctggtcttgaactcttgacctcgtgatccgcccacctcatcctttgaaagtgctgggattgcaggtgtgagccactgcgactggccacaagccattcttcaactcatttacctgtttgtggcctgtctccaccctagaatgtgaattctgccagggcagggaccatacttatgccctcttttgtctgcttagtagagtgcctggcacataggtgtggacgttaaagtgtttgttaaatgcacatgtgatctgatgaccaaacttctctgctctcatgcatagttggctgagaaaatacggggaactgtgctgggcagagctcctgtggattcaggttttcacatcaagcagggtccatgaggacacctgttcacttggtaaatctccttcctggcttggtcagctcccttcctgctttcttatgtctgctcttccaaacctctgcagcttgaagtcctgatttcctggtttctagtattatctttttccttctgtcattttccacacactaccatgatgttctttttcttttttttgtcctttgtttttttttttttgttttttttttttagataggttcttgccctgttgcccaggctagagtgcagtggtgcaatcatggctcactgcagcctcgatctcccaggctcaagtgatcctcccatctcccaagtagctgggactgcaggcatgtgccaccgcacctggctaattttttgtatttttggtagagatggggtgtcactgtgttgcccaggctgttctcaaactcccaagctcaagtgatccacctgccttggcctcccagagtgctgggattataggtgtgagccattgcactggccagaatgttcttctagtactgtcatgatcctactctcttttatccatttatttattcattgttgttagttgtgaattgtgtgccaagaaccatgttaaactttgaaaaaatagtgccaagcaaagcaaatgataatccccactatggtaggacttcctctgtcatgggaagacgggtccaagagagtaaccgcatgggggtgtaataaatatgcatttggtgtttacttgtgttaagcacctgttttatgtgctttacacatatgaatgcagagtcctcacaaaaaccttgttagtagaggcgttagagatgtactctgaatgatagtggttcctggcagatcagaatccagcctccacccctgcgtgtgactttgtgtagtcagaaactgatggccaggcgaggtggctaacgcctgtgatcccagcactttggggggccaaggtggctcacgcctgtgatcccagcagtttggggggccaaggtggctcacgcctgtgatcccagcactttggggagccgaggtggctcacgcctgtgatcccagcactttggggggccgaggtggctcacgcctgtgatcccagcacttagggaggccgaggtggctcacgcctgtgatcccagcacttagggaggccgaggtggcttacgcctgtaatgctagcactttgggaggccgaggcaggaggatcatttgaggtcaggagttcgagatgagtctgaccagcatggtgaaaacctgtctctgctaaaagtacaaaaaaaattagccaggtatggtggtgcatgcctgtagtcccagttacttgggaggctgaggcaggaaaatcacttgaacctgggaggcaggggttgcagtgagccgagattgtgccactgcactccagcctggacaacagagcgagagactgtctcaaaaacaaaaaccaaaaccaaccaaccaaccgaaaaaatcaccagaaacttataagggatttgaaagaaaatgtatggtcctgtggagagtttggggggcttagtttgtttgagatgaaagcagttacttatttatggtgagctaaagaatgtttagctccaggtggaggaaacctggtgttggaaggattggagtttttacaaaaattagccgggcgcctataatcccagctactcaggaagcttaggcagggagaattacttgaacccaggaggcggaggttgcagtgagctgagattgcgcccctgcattccagcttgggtgacagagtgagactccgtctcaaacaaaacaaaacaaaacaaaacagaaggttccaagttgggaccatagagcagaggagggcaggcagctggagagggaggctggccagcatggaggcctccctctggctccgtttaggattttgggtttttcctgccactgttaggaaaaacccaaaatcctaaacagaggcactgagcagagcgtggagagtggacgggaggggagtgaagggcaggaggagccctgtcagtgcagaggtgaaaggggaggtggtggggccagaatgggggtgactgtggagaggaacccctgggtttctgggcaggtgggttgggggctatttggagttcagtgtggatgcattcagtatgaatcttggtgaagccatccaagcgatgtttgaagaaggcagctgaacatgtgggtttgggctcagatggcaggtccaacctggggaggtgagaagacaagtgaagcccagtagtgtcttgggagtgggcaagccagccaggctgagggtcactggagagaagggccacttctgcagctcagcttccaggccgccatctcctccatgttcccttctttctggaccagctcttcaggtcctgaacacccccgaggtccttacactccgtagacgaccatgctgctgtttcctctcccttcctcccagatctgacaaacaccctttatccttcaagagctaatggaagtgactccccttggggatggcttcccagcctctgccactccttcgtgctaccatggtgcctaaaatcttgcctctccccagcacgcgccatgctttggccatgtttagatcatgctcattttcctgaagagacgtgtccagtctctgctagctgccttcacgttcccttcatctgtctggtgagcctctgcgtttttcaggcttagctttgacattatctatgcatgtgttcatcaaatatttactggacaccagtgtcaggcactgaacagaaggctggaattacactaatgctgctcacacagttcactaagggacacgatcacactaagggagcggcacagaggccccaggaatggaggggctctgaaaaagagtttgcgtggggacagctgggggtcggtgttccaggcagatggaaatgcaaaattgaagagctggaaagacacctaggggcttcaaagtgtcgtttgtggctgggcacggtggtgcatgcctgtgatcccagtgctttgggaggctgaggcaggaggatcactggaggccaggagtttgagaccaacctgggcaacatagagaaaccctgtctctacaaaaacattttttttttgagacggagtctcgctctgtcgcccaggctggagtgcagtggcgcgatctcggctcactgcaagctccgcctcccaggttcatgccattctcctgcctcagcctcccgagtagctgggactacaggcgcccgccaccacgcccagctaattttttgtatttttagtagagacgaggtttcaccgtgttagccaggatggtctcgatctcctgacctcatgatctgcccgcctcggcctcccaaagtgctgggattacaggtgtgagccaccgcacccggccttttttttttttttttttttaaagtgtcatttgctgagaaggaatacaggagatgagccagcgttggggaagatgttgggtaaagtatggaagtaaagtgtttggggacatttgaatgtactctgtggacagctatgaatgcagccccagagctaaggagagagagctggtcgggttgggtttggggctcattggcttatggttggcagcttgggcatgggatgaaggaatgtgcatggcggggggtggagcgcctggcgcactgacgtttaaggggtgacagaggagctggggctccgggaggctgaggggagcagaggaaggatggcgactcacctgtaactgtttcctgagttctctgctcagaggatggagacctcagcattttatctctgcctttcctacccctgaggttcccttttcttctctgtgtcggggatcttcctgctggagtctgtcagcctctggcgccttgtggagggagccgctgtgctgccctggttgtttgtagacagtgtgccctgggggccttccacttccaaaacaggtttttgttataggaagtagggggaaacacagagacctgtctctgccccgaaataccagggacaaccggtgagcccacagcatagctagagctgcccgtctcgggaggtgctgggcagagaccaaagatgggtggggctgccctggaagaagcgagtgcagactgggccttggattccccctgtctttgtgttgtttcttgcagctggatcagatctgcatttcttttgacgaaggcaagaccacaatgaacttcattgaggcagcgttgttgatccagggctctgcctgcgtctacagtaagaaggtgggccctgcttgacgctggtcttggcattttggtggccagtgggaccacagtcggctctccttctggggcaggtgcagtggtcgtcccgtctgtgacctacctccctctctcctcaggtctcagccaattcctcagcaccttccaacaccaagaacaatttttaatttaaaatcgcacagccaggcagggagggtcttttgtgctgttgggctctgttgtcttgggggaatgacacctgctgtgtgcacttggacacagcccagggtgccacctgcacccaccttccccttccccgtcccctacttgtgggtgcctcattgtcagcacctagaaagtccacaaccaccaccctcacggtggggcctctgttctgtggaggagaaggacaggaagtgagtgacgggctctgtcctgcaggccccgtggcggcaggagctgggacagggcagggccaggacaggaggaggggctggggtgatgctggcgggagcacacgggcggaggagcagcagggctgcaggccgtcggcagagtgggtgccaagcacgaggggcctcaccaccaaggaccgtgtgatgaggcacactgtgggaaccacagtgctgtcagggtcacacgttgagaaggccacgctcgcggctgcgtggaccatagagggcagaggagagatgtgggtggcctcagctggtaaagtaattctcatgagattcctggtttgatttgagaattatttttggaaccaaaattggtggtttcttgtactggaggtttggtggtggtggccaggcctcgtgggggcaccgatggatagctgggaaggccttgggggtgggcccctcctttctgggtcctcactgcctgcatctggtcaccaggtggaatacctctactcactcgtctaccaggcccttgatttcatctctggaaagaggtgagttctgcagccactcactgtgctgccctgcatgtggccagggaggcccctgcagctcctgggatgcccacgggatgtgcttctctctcaggcgggccaagcagctctcttcggtgcaggaggacagggccaatggggttgccagctccggggtcccccaggaggcagagaatgaggtgagtttctttggcatgtggtccccgcccactgtgtgtttgcctgggctccgcccccacgagctctgtctccctccagttcctgtcgctggatgacttccctgactcccggactaacgtggatctcaagaatgatcagacgcccagtgtgagtcctggcctggcccctcttaggctggggtgaggtcagcactttccctggggctgtgttgagctgatggggtgtgggaaggtgtcattgccccatgtgggtcctgttctccactggagtggaagggtgcctggctcacccacccttggcctccatgcaggaggtcctcatcatccccctcctgcccatggccctggtggcccctgatgaaatggagaagaacaacaatcccctgtacaggtagggatctgagcccagcgacggggagggaggcctgcctgggaagggtctctacagcaggcgtgtttttgccagcacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaagggtgagggcttggatgcggggggcttggtgggaaggaagggagggtcttctggttggactcttgtggggtgccctgtgcttgccacctctggtcttgggagctccctgtctctgggtgcctgctctagtctagacaggttggctggtgctcatcccacccatctgctgtgccttgattacaagttaacatggtctcagtgccagagacctggtgcctggctcagggccctgctgtctccccccagcccaaggcctggagtctgctggtctctgccctcctgctggccccttggagaggcttgttgaacaccgggcagggaccatcttggagaggggctgggctgaccttgtctgatccctgtctctcccagacaccgggaggactgaggagcagccaatggaagtttccgtgtgcaggagccctgtcccagcactcggcttctcccaggagccaggtgagaagagagctccccggtgggactggcagggcagccaaagaggggaccagggaggcagcacccagtggacagggctccaaggggctgctctcagctgccagcctcatgccccttctgtggcccatgggagtgaggcctcgccccggggaagcagccacagcccccggtgagcctcagcccatcttggttcactgactgccctctgactgccctcctgggtctcctctctgggcagatgtggatggctgcatttaaagaggaacatttgctaagaaataaaatgaaccaagcagagcacagagcacaggagcacgacgaggatggtgcaaggcacccgccaaatcctctgggctccgtgactaaagctgagggaggaagtagccatcagggtccctttggtgccgtctggtctcggcactccttggagctgatcactctcttgctccctgcctaggcccctctccagaaggcccgatgcccctgggtgggggcgaggacgaggatgcagaggaggcagtagagcttcctgaggcctcggcccccaaggccgctctggagcccaaggagtccaggagcccgcagcaggtgggacccacatggaggcctgcagaacctgagctgtgaactggcaaccctggctctggggccgagtcaccttgcacaaggaggacagtggtatggccttggccccagaccactggtctggggcagaagcccacctgtcttgcagcccgtcctgcaaccagcccttttgaagagcagcttctgtgttcctcccctctctgagcagaactgatgctcctcagagtagtgggctggcgtccaaggatttgagccctgtcgagctcacggcaacctgggatggccgccggttgccaaggcgcctctctgcagtcgggctggtaggagggagtgtctggaggccattgctgcctccctcaacccccggggtcaactgtacccagcctagagccaagaaatccttcctttttattcattaaaacaaaatcaacctgatgcatacagaggaaatgttaacgtttcttcactctagttggtagatggcatggatatttgtcatattctattcatttttcctagttttgaagaagagtaccccgtgaccactgtttgtgttttctgtttgttttttgagatggagttttgctctgtcccccaggctggagtgcagtggtgcgatcttggctcactgcaagctccgcctcccgggttcacgccattctcctccctcagcctcccaagtagctgggactacaggcgcccgccaccatgcctggctaattttttgtatttttagtagagacggggtttcaccatgttggccaggatggtctcaatctcctgacttcgtgatctgcccgtcttggcctcccaaagcactgggattacaggcgtgagccaccacgcccggcccactgtttgtgttttaaagtttttcttagggtttttgttttaatacccccagagagtactagcagggtttatttttatcttattttatttatttatttttgagacagggtcttgctctgttgcccaggctagagtgcagtggcctgatcttggctcattgcagccttgactctctctaggctcaggtgatccttccacctcagcctcccgagtagctgggactacaggcgtgtaccaccacacccggctaatttttgtattttttgtagagacggggtctcactgcattgcccaggctggtcttgaactcctgggctcaagtgatctacccgccttggcctctcaaagcactgggattataggcgtgagccactgtgtccggtccctgtaggttttttttttttttttggacggagtcttgttcttttgcccaggctggagtgcagtggtgtgatatcggctcactgcaacctctgcctcctgggttcaagcgattctcctgcctcggcctcccgagtaggtgggattacaggtgtgcgccaccacacccggctaattttttttgcatttttagtagaggcgggggtttcaccatgttggccaggctggtctcaaactcttgacctcgggtgatctgcccgccttggcctcccaaagtgctgggattacaggcatgagccaccacgcccgacccttgtagggttcttgatgttaacccaaggtggagttcctggggtacccagagccttgaggggagaaagaggagaagtggggaccctgtgactgtctttgcagagtgctgccctgcccaggaggtacatgctgcgggagcgggagggggccccagagcctgcatcctgcgtgaaggtaggagtgttggggccctgacccccggcagggagggatgggcggattcgaggactggctgcctgcccatcatgctcttgctcctgctggcctgtggtgttcccagcctgtggccctttgcacttgctctcttaaagaccccctcatgcgactctgggctcccaccctctctctagtgttcccctctgtgatccaggatttgagtgtggtcggctctgccccaggctgtcactgcacttgttgcctgggctttgggaaggcggctgtgcaccccctactcctctgggagggtggctgtgtaccccctactcctttgggagggtggctgtgaaccccctactcctcctttgggagggtggctgtgcaccccctactcctcctttgggagcgcggctgtgtaccccctactcttcctttgggagggtggctgtgcatcccctactcctttgggagggacggctgtgcaccccctacttctccagcgccttcttgtgctctgtgcccaggagactccagacccctggcagagcctggacccctttgactccttggagtctaagcccttcaagaaaggtaattgggtggaaggtacctccactcaggtacccctggctgggtttcctggggcatgaggtgggggggtgggagtgggctttgcaccctgatcccccagcggctctaagacagtccctgtttgcccccaggtaggccttactctgtgcccccctgtgtggaggaggctctgggacagaagcgcaagaggaagggcgctgccaagctgcaggacttccaccagtggtacctggctgcctgtgagtgggtgtggtgtgcactccggaccactgggagctgggggctgggccagggccagtggaggaggatcagcacccttttcccaatgctgtgggcagctcttggcctggctggtgctgagcatgttctttcacagatgcagaccatgccgacagcaggcggcttcggcgaaagggtccgtcctttgcaggtgaggctgaagtcctcggggaagacagttttactctccttcccctacctcttcccccacctggtgtcacccaaagccttgggtggactggcacggggcctgggaaggacgagggagccctcacaaggcctttgtctgcagacatggaggtcctgtactggacacacgtgaaggagcagttggaaactctccggaagctgcagaggagggaggcaagtcccagctggtcagctgtgatctaggaccccgtggtggccctgatgggaggtgacagtgcccctcacagatgctttctctggacaggtggctgagcagtggctgcggcctgcagaggaggaccacctggaggattccctggaagacctgggggcagcaggtgggtgcctgccagggggtggggtggggcttggcacctgccgactagctgcctgcgtgctgttcactctcccacctcccagcagatgactttctagagcctgaggagtacatggagcccgagggagcagaccccagggaagccgctgaccttggtaggtgggcagcgggctaggagtgctgaggggccactggagctgggggcaggggagagcgtggccccttagctgcccagctcacagctaccccttcccagacgcagtgccgatgtccctgagctacgaggagctggttcgaaggaatgtggtaggcctgggttagagggagacggggaggggagggggacaggtgagcggtgcccaggcccctgcttgggaggcagtagctcctgctgatcctcccctaggagctcttcatcgccacctcccagaagtttgtccaggagacagagctgagccagcgcatcagggactgggaggacacagtgcagcctctgctccaggagcaggtgaggcggggccgctgggaaccagagctgtgtgccacgggtctgtccagggccttgcctctctccgcagccaacatgcccctcccctgtgcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggtgagtagcctgggatacgtgggagggggagacggtccccagaccctgctgatgtgccacccctgcaggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgtgtctgctcctggctggcccggcctaataaagcagtgttgccatctcatcttccccctaaaaa

SEQ ID NO: 72 - DNA, 1766 bp, Homo sapiens
gagagaaggagagcctgcagacagaggcctccagcttggtctgtctccccacctctaccagcatctgctgagctatgagccaaaccagggatttacagggtagggagggtgggataggcagcggcattagatcggaggaatgagatggacagacctgggctgtgggctaggagggcagtcagctggcctagggtagcccgggctggtgtcagggtaaggagaggaagggagggatgagggctgattaatttttttcaccccacaggaggaaaagctttcggactgctgaaggcccagcaggaagagaggctggatgagatcaacaaggtagaaggaagaactaagggggcagagccagggggatggggcgtggatggggagggcctaccctggctcttattttcccctccatagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccctgctgaaaaccctccagtcagcgcttatcccttctgctctctcccctcacccagagaaatacatggagtttgaccttaatggaaatggcgatattggtgagaaacgggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 73 - DNA, 4630 bp, Homo sapiens
ccgcggcggagccagaggctgcaggaagagcccgcgggggcccggagggtgcgattcctcggcccccgcaaaacaatgtgtgttgtgagccaggacgcaacttgccggaggcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagcgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctgccccctcctggacgtgcccatcccccctcagatccagacatgcccctcccccgcagacacaccccaaggcagcccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggacccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccagccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgaccttgccctgtggttctgcatgtctgtgctcttcctcaaccctccctaaacagtttgccagattcaagtccgtgtgatttgggcccgagctgggtgtcccagggcaagccaccttgcctgtctaggcctctatgtcaggactccctggccttcatgaagaatagcaaactcatccctgtagggaccaggcaggtaacatagacgagtgactctgggtggacagtggtgtcatgacccacttcaaggggcctacctcctgccagttgtgaccctgtgggaatgcagtccacagtggccaggtggccagatttttcaagaaaagctggatggatgtttctgagtcatcttaatttcaaaatgagactcatattttaaaatttctgtgggccaaatgaaacaagtatgcaggcaggtctggtccgagggggctggcttggccatgcctttctgtgcctttaatgaggactaagaagcaagattgggccacactgtctggactcaaagcccagctccaccactgagcacccgtgtgactctttccatatgtataacgtggggataataataatagctgcttcacaggatgaaatgaagtttgaggtgagaagcattcaccatggtgcccatcgtgttactccattgtcagaggaggaaacggggtcaggcaggaaagcaacttaaaggagggcctgcaagcagccagggtcagagacagggcttggttctgcttcctggtgaagcatggcttcggggtgctgcctctccctccctgtttgaatctgcagattgtgttaggcccccagctgagggcctggagtggtgggattggtcccagtgcctggcgcacattggcctgcagagtagattaactgaatgaccaaagagcaacagaagtctagtgattcttgtctttgaggttctgactggtgttttacaactgagtccaaggcttttccctcctttgtccctctgacacccctccccctaattctcatctgtcagatccagtgtattcctaagctgggacaaagcctctgttttcccagtaggagccagggctgagtgtggaaattacagtgactgcttcttctcagcttctctggttgaaagcaagctggcgaagtaagaggaggtagagttgagaaggtgtggaagatagggacagctgcccccagaactcccttcaagggaggacttccccagctatgggaagtgccatcagggtggccgcagctgcagagagccacttcacctgagaccacgcccttcctggggcagcctgtatctggtgtctgagtgaggcatggtataaacacctggtcatttcaatccaacatgggacggacactgacagacagtactcccagcaggcccaggccagccagggcttcgtcaggcctgcagcacaatttgacttcctatgcccaggcctgcttcctcttcttcctcttcttttcacaggtgcttattcctaataaacatcttgcaacccaaa

SEQ ID NO: 74 - DNA, 248530 bp, Homo sapiens
gagcatcttttggggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtggaaaggggggctcgcccaagaagggtgaagaagcgaagaaagtcgaggcgccgaggctcccaaagctggcagctccgggtggcggtgcaggggcgaagggggggcggggggaaccgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgggcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacaggtaggtgagggcgcctcggcgggcgctgcaccgtccctgcggccccagaggctcgcgggtgtctgggcgcgggtggcgggcgggtcgggggcttgcgggcgtgtctgtgcgagagctgccccgcgagcggcgcagagacatccgggcgagctgagagcctcactttgctccatcggtggaatgggcacactcggaaggcgtagctgctccatccctgggaggaacctggggagccctcctggcggccccgcggaccctcggccagtgagggctggttcccggagcctagggcacgtaacccgtgctccgaatggtcagatgcactctctccttttgggatgaaagggaggatgacccaattgagatgcatgtgaaaggagacttggggaccgttgatttctttgacgttttaatggaggtaactccccttcattaggccccattcccctgaaagccggcaagggcaaggttgttgtaatggccaggacttagaagtcctcgaagtgccccaaagttgctcactgattgaagcctgcctctgggactcaccctcaccccctccacgccatcccatgtcctagcttttaaagcccattgcctgtcactcggggctgggacgagaccttcctaacgcataccccgccagcgttccccagacgcggctgcgaaacggggcgcttttctcatatgggactttatgagcccgtaatgaatttgagttctccctcctcaacctccctctctctccccttcgctgttccacagcaaagcctatagtgaaatcggacactttgcgaggattgcaaaccttagaaatgctccagcatccattttcccccctctaaatgaatctgtggaaatgcctttaataaaactggggagcggaggtgggggcggcgctggaagagaggaggaaagttttgccttttctgtctgggagattccctttctgcacaaacaatcttgccatgtcctgggacgtcttaaagtgagagtaggggttcccccttcactgcagccaggaaacgtgtgaaggcgttttgcgatcccaccccctcacacacacactttcttagaagggaaagctgtgagctctccgggcagttctgcttcttcctgtctttccatggcttggactttcacagatgtagcactgactatccagttgacatgaagacccctttaggagacccacactctgctgctatcccaagaatacgtctcccgaagcccccgctttccagctatcaaaggagagcgatacagtgattccccccaacaacccacaactgacgtcatcgcatgctatttttcctttttttttttcctccgggaagaagaaggagactgaactcattcacttttaactcgcaagccctatttgcccagaggagggtctaatttggaacagaggaaacgttatccataataataatgacgatggtgataatttagagctgtagtatgttgacttctctttccaaacatgtgaaaaagcaaagagactgctgcttggaggtgatttttttttttttttaatctgtaggtctggtttttcctagtctttacctagtaccagtgatttggaaggcattccctggagagaggagagcacagggttatgcaggcatcatcagtgaaagggtagtgaatgcattttaactatgtaagtgtgtctacataaatacgtgtgtgtgtgtgtatatatatatatacatgtatatatatgtgtgtatatatatatgtgtatatatatatatgtatatatatatatataacacctgggattccacaggagactgctttataaatgtctataattcagacaaggagcctctcttcacacacattctcttgagcactcattcactctctcacacaaagattgttgcagtaaaatactttaattggatggggggcgttaggttattattgcttgtataaaatgcctggtccattttatgtgtagaaataacattcctctcaaaacgaaaaaaataaaataaataaataagcactgctgtcgtgtagcaccagaaagccaggagcttttcccctgaggattctggtggatttcttttccctcccctagttgagttggagccagatttggcggcgtgtaaacacctggctctgagccagaaaagactcattctgcatatcctccacatggtacaggctgttggactaaaaagaacctgcttctccttgaattaaaaagcaaacaaacagaggttctttgcagaagtactttttcagctccctccttcgtgtaagtttgggctgggagagccaggaccgaggtgggcagcaaggatcgggtgcgaaggctcaccctctcgcggcgacctcaggtgcccagtttgctgcctgacctctgctggctttctctggctgggcgttgccactttcctaggaatccctggtcacctatcttgagagagcagtcatcgctcagcagggaccgcgctgctatttcaggcagagagttgctgtcttgctgtcaggccaggctgccttacatcactctttgctgcaggattcaattgggtttcgtaaaggtctaattttacggtgctgttaaccgggtctgtcgtctggcagaggcaggccttgccgctcctggtaggcgggctatgctcccagatccgcccgggatgctatttctgccccggttcaaacttcactgacaccagttcagacaggcgctcggagagacagggggaaggagcgaaggagcagtttgcttctgaagctcagaaaacatgccttttatttttctgaaaggaaaggagaaaaatatatatactaatacataaaaaaagggaaggcttatgcaggcaaaaacaaagccaaagttagaaagtgcctatgtgtaggattctctggagggtccaccagtggatggtctttaggattgaagaatcctttaaggctgctgtgaaaagggtcctcagaggttacccaagccagtttcccttttggccgaatggggagagagacacacagagaggggaggggtgtgtgctggatgacacagctcctcagcggcaggaactaggatttaatccctggcatctgacttccaggccttgccccctgcaccgctgagagaatgtgtctcataaacaccatcacctctcaccccacacggacccaccacccacacacagccttcagccttcatgcatagcaatttgggctccctttcaagtcaggggatgaggggttgtttctgacacatccctttgcttttgtaccacaccaggcaggaggaaccagacccctgttcctcatccccaactgcccccccaacacccctccagtttgaaagaaaaggaaaacaaaagactcaatttgctccatcgagcagaggccttgagcagcagttaatcttgttaaagtttctcctgacctgttagataagtgaaatgtggaccccacaagtactgccctcctcccacccctgtcccactccccttgccttagtgattcggaattcctgctcagaaggagaaaaggatttacctgaatcccatccagcacctctgcttgccagccttttttcttttgttctaatggttggactggattaagtgtgctggttactcccaagaatctttttttccttcccttctgcacccccacttcctagtatccacccaaccctcaaaaaagagtacccacattttctccacttcagcattgctgtaacagtgaaggctgggtttaagtatatggctaggagtccatatattaacaaggcttttccccagtatctgtagtcctacctgggatctagaatattgtaatagttagaactcagttttagtagccaggttacctatgtggaatctctgcccctaactaactgtgtgaccttgggcaagcaagctagttgacttctctggacttcattcaccttcctcatgtacagagtgatgatggcacaagtacctgtatcatagagctgtgtaaatgctaacagaacttggacatggaaggtacttaaaactggacttggtatgtagtaggtgctcaacaaacttcattcttattagacatgattttccaaatatctcagtcttggctttctggactggggaacacttgaaggtatgaagaaatccaactctacctgggtgcttccttggtgatgctgggcactttccttgtgccagcatgttttgccttcacaactaccctgagaagtgtgtatcgtcgcctgtacttcacaaaagagaaatctgagtttcagagagttgaaatgacttggtctaaagtcccacaggttctcagtggagagagcctagatgtgaacccaagtcctcgtttcctctgtcagcagtctttttggagagagaagaaattattcacatgctcttccttaacctttctgtggaacatttccattcctttctgcatctctatgtgtcaaccatatacctacagatcgaagagggtgagaaatggatataaatctcaactgaagccctgcatgagacctggcagatctgtttttcttttcacatcaaattatcagacagacaggcttggaatttctcttacatgctgtgtaatttgagtcaagtcacttcatccatctcttccttggtttacttatctgtaaagtgggcataatgacatcaggatagttcaatgaaataaacatgcaaaaagtacccagtgcagtgtcaacttgtattagagactcagtcaagggtagccggatctaggaagtagctgcatctctttttccagtttgcggctttggctttcaaaaagtggggcctgtttgtaaggcttcccctcttgagttgctggggagtctctctagagtagataatgtatcttggggaacaattagactccttcaaatacctttctttcaatttgatcttctcctctttgacatgctaggattacccctctgtaataagagccaaaggaggcccagaaccactgggacctttaaacaggaaaacaagttagcattcagagagagcaagcacctccagaaaaggaagccacacagatctactgtcggcctcttgctccttccccaggtgctcctcaaactctcaccttccgttgagctgccactcagtgaacaagtagaagtgataaaggctgtgaaacctgggaaagcacctcccatttttccctgcacagaggaaggcaaaatcaaggtccagagatatggaactcgggagtgtgggttgtgtatggccagcctggacatgaactcagtgatcatctgggtcaaacagctcactgtgcaacaggaaagttgaggaccagggtcacacaaaattaaactgtattcacagatgatcccctctaaatggtctgagagatcatttggtccagcacttcccattcctggctgcacctggaataaccagcttttaaaacatccttctgcccaggctgcaccccaaggattctgatgttgtgggtctggggttggcctgggaacgggtgtttcccaaagccttctcaggtaatgttgaaggaccactagtgaaaataattactgatgtagtctgacatcctcttgttctgcagaggcccaaagggtaaacgatgttccctgcttactgagctgggtagtagctaagcatttggggaagttccggtgccccagctctgaaggacccctcttccatgctgacttcctctgttcactccaaacccctgggtgccacaggtcctgacatttcattttttccagtgccattcctgtgtggaaccatggtggtccccatctttacaggaggcacctgatgtcaaatgaatctctcggagttttggagagagaagcctctttgaacaggaaggattataagaaagggaagctcagctctaaggcattcaccattcactttgccctgggctagtcctttagaaagatgtgtgttcctattacttcaaaacccctcaccttgagatccctctgaaaccagcactggctgcaggtgtctccaatgaggagaagagaaaatctccaggtactagaggactccctctatgggcaacttgtatcttatctacctgtggctgagggctcgggaatccagtaggtatctatttctctccgcaccagctgccccttctctagaacttagttccctttccctaaggttctcctaactttcttcttactgcagtaagagctctgcttcttgccttggtgcagttactggaaatgctcaactgtgattctgacatcagcagctgagaaccgacttgtaagttccttggcttgtttgaagatctgtaagtgggaattaggaggtcagcgttcaggtcctggtttggcttcctctaagctgtgtgacctgtggtctctgacttaaccactggggcctcaggggagagggtttgggggatggttactctcaatgtccccatctcatgggctgtcatgggaccaggtgagacaatgccgggagaagccgttggctgaggtcagaccacagtgcacgggtcagcatggttaggaggagctagaaagtgagagatgtgagggattagtgcaatcaaggtcattcctggaaaggtgcttttattatgatcattcacactgtagatgataaacagtgatggagttagcaaaccttttcatgcctgtgacctcactggagttctttgatgttgggacttcataagtctgccaaatcctgccacttactgctttatgaccttgaccatttaccgcttctctctggacctcagtgttctcaggatgcaaaaggagggtcaggggtaaaatagcgactttcaaactgtcaggggtaaaatagcgactttcaaacttttcaaacttctgggacaagggtgaagggcaggactctgcctctctccttcccttcaccttattccacttaaattgtgtgattctacaagcttatgtttaaaggaatatgttcctccattacaaagagtttaaatggatatggactgacattgaggagttattgttaatcttgataggtgtgatatgatattgttgttatgtttttttaaagatcctaatttgttagaaatgcatactgaagtacttgtgggtaaaattatgttttgtctattttgtttgtttatttgtttaaaaagctccagaaaaaaaaaaaaaaaggttctgggggtagtggttggtgagagattagcaaactgataacaattgttgaaaccaagtgattaaaccttggagctttaatacatttttgttcatgctgtggtgtgtgattgaagatttccataataaaaagttaaaaatactaaaagtgtttgagagccacaggaggaagtgaagtctcagttccctgcgtgttctgtgacctgaaaggtttgcaaatacggagaccaccgtttagagagggttagggactcccccaaggtcgcacaaagattagctgaaagtcgtgacacagcccaggcttcagatctgaggagctccccatcccctcctctctgtacacttgcaaactcaagtgaaaatgattatccagggagaactcgaggggaataaaagtgatgaggggagccttaggaggagcatggagaaggggcaagtggaggcttgctctgcaataagaagcttttgagtgagaaaattatttgctgtatgggactgccctacatattgtgaaatgtttagcatctttggccctgtttatgagaatttcatgggatctgttagtgattgtgacaggcccagaagtattgtgacgatacacacacacatactcatatactcacaggtccacatacccttagttctcgtttttctggttccttatttctctccatccctaactacctggagagcaattctagagccttctagaggcctggggcagtgacctgcaggagcatatgtttactgaggaagtattttgcaatggttgatcacaggactcaggaatcaaactgcctggtcaaaccctgactattgcacctgctggttgtgtgaccttgggcaagttacttagtatctccaagcttcacttttcccctctgtaaagtgcagataatactagctgttacttcatagggttgttttgaagattaactgggcctccatgtggaaaatgcttagtaatggaatctagaccatgcggtaacccagcaaacgttaactcatatcagtattatgtgtgccagccattgccacgcattatttctaataatctcaataactctaggagttagacatacttatctcttttggcaaagccaggaattgccttttcctcccttacaactcaggaaagagttattgctgtcatcttaacatagaaaaattaaaaatttaaacaactaaaatgaaaggctaacaagataaacacattattgtgtcatttaaaaaaaaatagtgcatgctcattgtaaaaaaaatctcagaaatgcagacaaagaacaagagaccaggtaaaatttgtctatttcctgcccaagcatgcaacaactattttttgagtttctgctctgtgctgggtacagttttaggccttgaggacagaccagtcaacaaaagagagaaacatctccgccctcagggagtttatattctgggcagtgggtgttggggagaaggtggagacagactataaatgaataagcatatatatcccataatgtcaggtgaatgtttgtaaagaaaaagttgagaaggaagtctaggaatgctgtgtgggagtggggatgcaggaggagagaggagtgggatatgaaaagagtggtcaagggaggccatcatcagagtagctttgaagaagagacctatgagcaggcctgaggctctctggagaaggccatggtgtatcgcaaaaggaggagcaatgctttgagctaggagatgtcagttctagcactagtttgctgtgtgactttaggcaagtcactctccctctcagaaccagttttcacatctgaactttgtggtactgtagggattatttgcactaaagacacttctacagacacttcctaggattctataatcctcatcaaggctgtcctcagacaaaactgtgaagttggcaatagttccagttttcttccttttctggtgtattttcctccactaggtggtgcctgtgcctgtcaccctcaggggccaagtgtggacacattttcggcttccacacctcagcaacactggggaaaaaagaagatggtacaccttcttgctaagtaccattgactggtaacaacttggaatgttactgctccattggtggatactcttttaggacttcccagaaagctttgtgtcacaaagcaatgtaacagtggtagaatttctaagactgactgaagacattatttggggaatattggtacttcctgatagctggaatccatcctattaataatataactaattctagcccccacaaatatccagaaaacttgctgagtgactcccagtcatcacttactgggtgaatgctagcatgttcatattttgtaatttcttaggatataaaggccattccagacaaattcctggactttggaatagaccaccggccttgtagtattgcttatcattttaatcagataactcagtgaattaaaataccaaaactctggagtctgtcatcattttccagactattttccttcagaggatccctggaactgtcatctctgaagtatatccagcttcctctcaactccctccttcttctctctcttcctactcctcatacccagcttatttgctttgaccacttggatttttctccaaacaagataaagaaaatgtgtttgttttttggtattatttgccacaaacccagggtccacagaacttggaagaatataagaggttcccctcttctactttagattgtagagaaccctggtcaggtctcagattccaacccacttggaggaagctaagacataaaagctggtcagtaacaacttggaatatcgaagtatgtgagtaggggcagcgtaccactagttgctgagacctgttatagccttgtgtgtttaggaagccagtggtccaacctgtacctattatccttgtaatcaagaagtcattcctatgcctgtcccgtatccattcctgttgctctatgaatctgaaaggtggctcggcagaatgtggccaaatgcatttatatggagggggttattttccccagtgtgactgcagatctttcagctcagaggctgatgaatgaagagagaaggctgtgttaataggctaatcttaagatgcaaggcacccaggcagaaaacataaaacattgataaatgtgatactcagttttgtgaagtaaacttcatttaagtccaaagaaacaaggtgtgtcaaagtccaaggactcatccaagccatttatttcatagatgagggactgagggttgatgaggaaagtggcttatccaagtcagtgaccaagctgggtaaagacgagtaccattgactgataacatcttaaaatgttactcttccactggtaaatactcttgcatgactgcccaaaagctttgtgtcacaaagcaaacaacttagaatgttacttctacattggtagatcctccattggtagatactttaaagtcttaagccaggtctgggtccacttgtctcctgactttacaccctttcccatagattaattacccatctgtctactaatggtagttatttgtccagactccactgggctccagactcacagatccacctgtctactggaaatgttagcacattctacaaactccacacttccgaaacaatcatctttcctccaaaattccttgcatcctcatcttggttggtgtcacccactctacattacatcatctaccatattcaatcagtcatcaactcctgactctcctgcttccttataatgtttatagacaaactctcttctctgtaccttaaatcctctttatttcttgctgtgactatttccttagtattataatgcccacttctctgaaattcaatccctgcacccccttcaacctgcccaccaacatccaacagtcacatctgtccagaatgcaaatctgactctgtcacctctagctgaaagctcttcaataaaatctgaattatttgaaattcccccaaatgcacctggttctttaattatcactttttttacttggcttatcttctatttccagtgcaccattttgcagaatgtttatgccttcccaggattttgccagagttttctctcttctgagaagcccttcataacttccccaaagtgtaacttgttccctaccttgttcatctgttcccactatgctttctgcacacttttatcaaaatacctggaattatgacatttaattgtgtacatatttgagatcttatccatctcaagttctctattgcctagctcagtatctgacctataaaggggctatatgtatttttgtttaataaatggataactggataagagaaccagtttaatatctaatgattctgggagaaagagctcaggaaccttaggcatgttgcattacgtaaccaaagcacatgacctagcatgtgcatcactgtcagaaacattacacagtggttaattccatttacccctgagcaaagaagtcagaagggaaaagaaatctggccttccaaaacagaaggggaaggggaatagtatatttaagggccttctcagctcacattgggctttctaatccaagccatattttggccttggtcttcgcctctcagccctgtgcctgtttgcaaagcatttgttttgtgtgtgcacggcagcacataatcttaagctttgcttgcctctcaaatttccctctctcccccttatcagtgtccttctgagcctcaagtgtcctggcagtcatatctgttgcttcagtcttcacccatttccctcctttctgttaatggggctttctatctgctttccttgattttccttgatcttgtgagaccttgtgatgacctcaggatctggaattctctatccgctgtttatatacccctaggagagaagacacattctcagcagtaataacagtaatgaaagcagctagcttataataagcacttactatgtgctggcactatgctgaatgctacactttgaacactctgaaactgggttataaagttgcatgactccctgaagtaccaattgctaatgggtgatgaaactggaattctcatccacaccagtttaattttatctctcttcatcctcaaggcctgacacattgcttggaacaccgcaattactctgtaaatgtaccatgagagaatgaatatatgaatgactgaatgaatgaatggtggtgccccccagtggctaatgcaaacatttgaagaatgtagaatggaaaggtaaagaaggaagagagggagggatagaggaagaaatagaggaaaaatctgaatgaacattataagatttcaaaaagattggctaagaaatctcagatatgcaaagtatattttatttgcaggtgattttcaaacataaagacattttacatccattagagcatttcccacctttaactagtcctttaggagatatacagttgtccctcagtgtccacaggggattggttcgaggaccaactccctcaatgccaaaatctgaggttgctcaagtccccaacataaaatggcatagtgtttgtgaataacccacacacatcctctcatatactttgaatcatttcttggttatttataatacataatccaatgttaatgctatacaaatagttgtaatgtggtattgttttatttgtattatttttattaagtattatattttaatttattctgaaatattttcaatctgaatttggttgaatccacagatgcagaggctacagataaggaggaccaattgtgcacttatttcaaagatactctgtttgccaaaaatgtttttggattcttgttttgagaatcagtgcctgggacatgtttccccagatatgctcaatggagcctccttgtcatcctctgatgaggggccctgatgcattctcaggcaaatcttggaattatgtgggtgaccatgctgagtgaatatggggttttgaatagaacagtgactctggagtaacaaggctgatttttgggtgactatcatcagagctgattaagccttgatagagccaatattaagctctcaggatgacccctttacagaaaagcccctcaaaaggctgatttaatctgctaaaaacaaatgcaatatcttgaccttccctttcccaaattctaaagctggagtaacagaaactgccttatcaaatctgctcagtttactgactgagaaactgagatccatggatgtttacctgctaaattaagctaagctaagtgagtaaggttaagcagcaaattggcagtaaaattgaaactaaaatttagatctgttgacttccacatcagtgctctttccactgggtcactttattttcctttacagtgtggggtgatagttataactatgggtttatattagtaagattactagaaagcatcatacagctgtttaataacttttttaaagaacttcttatgtgccaatctgctgtcctagacattctttaagattcaatgagaaatgaaagtttattaggaaaggtaaatgttccttcatttcttccttctttctaaccattcacccttctatttcatatgtagttattcagcaatttttatatattatacattgagttaggagataagaattaaaaagaagaacaaggcatagttccatgccttgaggaactcccagtcctagtggtggaagcagactggtaaacagatagatgacatcatggtaactgctataactaagcaattaacagagtcctggggaagcacagagcagaaacactatgttatgaaacacccatgtttatcatgagagtgaaaaagtgctctgaaatttcaaaggcataagtgatcttttccacctggaaggattggggacttgttcatgaagtgaatgtgtatgtatgtagagtgtgtgctctgccttgtgtgggggtatagtcatgtatgtaattttaaacatatagccataaatcaaatgagaacaatcaacacttctggattcatgcctcagctgtagatacttacccagagtatcttttaggagtatggtgttaggaaattattggacaattcaatatccatcaccatctgcatcaagccaatgcaactccttatcttccctcctcatagcatttatcacactctattgtgatttccttggtatctgtctgtttctccccaattgtctctgagctccttggagcagagaccattttggtcttcatctttgcattattccttttacttcgcacaatactagtcatgtcggtgagggctggctaaacaatgttaaatgaacgaacagattagagatggctccaaataaggaataacataaggtgattgaatgtgagtgctgtgaagaaaaggtgctttgagaattaatagcataggccttagaaagaccaaagagtgaaggcagacacattgtgagtggcattgactgtgagatatggccctggtctctctgagctaaccagttacctattgaaatgtatatgcttatcatctttccctatctctcttcctctctttctttccagtgaaccagtataccatctatgccagctttaagtcccttccatgtggctgtccttcggcctctccaaacccattctttttttttttttttttttttttttttgagatggagtctcactctgtcactcaggctggagtgcagtggcacaatcttggcttactgcaacctccacctcccgaggtcaagcaattctcctgcctcagcctcccgagtagctggcattacaggcacctgccaccacgcccagctaatttttgtatttttattagagacagggcttcatcatgttggccaggctggtctcaaactcctgacctcaggtgatccgcccaccttggcctcccaaagtgctgggattacaagcatgagccaccgcacctaacctctccaaactattcttagaaagagctgctaagagctaggtggaattgtaagggatgtgtccatgctcctcctgcaatcttcacctagaatataagaggatgaggatggcacactagattttttttttttatctagtgtgccaggaagttatcagagagcttcaaacaatggagttactggatctggtttatggtttccaaagatcactctgactactatgtgtagaatggattgcatgaggccaagagtggggtctcagttacaacagcatcatgatcgattgctgatgttatgacttagtattttggttaatataattatcatttatttccttatgaatacgagtaccaagtgaaataccagaatagcactcctattttagatcaacgaggataggggagtttttgcacttgggttcagaagtacttgatttgtaaaccccaagacattttctgtaaaaatttgaggttgtgcatatttttctggagtcaaagttcttcttagttgcttaaagggatatatgtcccccaaatggtgacttacatgctgaaaaactgggggcataccaggtcatttcctgaagcttgttcccagctctaaaatatgaacactataggggatctgtgataatgagaatgttgatgttgagttgtcatatcagactgagcaattgcactttccttcatctgtacccttgttggagtaaatagaatttggacctttttttcctctgaggaagaattagtttatttcttagaaatataatctacaactttgtttattcaaactctgctttctgagtttctctgagtttttaaataggcaagtacacttcaaatgtggtctgaagtggtcctgcccataagtattcactgtggactttgaccatgaagccacaaatccagccacctatccacccttccatcaatctactcttccatccattacccatctattaactctccttccctccctttcttccttcctccctacccccttatctccccccactccctccctctcttccttctttccttccatccacccttccatcaatccatcccctttcatccccattcattccctaatccatccacccttcttttctgctatccatccatctatccatccatccattcatctgtccatccatccttccattcttggataaatgtaatcttccatttaccaggctttgtgctaggactggaggaagagttaggaggttccaattcttgtttttatgccgctgtgagttcttaaaaaaaaaaaaatcccctgagacatcttcactgaaccttatgcttccacatagtagagtgtgaaaaccactcattgaaaactaatttgaaaagttaaagtgttctgcctgcatagttctatcatataaatattcctggtagtgctctgagtctggatctagactaccagaggctcctttatcaacagtaatattttagatcaataacagtttctacccttaggttagcaggtactggaaaaacaataggaagtttgaaatggaagcctttctttgggaaagggcaggcttaggtgagaccagagaagggagctgctagtcacttagcctctgggactcttttttcccacagcctcccaaagcccttgtttagtgatgctgagccttcacattctgtgtatgcctctggatgtatgatgtagcagaatgcccttgtggcatggggttgtttcagtttccaaagcattttcgacatctacctatcatattcccactcgccttgtaaaacaagcattttcatttaatacagtgaggtctttgtattctcaacaacaaacacatggtccaaggctctaggacacaacctgcctttttctccaacccccactttcaacccccccaccactctgtccacccttacaaagcccagtgttagcagaaatatctgtttacaaacaagtgttccaaaagaacagtatcagtagctcaaacaagcctctgaaacatgcctctgattctatacttggaatccctgtgaacagtgggtatcactggcagcagctttcatggaaggcttcctgcctttccatccttccgtctgtcctcatgtctgactttctctgtctccttccccttattcattgaaaccatggggaggctgaactggagaggcagtcagatgctggcctgggcattatggatatctaggagacaaagcccagacagggagttgcttgcagacagcaagacaaacccaaacacatccgcctgcagtgttatctgaagcagaagctgattgaagaaggattattaattgggtggatataatagtcacatgataatcatgcagctctaagcctttttctaaggtttcatcgactgaggagctgctattgctgctctctggaagttgagtctactctagctccctattacctatgcataacagctaatatatttaatgcataatatgtgtcgggcactgttcataaaattttgcatatgttaactctttaatcctcaccatgaccctctgaggtgggtactattattactgcaattttccagatgaaagatgaggaatgttaagtgaatttcccaaggtccacacaagtcagtggtagaagcaatcttcagagtgcatattctaacccctccaccataaacctctctagattctctagactggttctaaattctgtagcctcacattcaccttcctccctaagcattgtttactactgtaactttccctcgttgcttccaccagggatgctaaacctcaccactattaacattttggaatgcataattccttgttgtggagtttgacagcatccctggcctctatgtactagacacagtagccacaacctcctccccagtgtgatgatcaaaaacgtctgtagacattgccaaatgttccctgtgagcaaaatctactgactgagaaccactgacttacatggattcttctgattaaactgaattacctgatactcctaaaacacatatttctccctctatgctttttcacatttgttttcccctcttgagcttacagtgttcttggcctcctcctcatcaatcttctctgtttcatagtctttcagttcctcagcatcttttacagccagaggaaatactaacctgtctggttactgatctgcttgtttctatgccttttttgtttaaaaaatggtcaccacttccaaacttttgatttaaagtcccttaaagatccctggagtcttgagtttaaaatttagtttgtactatgcattccacgatgttttacagagtctaccatgtatcagatctcaagctaatcactgaggatatgaagtcaaaggagataaaatccctttctttcaaggagtttatgagatagactctcagggaaataaagggatctgaagatcaactctccatcctccttcagttgaatagatggggaaaccaagagacaaaaggtagatgacattttctcaaggtcagctagagaccaggatcaaggctgaactaatcatcctctacctagtgcaacaaaatttaaattatgaagccccaaagagcatctaaaccctatttatccatttagagccttaaagcgttttttgagttgagttatttataatttatgattttctaacagatgtcaaaacaatagaaatttagtagtgtatcaaacctctctctttgaaattgtgctcacatttcaccctcttcattaatgagtcttaaggctaaatgactccagattgccacatgagcactagacaggagtcctgagactttagtcctggctctgttagctctgtgactgtcaaaaggaagaccatataatccccagctaatgatccccacccacccccatggactgcctcaaaaaacaccaaagattcattcttttctatggaagaaactttagatcttttggcatgtcattcacaaccctttgtgatctagcctcagacagccattgtacttcatttccctcagttactctgtgcaccctcaatcccatcaaaagcaaatatctttctcatctcgagagtgacctttaggtggacttcatagctcttgccattgctgatgattcaccttgtgctagaaagtctttgaccagcttctccttccccaaatcctgtacctcatgcaaggctcggctcttttgagactcatccaggaaaacttccctgcaccttcttgtcagaatcaagtagtctttctgctgagctctatttgcttgtacctctactatagaactcgctttattactctttatttatcattaaaagcagccccttgtcctggtgtagtcagctttcccctgactaagcagaaatatttagaagttaaaatgtgaattctggagtctgattgcttggggttgaaccccatctttgtcacttggccaacaggttactcaggcttaggtgagttatttggactctctgagtctcagttttctcatctgtaaaatggtgataataataatatttccctgcttgcattattgtgagagttacctgagttatctatgcaaagagtttcgcacaatacctggcacacagtaatcactcggtaagcatcagctgtcattgccctccctgcctagaaaggtaattctggagggcaccagccctgcaaagtggagatctgcctgtctggccttgtccctttcttatctccctttgccatctctctcctgaaaggctcaccctaggctgtgtgggccaagatgaggtgatggcaggctcatctgagagaggagctttttcttcagagctcagcccacactgtgtgggctgtgtttttatacaacttgctgtaggcctgcatcaggtatgaaatttacatcatttgacttgcccatgtgggaatcttccccattcctcttggctccttagaatgggtacaggtgttcagtgcctcctcctcccaatgctcttcagcagatgaggaaccgaggtccaaagatgaaaacaaggctgatgactcacctgttagacacagttggcacagtgcctgaggtctacagtacttttgttaaactacaaaaatggattaattctttcttttagaattaattaatttcttttagattaatttcttttagaatcagaagaaaaaataatataataataatacatctaaaataaggaatccagactctcaattacatttatttttataacaatgcaatcataaagcataattttggaagaaggagcctatgaaagtcatgaagtgaccatggatgaaaagaaatttgcccaagattaatagtggcaaattaaagcacaagttcccgtcttattaccctccaaatagaaatttttttctctgcattttcaagaaaactggtagaatttattttaccacagtcatcttctttcacaaataagaaaacggacacctgagagagagtgtgacttgcctaaggtctcgccaacacacaactaagttgtattttcctaactccctgttactcctttcactatttatacattcaaacctaatgaccactgatgtcaacctcccattatatagatggaaacatcgagggccagaaagttgaaggggcttatatgatgtaacaaggaccgccactcttgcctctaaatcagggcgccctccagtaccaagaggagcgtttgaaaactggatacacaattttgttagacagcaggaatcacttcaagagatctattatacaacatgatgactatagttactattgcacacttgaaaattgctaggaaaatagattttaagtgttctcaccacaaaaattctaataagcatgtaagataatgcatacttaattaacttggttcagccattccataatgtatacgtatttcataatatcatgttgtacagtattaatatacataatttttgtcaattaaatacaaatacaaataatacaaacttaaaagaagaagaaaagcttgtttgaaaccaaaactccccccaaattaggtttcctcacaagccttgggcacataaatctttcatttatttatccattcagcaaatgtttattgaggacttatgtcctagccactatatggagggttctatatagtgatacagggtggtgatacaggctctatatagtgatacagggtggtgatagacatgtactgtctgttcttatgaggcttacagtcgagtgggggagagtaccattggaggttgacctcagaaatgagtcatactgtcaacagtgatcattgccatgaaaaaaaattagatcaacaactaaacaaccaaaaacagtattaggacctcagaaagactcaggagaaaagagaggctgtgccctcaacaactacatgtgggaactatcaagaaacagcccaagtgtcctgtggctggtacagaaagatggctgggtcaaagactgactacatctgtgccagatagcaggtgctcatcaacacttatacactgatggtggagactcatgaagactgaaggtctactggaagaagtaatactggtattgtcttgaagatcagaaaagagaaaaggacagggacaatagggagacatttctacctgtaggaaacagtgtgggccaaagtgaggaaatcttaccagagtctgtctacacactcagagatagattgagaccaatttctgaaatgcaaaattgttgttggtctttattctgagagcatcagagaaagaggtttgtctgtttgggggaatagtgaaaaataggattttaggaagatgaatctggtgatgcttcacaggctgtataagggagcaatgaaacttctggaccatgggccagttagaagagtgttccaataatgtaattatgatggattaagcaccagctttgttttttcataccctttatggtgcataataggatgctcattttaccaagtaacagaagaaaagctcagaccaaaattatgacttgctctaatctctgctccatggtagcagagttgatatttgaaatcatatctcacaccccagcttggaaagataaatatccctctctcctgttagtctgtgaacttgtggatagaatactatagtatccacataactgcatgtagagcattcattcaattagagtctgttgagcacctactaagtgccaccattatgctaggcaatatgtgatatattcttttaaactttaaacatatgtgcatgaacatacacacaagcaaagttacacagagaaataaaaatggagttgacaagatgagccaaggtctgattatagcaaaactgggagaaagttaccacatcagggaagcttcctttacttctccaacagtattaatggctattaatgtcttgatctctggagtactgagaggaaagacccccccccccaatatttttattagtgacattaaattgacatgtccatgtggctttgcagggacatgtaaaatatgtttctgagcttattagaaacagttctctccttcttcttcaattctgtctcatttctctgatacttcccatgtgcatttggttttactttcctcacatacatccttcatgatgcccatttcttggatgcttattgtacaccatgcactttgaaaagtgttctatgaacagtgtcttattacatccttccaaccagagctgcctcaaggtcatcacagagccagaacttaaaacagctgtattcactcccaaattgtgctcttcactaccagactgtccactgtgctttcactcatgcaagcaccctcacatgcatttctttatttccccttaaatgcatgcatacatataagcattttgtcaacttaattggtgctttctacttgccaatcattgtgctggcctggaaatatgagtggtcagtcatttgttaaaatgttgtacagatgattcaaatatgaggttaggtgtgaaaggggatgattaaataaccagtaagagaatttccagccctgactctgcctaattcaatgaatggtgaagggtcagtcttggggctgccatgcagggtatgacagcaggatgcactggtccttgaccattttctggcaagtggtatcattgtctccaggcttgatgagtgagtggagagaggagcttgtagattctcaagtcattaaaatgaccgaaggaaagatctctcttccaagacagccccaacatcagccctccttagtccaccaggatctggtttgtgctgtgcaactttcaaggatgaacaatagttcatattgttatagtgtacttctttgaccccatcccccacctcttctttctccttgatctttttttcttgtccttccccacttcctttcttacgttgatgtgcaccaattttatatgcactgatttcatcgacaatgtgtgaaaaaagagcaataaacatgcatcttcatttcagagaacagtgtcagaaaggaacctttatgtgtgtgtttaacagcacaaaaaggggggaaataatcccaattctgaaaaagaaggaaagatattattttttgtttgtttgttcatttatttgtttgagacggagtttcgctcttgttgcccaggctggaatgcagtggcgcgatctcggcttactgcaatctctgcctcctgggttcaagtgattctcctgccttagcctcctgagtagctgggattacaggcacacatcaccatgcccagctaattttttgtatttttagtagagacagggtttcatcatgttggccaggctggtcttgaactcctgacctcaggtgatctgcccacctcagcctcccaaagtgcagggattacaggcgtgagccaccttgcctggccggaaagatatttattattaacacacatttttaaaaagtgtagctacaacaatcccattctatgcaaatgagcctttggattctcttactaaatcctcgaaatggcactatttattaagtacttattattatcagtttacatatgaggaaactatcaaggagataaagagattttgtccaaggctacacagctaacagggagcagagctgagatacacagatcagcctcacaccactgtccatgtgttgtaacacttgttttgttgccagtggccatgtgccaagtgctgtcacatttgttttatcattagttcccccactacaactgtcagaggaagatgtatcatccccattttacagatggggagactaatactgggaaaggagccctgactttcccatccatagctagtaaatggcaaagccagcattcgaactcagatttactggcctgtaatcccccaacctttctacgtccatgcagactgcttacacatgagcaaaggaggaaggctggagacacaagagccagagggaattacagtttgccatcccaaatgtaccacataagtctgtgtattattaaaacttatgggtttcaggaaccctcaggcatactactctcaagcttgcctcacatctggatagccttaaatagtttacaaggaaatatgcatacatttatctcttttctctctcagaagacatctgtgaagtatacaggataagattcttcatcctagtgtacatgtgggaaaactaaggttcagagaggtgaattaacttgtctgatgtcacacagctagtaaaaaaggtgaacagacccatttagtgagggtgctttcagataacagttcctggcaaggaagaagaatacaggcaggagaacagacacaggtgccatcaagggtgttcattctactgctccatgccgtcctgcaaaaggaaatctggtcctcctcctacacttgcatggccaacacatgggaaacacctgagctaaccctgacttggagaattgttccatgtggttactttcaatgctcctgcctctcttgaacaagacacagagatgtccagaacccagtataacttggtataatcctccagtcctgtatgtctccctttaagcctcctccttccactgagcctaaggcaaatcttttgacccggggtggacccggagggatgaggatgctgaggagcagtcccccaggtaccctcctcggtgatatcccagccttcctctgaatgcctgatggtgctgagtcctccaggtcattttggtgggtctcccccccgactgaaccaagtgcagggaccatgggtatacttaacccaaatctgtctgttttaatcactgtcctctggacagataaaagctttccataggattgctctctcaagcattcctctgtggctttgatactagtgattaaatcatggaagggaaagcaaaacaaaacaaaacaaaaaagggaccagctccaacctttagcttttaatttttttagcctcatgaaagaaaccagattgttgacctaaattccccctttcatcccctcatcctctcacctctgcttgtattctcctggcagatgtcccacagctagtgggcatcctttaattgaagggtctgaaactgccttttaccctgccccacaatgaccttacatctcccgcagggggaaccaaggctgggatacctgtaatcgctgggatcttggagtcacagaatgtggatggaagggacctctgtgaccatgtggtctaacactcttatatcctaaggaaaggaagtgaggaagcccagagtagggagctattcacccagggaccacagcacagcatggcagacctagacattagagccttcatggtggattgagagcaccaatccaccatggaaagcatcttggtggggagctttggctctggagtgaaagagatgagagttagaattgtgattctcccaatccctcgctgggatccttggagggaaaatcaattaacctctctacatctcagtttccttatctgtcaaaagaatactaataaatcccacttagtctgtgcttagtaaagagactactaaatagaggctttcagaaagtgtttgttattattatcattatttatttaaaaataccactttttcacagcagaaatgtcctggtggagttttttctccttctatatctactctcccaatgagagaaaacaaacaataatacgaattgcatataaattgtcatcctttgctaattatctccaccccgccgcccccagacagtgatggcagaaagtcaaatgttatcagagataattttatgttgacttaaagcttcccaggaaaacatcctaggcaagaccacaggaagaaagcatagctagagtccccctcagctgtgggggagctttcaaatttgaaatcaggagactcgaattccagtttttcctaccccttagtgctgtgggactttaggcaggggacctcgcctctctgactttccagttttctgatctgtaaatagtacctattgtagcagattgctgtgaggattctaggagacaccttgaggtgaggaatgtttcctgtaagtgatgaacacaccaccaattttgctatctttctaatacaccttgctctactcaaaacagcaattgagtaaattgagacattgcattgtaacaagagaaaaattctgaactgggaacaggcattaggagataagatagattttagaaaaatttcagtgggagagcttagaaaacttgttgaatgatggtttgctagggcaggcataacaaaggaccccagcctggctggcttaaatgacagaaatttattttcttaaaattctggagatcaaaagtccaagatcaaggtgtcagccaggtttgtttcttccaagacctctctctctctctctttctctctctctctttctctctctctctcactggtttccagatggtcatcttttccttgtatcttcacatagtcttttctctgtattacttgtgtcctaattttctcctcttataagaacaccagtcaaattggattaggatctgccatgtcacctcactttaatttaattaccttttcaaagactgtatctccaaatacagttaaattccaaggtactggggttacatctttaatgtatgaaatttggtggaacacaatttcatccaccacaatgaaaaggaaaatgggaggcagccaaaagcatggcagcaagcttgggaagaaaaatcagtatcgacattggaagttagaggaaacctgagtcagaaaccatcaggcaggtaggctggtaacggaaatccagatgtcgaaggacaagctcaagtaagcactccagatggacaactatgcctggacaaactttgggttctagcgaagtgggctgagcccagtggaatagattactctttggtaataaagaaccatcaattcttagttaattgtttaggtccctacagaagaatgataaagacagcagcctcctggctttcaattcaattcaccttgcttgtgggggtgctgcagaacttacagaagtatttccagaggaggccacgcctttaaacagcctacaacaaaacatttggcctttggcacttaatgtattgaccatgactaagagcctgggtgtgggaattctatagacctgcattctgagctgtgttgctttgggcaaccatttccctattctgagcctcagtctatcctgaagagggagcaatgctgatagacttgttgtgaagattaagcaagataattaacgtagagtaaatgatagtatgttctcaataaagagtaagatactcttatagagaaggcagaaatagggaagtatccccctgctccctttctttctttctttttaactttcaataacaaactctacagagcacttacaacataccagattttgggttggatgttaggtatttataaatgaagcaaacagccacatatgtgggaagcacagatcttgaatgagtaattactcagtgatgaggcagttttaggatggggaggagtatgatgaatatacaggaggaagatttgttggtgcctgggtggcatggggtcgtcagacagacttgtcttggggtaatatttaccatgatgatctttagagaatacccctaatgcccagagtattctcccacactctgtacagccttagccaaggttctgagagactctttccatgcctttgagcttttctcctttgtggatgttcttcctttctgggatgagattgaatgagtagatgagaagaaaaagaggcaatgaaaaaaatagacatcaagcttctgggggcctatggaacccttttcacatccagcctagctgcaggaagatagggtgcattagaaagatcagctggccagggttccagggatggttccgtaacaggaggaccatggcaggctcctttcctgctgcacctcaacctctccctctgtgcagtgtgcccagacacactactttaaaagggctcttgcacgctttcattgtctagttctatgtgcttatagcattgagacagacatacgctaattatatgtagattgtgtgcagaattgcatgtggccttcggttttgccacatgggactatatcccctgggatcatcctctagtcccacacagatggtgctgacttcagacaaattagcaccattttttttttgtactatgcctctatctttatggagaactgtgaggaagggcagtgtggagacgtgggggttcttttgtgtcctccagagaacagcattgtgtgtcctgtatagagatcctcagaggagacagaacctaagcatgcaagagttgcgaatgacataaggcatctaattccaatcaacacatatttttgagcaccttctccttacaaggaaccattctatcagtgaacaaaagagctcttaaattctagcaagggatcatttttatccagacccctccttttacagagaagggaaattaggttcagcagcataaaggaggtggtatgacttgtcccaggcaaggttacctgacaagtcaagctcagatctctggtgccaaacttctggttctgagctggtggtacaacgatgcttccctttcagaccctaaaataagactactgttgattaagttatgttcatatagaaataaaaccccattgccaccatacacccccaaccttattgaagctcggtgattttctttcactacttatactccaggtaaatatttccctctgaacttgtgaagccgctgcttcaaggttctcatttcccttaatgtgtttctttttggttccattgaaaaccttctctttgcccttcctctctgcctcccatggctaagccaccccttatttcttaactcttttgcagaatctgccttttctcacttcttcccccttctctcaactgcaaacagaggtggcctgagcctgggtcccaagccccggcaaggttctgaactgagagcaccctacagatgtgtaaacattttaccttgctaaccaggctagctgccttccaaaggcaacaggaaaaccagagactgggagcccctggcaaaataaaaacctgcagagagagagagacagagaaagagagagggaaaaaggatcttgttttagattttaattttctcattagaaggccattcattttcttttcatgagggatagggttagctgggagagagagagaaggtgagctaagaggtgggaaggacatgaatgtcatggctccaggaacctctgctctcaactggttccataacaggcagcaacagatagatctggcgcaactcacttcaaatctggagttggatcttaggcttttgaaggagtcagtggggaggcagcttttaatatgtagtctcatgatatcatctaagctgacgggatctatgatttctaagaagggtttgccagtgggtttgaggaggacctgggcttttttgagccttccttcttgatatgtcgtgcaagatgccttcagggtaccctctctttctggcctttctattttgtttcccgtcatttcctccctccttttcatcctctacatcacccctgaaccctccagcatcttaacaatgaactctcatttggacagccgttgtatgcggaggatgtcatattcactatgtcttttaagtatgacaatatatttagagatacagatgaaggaattaaggcttagaggtgaagtgattttgccccatacgtacaactagtaactgctgtcatcaaaattcaaagtaaattaccctgagtgcaaagatcctgatctttctactttaccaagaatacattttattctctgattctccctgtactttagtcacagagacataaattaatgcctttgattctgtttgtccttaaaatccctaccctttctcgtctccggctctatttagaatcattcccatgcctgctgtagcaaggtgctggagaggttactggaatgacacagacacaaccattgctctcgagaagaaaacagttcggcagagaggggataatggtgagaacacaggcaactccaaaaccgaagagcacatgtcaagtttcctaaaagtaaaaagagttcaaagaagagaataatcactattcacagggaagtcaggatgaacttcttgaaagagttaccttgcatgctagtcattgggaaatctagaataaagaaaatcagacttggacctaatatgtgacacagaaccttacttaacccgctcctttaccagatagagaatcaggacccagaggacaccagaggaggcatttggtgcttcactaaggttgtcctgatggtaagagcaggatgactttgtaaggagactctggccatttcctgaaaaatggctgagcaggaagtaggaggagaggtgtagattggcatagatgctggtccaagactgctggccatgtcagctgctgacaaagagatttacaccaattctaagctcccactgcccacagaggagtgaagactgtgtgggcctcctctattgattttgctggaagctctccttgctcatttgatgagcacttatagcaggtgaactcccagagttatggtgactgcaacaattctccagctgagagtagtcactgtccttctaaatgagcatcttttattcactctcctctccctctctttcttctcccacctggcctcatacatcatctgacacttaaaatacactcttaattagaaagtcctcttccccatccaacagctttgtctatgccagggacactgggtatattccagaaaggctaggaaatgggggttggtgagcataaagataattagatccagagagaatctgctaacctacttcctggggttcccagagtaactatagagatgcttggcttggaacttcctcaaatattgaactcaaatttgtgacatgccccaggtaggtggcatagcccagatgcctgatgattttggtgaggcagggggagctgctatagaattagggcctaggacagtgaatccaaggatctgatggatctaggatccacttaccaagcagttgaccttcaacctgtctctctatctcctttaacttccatattctcaccagttaagtgagaaacgtaatgtcaccaccttagggatattacatggattaagttagtgcatatacagaccttagcacaatgcctggcctgccatagaggcttgggagattttgctcattattattaactattatgtaggcatacccaatttatgttaagaaggcactcattatatgtgtgtgtgtgtgtgtgtgtgtgtgtgtgtatctatatctatatatctatatagatatatagatatagatatagatatagatatatatagacagagagagaggcatcagtgtaagaagaaagctgaattgggacacaggggaactgtcaatgactctgtgacataacaaatgccttccattctctgggactcagctctctcacctgtcaaacaaagggtttggaggtgatgatctttgaaaacctgtctagtttagctctgaagtgtgttttctttctttggggataaatggcaagattcctgttagagaatgaagttccagcttttcaggtcctgaccctcacttttatgccccaactttcctgacaatttaatgccactgatcatttaatgactgctaatggcagatgtacactcaaagttctggtaactatggtagggacctcccttctaaatgagcatcttctgttcgttatcatctccctctgtttctcctttcacctcgtatactatattacacttaaaataccctcttaattacaaagtcctcttccccatccaacagctttggaaaatggttttcagatttttattattattgctgctgttgttgcaacaacttcattagatgaagtaccctttcttcaaacaaaaatctttcttgtatgcttcatattcaaaaccaataaaagttaaacttcatgggttaaaattgtgatgaaaatgctccaaacccaacttactcattctctcagctcctccagcccttgccttgccctcgaggtggtcccagaggcaccattagcaactcctaggatcccacagagcagttggaaagcgatgagtctaggataacctgatacaaattttattagagaaaaataacttaaccccccctccttttccatcctttatttattcatctttctcttttggggccacatagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacaggtaagaccttactgggctaaagatgcccagttgaaagttgaacttgatgtcctccatattatagataaggcacctgaggccagtgggtgatatggggattttctggttcaaccagcagcttcatgattgaggcaagtcttttactcgggtcattgtggagaccataggtaaacccagtttattataaaaatatttattgagtgcctaccatgagtcatgagggaagcctgagagccctgttttctcaaagagcccagagttcaaattgagtgatataagctgagtacaaatagctgttgtattgtatgacatagagtgggtgagagttgcacagtccaatatggtagttcctagcaacatgtgcctacttaaatttaaatcagtcaaagttaaataaaactcaaaattcaattcctgagtttcattagccacatttcaagtactctagccacatgggactagtagctaccatactggcaaagcaatatgaaacacttcagtcatcacagaaagttctggtggacaggctcaaagaggtggggtcgcatggggctagaaaacctggccccatggtctcagctctctgtgacttcttcattttgtaacttcttagaagctgtttcttcatctgtaaaatggggagaataatggtacctattttgtcaagttgctctgaggattgatagagagaagacatataaagtacactctcttacagcacatcattaattctcaatagtatgtctgtcattacttgtctaatgaaaggtagtgtgctgtgtttagggagtgccctagatgatcaaagagaaaaagttgatttgcagcttgactatatcagggaagccttcttgagagaggtgacatttgagcaaggtcttcaagaatagctctaatttgaaggatgttagaacaaatctagagatctaatgaacaacaagatcaatacatttggtgtaatagaacaaatctagagggctaatgtatagcatgaggactataggaaataaggttgaactgtatttgggattcatgctaaataaccagattttaaatacttttggcacaaaaccaaaagaaaatggatgacttaagataatggatatgttaatttatttcactataataaactgtttgctatctatatgtttcccataacatcatgtctaccttaaatatacacaataaaatttacctgaaaaaagaataggtaaaattttgacatcagaaattgggtggaggaagaagggaggacactccaggcagaaggaatttctcatctactgctaaaaagaggacagaaaagggggccttcagtctaatgcctcacttagcctctgccattgctgtcagttgcaaccagtaatccaaaagtagagcccaaaaggtgaactcaagggtaacctgtattaaatgtgggacctggaggaactagattcaagctggagagaccatcaatatccactttcttgtttttcccagattcacactgaacttttctattctgtccaacacacaggaccctggacttgctgatggctcgagcacatttgccgacctctgcaggttttctgctgactcttctctttatgtctctctcaaaagagcaagggcctcccgtgcgtgaacaaaatacctatgtgcaaaggaatgaggatgctggcaggagaatgccctgcctggcagcaagtcagaaagcacctcagctcagcttcccggcaccaggagggcccctggactctcaccttggctccaagacatgagcagcccatgtgaggagaagccttggtgtgtgaccagtctcttctaggtcacagtgcattgtcatctctgctttcacttgggcctttccaaaacttggcaagggagtcaacacagaggttaacattcacatttgactgatgggaaatagaggaaacttagagagtggagtaacttagctaagttcatgggtcaagaaaatcattaggctaaatcacaagtgcaagtctatgatcagtgtgctccaccaaactagactcccaagaggtacctctgtgcctggtgagagtgggcgtggggtaggatgggcataattggaagtcatccattcatttgtacatcgatttatttgctcattcattcactcattcattcatgcaacaaatgtttatgcagcacctgccaagtgccaggaaagtggatacccttagccctgttttgctttgaaaatttcaagattcagaaagatgaagggacttacctaagctcaatctgctaataaatggatagcttggattcaaactcaagactactaggtccaaacctcccatggaaggaggatattttttaatctaaggaacaataaggggcaaaattaaaagacaagtgatagggagagtggcgctactaaagttttggggaaaaaaactgtgtatcattgagacaggatgaagagcagctggcctttgcagagcaccatgctggtgtggaggggccatggggccccaggttccagacacctcacaatcagcagacagcactggcaggttccaaaggcctcctcttttctaagtcacgggaatgcatgcccagagtgtctgtgagcgaccatgagccagctataaccgctgtgaccagggcttgtttgtttgctagctgggaaagctgtatgccctgggtgaggcccaccaggtcacgtgtcatctcttggtgaggctgggattttctgggttctggccgattcagctctcctgtgtgcagacagaaacctgtggaaggttgcagataaatttttgctttgtgaatttaaacaaaaaagggaggaagggaaggagggaggaagggaaggagggagggagggagatagggagggtgggagagtcatgattacatggtcatgacacatacacttcaagctctgaaggcctatcctgtgggaaagtcacagaattattctatatggtttctaagccatggctgtgactacagtgttgcaattacaggaggcagctttgagctgagtaatagatgatatcatctccagtcagaatggtcctttttggggagggctttgtctgtgggtgagtgagctccccttcaccagaagcatgcaagtcagtactgataaccatgcataatgaggccataggtgggattacagttctggtggagacggtggccttgtggtcttggggttgagcactgcacagtaatatcttattccatttcatatcagaaaaccaaatattgactgcttctcttctctttaacaggcatttattgggcatgtctatcccaccagcctttctgctcttcactgggggtgttgcaatgagttggacatgttcctcaccattaaggggcttccactttagtgggaaagtcatatagaaacataagaaactctgatttgtaaatttagagacacacagtaggacaggagactgaaaaagcagagatttatttgactaggaaaacaaggcaaatcagctggagggggcaagatttgagtaggcatttgagaataggcagcctgctgagaggtaaagatgcagactccatcagtgagggtcctagcaggaaacagatggcacattcaaacagaataattaaggagaattgaaggaggggctgttttcaaggagaagctgtttacaatgttgtaggcaggattaaggacaaccaacaaggccttgtgctatactctagggcgggcaaccatggagagccatttacccccttggcctgtaggggcaagaggagaaagtggttatgggacccagagagagggactgtatggaggggatttcctggcagcagctgtggctctcagcaagggaagcagccaggctacagccacctgaccagaagggaaccaggagagtaaattccatgttgtcattctctctgcctgccagtctcctgccagtgcttcccatttggtggatccaactgaagtcacaaaacaaaggaacctgttgatgcaatccatagatagccagcctcccaaggacacagagcagggtggggagtggacctgcattagcaagcagagaatgtccagagcctagagacagccagcccatgcagagggtagggcataagccaggcagtggagagggtgaggagtggtgtatagaagagagcatggagtttaaggggttattatggctgagatccagaccatgagcagagaaaagttcagtttatctcacggaaaactttaatgttaggcttaatcctctgttccttcctccctacattcttcccaccttcccttccttctgtccttttcttctctcaataaatatttgttgaatgctctctctgtgccagcccgatcactgccctcccagagcttaccacctagtgggtaagacagagaagtcaacaccccactgcaatcactggtgtgaatgaagggtccacagtactagccaggaggagcagtctgtgtgagcagtaaatgcctttctatgagactagccagttagaaaaaagacattccaggtgaactgtggccattctctacagtggtggagaatagccagggaggcaggacttcatctgcagccattagagatgtctccacgcaggtagaatgcacttcacacacccttttataaatgaaatggaaaacctggatattaatagaaaattccagtgtcaggaaatccaggggcatttgacactgaagactgtagctacctcactgagagaggatattgcagcaaaccaaccaagttcctgtttggacccttccaaaccctggcaccctcaagtgaactcacctttgttcatgaatatctactcatacaaaatgggatgggtggaaaaaaagacactttccctatacactgttgtctcataaggaaacatttcctttgtcttctctttattattatttgggaattatttcctttgtcttctcttttttattattatttttttgaatgtaacaaggacaatcccctgaggccaggtttttgttgttgttgcttttggactccagttaatgttgttggaagtctcacaaaaggggctgcgataagtcttgaggtcacccccgacccctctgctggcagctatagcccccgttagcctcttcccctgctctaatcagggccactgaatgatttgtcctctctgggtggggtttcctacttaatttctgatttgatctcatggagcataaacttcatactttcctcttccttttcaatctgaatgaaggactctcagagcttaatggatcagtagatgggtccagtactttcttgctgcagatggggagactaagccctcaaggaggggcagacactgacgcaaaccatccattgagaggggggctgagctgcgatggagacccagggtctcacttcctactcccatgctttttcaactacaccctatagacaccttagacaccagcttaaaacctggaaaggttacatttagtatgtttatgttcttacccatcatccacattccattaagacaccttagtatccagagaactgtgataaatgctgtaggggtccaagatataatctctgtcttcaaggtgcttgtatcctgtgattcaatgacattttgttacagtcattcaagagaaggcaagagggcagatgactaatttccctgtaaaccacatagcctataaggcttccatgagctctgagaaagggcaggatcactgtggtttggagaagttaggaaaggtttaatgatggagaagggatgcaataggcttttagcataagcaggctttgtaataatagaaaagagctggtgggctggccagacatgtagtgataatagggtaaataaattgaagtgggaagatgttgaggagatgcaagaaagatgtgagtctggttggggcttcatgaaggtagatgccacagttttttcttcagactgtagacactgaagactcgggctgatttagaatgaaagaattcaggtgaaacagattctagcctgggctgggcagtttgttagctatgcaatcttgggcaagccttttaatctctctgagcctccaattccacatctatttggaaggaataatagtatctgactgcctggatcacacaattgccatgagggtctcataaaataatatcccagaaagagttctgggaagagttaaccagcatgcagatgaaagggggcattgttatttttcagtcactttgttcattcttttccagtaatcatgtaaaagaaattgcttggaattttataatcagaatatcagggtttatttaatgtgactaatattcattaaagcaataacaggagtcaggtctggtgtagtggaaaaattatgcgtgctagagactgaccagggtttgaatcttggctccgctctgcactagctgtctgaccttggcacattgctcagtaagagccgctggtttctcatctgtaataattgggtgatagcagctatcctgtggcatgtcatggcactcaaatggagtcatctgtgtgagacacctggtatggtacagtgcctggcacatggtaggtgatggagaaaagtctcctccattcttgtgtgcacatgtggacaccatatcctccctgtcagcattgttttacagagactgtgttcctacaggctcataaaaaaaggcctggatgaaactgccatatacaaattgagagcatttgctgagattattttcgttctcaaaatattaactttttttaaaggactagccacagaattggtatttttaaataaagaccctataacttctatcaaactcattgagttattgaatttgcacactggcttacttttaaaatgacccaaatgtctggcagtgttaaaggacatatttctgtacaaaaccattccaggcaatgttgggatggctcataatgagagatatgccagacttgtgaagttactatatgtttccaccatctccagccctcatgcctgcttgagggttgatacacagacatacagattcaggcatactcacacatatggtttgattttctctgattcagtctgggttttcttcatgcttttcttctgaacaaagtccacctttactcacaagttccatctgtgagacttgcacacatataactttggtcttaagagcagaatagaggggtgaactgaattaaaagaagaactgttcaaggcccctaaagatgaggttaataaggagctcgaaacagtgacctatgaggaacagtagaagatcaatacagtctagcaaataaataagaatacaagttttggagacggaacatactacagtcaagtcatttaacagttctgtaaccttgcacaggtctcttcctttgtcaaagactcagtcacctcctctgtaaagtcaggaatgaaagtaacagtctagtgcattgggtggtttagaggattggatgaaataatacacagtcaaccttttaggacagcacctggcacatagtgaagtctgaaaatagcagttgttattgctgctgttgtttgggaattgccctcctccgatagatcttctcgcttcttattgtgcatatcccgaaattcttagccccttttcaatcctgagccccctcactacaatctcagtgcgggagtaagagacagaagtaacctaatcaaccactctgtactaccaaaagcccttttattttatcatcctcaggtttcatttttaaaatattttttttaattccaaaagtcctgtataaaccgaatgctaatatattgattatcccaagagataagcagcatgccacactaagtttaagcatttccagcaaaaaagcaaaggcatgtctgggattccaagttggggctcattgaatagtgagtagggaaggaactggaagctgggaagccaggagggtacccataatgtgctcaggactacaccaaccaaggctctctcctggcctgggactcttgccccagcatactctatattctcaaagtttacagataaaagttggaactcctttgcggggagaagtcaggaacatgccaggatctgaggtcctccttctttcatccctttcccaaatgttgtgttccctgtcccattcccagctgcctggatggatggcagtactggtgccctttcaagggcctcagcaggaggcagttggttttttcccaccctgggtttggcatgctcagcactctcattttcctttctgcatccactgatgacactgaccactcatgacagcctctgcacttggtcagatgcccttccaggttaggaaacaaagccgttgggcgtgcaagagatggttgaactgacagacagcagcacattttgttttattgaaatacattttcctaagttggttacagctcagcttgttgcttcaaactcactgctgggcagttttccacctcctgagagggaacctccacacctccactctcactttctgaaaacacaaaactagtgtgtgaacagcattgcattttgttcatgggtttgtttgcataactagaatatgctcgtgttttcccatttttcagaggagcattttctgtcttcctcctttctcctttcttctctttctcttttccatgttctaggttgttttagtggcctggtggtgaagggtggaggagcactgtctccacatcgagcttctgatgtgtttgattcaaaagttgtgtgagttcaggcagccaactgcagctcttagccttgaacttgacttctaactactgaactatttttatggccacagagggcaatgatgattataactccacaaaatcatgaagtaagagagatgcaaaggaggtttctttcccatgagaatccatggtagaaaaacacagtttgccagtggtttggccaagcgtgaggaaggaattgactagattcttccaggaacttagtggccagcatgaagtatgacacttttcttctcttatttcaaattcttcatctgtaaaatgggaggatttgaggtttgttcatgcacacatattctcaaattagacattggaatcctgtttccaagattgtgggaagtagaactagagtacagaggatgggcttaatatttaaaaggtacaaataaagccatgcactggcactggagacgccaagggatataagagacagtctttgccttcagaggattgaccagcccctgtaactacttgagtacaaagtgttcagtgtggtaatgaggagcaattatgctctatgacaagttgaaaaaaaatcctactcatatttctcaagtcccagcagtggccttgtgatggtaccccatactggggcagtctacatgtctgctattttattttcccttaggctccaaatgtggcatcctctttccaaaaatcaatttgaatttatttctacttttgacagcctggcatataatgtcatgctttctagcatcatttctctatacttgaactccttgatcatcacatgactttctaagagttgtctctgtttaaccccaagggagacccaaatttggagaagttactagacttattcaaggtcatccagagggacctacatctactgtacggcctgtattgttttaattttaaataaatttgttttttgcctaaggttaggtgatttgtatgggactatggtccagattaaaatttagacattgccattttaacacatattggtgattatataattcttgatttatcctttctaaacttagtatattttagttagtcttcacatcagttatatgcctacatggctaaagtctagagccaaactatgcagtcttctgaaataacccttgttcctaaaacattgactgctgcagctcatgaaggagatgtgattgtctttgcttagttgtgatttaagcataagacaaatcacagggctgttagtaagttgtgcatattcactcagtgtggtcagttgtgttatttatcaatttggtttgatgctccaagaaggaagtgaggtggtgggaagagagctgtgggcccttgaacggtagagttcagttgcaagaatgattgtctgacatgagataattgtattactactgtgttgcttttgaacacagcatcacaattcaattgtgcacctccttacttagcaagagattcctcaagccttaatggctgctctgaaaatatatgaactcagagtttctgaggctgtcaaaacagagattggagtaccccaagagaagatcttagggaagtgactattcatccaatagtttgtgcatgagtgtgtgtgtctgccttctatgtgccaagcacagtgctaggtgctagaagtacaacattgaacattgcacaagacatctgtaattctgcccttttggaatttcctgcagcaagataaatagctagctgcataattgctgttacggagaagtccaaggtgctgagcgaacacagagaatggctacctgactcagacatcgggggtcagagtagcttttaggctgtgtcctaaaggatgattcgtgttaacctagtgagtgtagctgagcttgccaggaaccaggtgttctgacactttgctttctgtcctaacaatctctaaaattattttccaaaaggtaaatgagaaaaatagcagctgtgtagtttctagtaaaatgcattcattgtaaagtagtgtgctttattctgagattattttttcttttggagtgctactcaagtaccttttattttatgatatgagggacctcatacatggtggagtgtttttttttccccttttgaatgctttatttattcatcgaagttacacaaactgctgacttccatctcaatgtttattattaggttgctgcagaagtaattgtggtttttgccatttaaaagtaatgttgaaaaccgcaattacttgtgcatcagtctaataatatcccaaaagtctaagaaccttgccactggcacactctgcttctctgaaccagcacctggtttcctctgaaccaaattctcaggattctccaccccacccattacctggtcccatcacgatccaatccacaaggagctgaaggccagtgattttcctatgggttagccttccaagagactcagcaaaggacatgccgttggcagataaatctctgcatttagagcagcaataaagggggctttgatatgtagtgtctgtgactgataaaagaaaaatactacaggagacaaaatcagaaaccagaccaacatttcagcttccctcactcccaccctaactcagcatcagatttttccccatgtgtgaataccactacttcttatatacattcctattgctgtgagacactgccaatgcctccttctccactttcaccacctctactccatctcccaaattccttcagaaatctccctggaaaatgtaaaccagatcattttatcctcttacataaaatctgccagggtctgcttgggactcccaggacactttcaattctccattgcctagtatacaagacccttcctgattgtcttagtttgctgtatattgcttcagaggaatacctgaggctgagtaatttacaaaggaaagagatttatttggctcatggttctacagacagtacaagaagcctggcaccagtgtctgcttctggggagggactcaaactgcttcccctcatgcttggaaggggaagaggagccagcatatgcagaaatcacatggcaagagaagaagcaagagagagagtggggagacgatagagtctttttaaccaccgactctcaccggaattagtagagtaagaactcactaccatgagaatgacaccaagccattcttaagggatctgcccccatgacacaaacaccttccactaggctccacccccaacattggggatcacatttcaatgtgacatttggaggggacaaatatccaaactatagcacagatgtagccattgctgtcccctccagcttcatcttcctcaaccttgcaagtgagggcttgtaatgtctcttctcatgcttctatgcttctgggctttctggagcttctgccattttctctatttcccacacttggttcaatatcaaaccaaggtttattctttatgtgaaaacctcagtggcttctgaccctccttcagctgggtgtcattgctgtatgctctcattatatttaacacccacccactctatcataacacatataataacaggaagtaagagactaatggctaaggatatggtcggtagcatccaacagactaggggttgtgtcccccctctgacacttttccaagtggagggaccttggaaaagtggtgtcagccctcttagccttggttccatcacctataagttggggatactctagggcttttgaaaagcttcaaaaatataacaaaaatacttcaacagttccagtgtgtagtaaactttcccaaatggtagtgttattaatgttatcatattatgttgtgatctttcatttattcgtctcactttcttcataaaacttctaataccttgataatgaaaatcatgctttttttcattgtctgtaggcaaagtttctggcttaaacatggtatttaatagaatctcagtaagtgttgttgatgaatgaaagcagaaaagaatgaatgaatgatatgtggaaaggaaagaaattagaaaggaagaaaggaaggaaagaatgaaagcagggaaaaagaaaggaaaaaatggaggtaaggaaagaatgactcattcaataactaaataaaggaatgatcaattttcaattagtctttgattgatgctattatgttacatgtcaggcttccatacaaaatctgttattttggaaactaatcattcaagattccaagaatttaataaactctcccagcattttctttctgtgtctctttttatagactggagaggcagatttaggtatttttgacaatgaaactaagcaggaggatcaagtccagattgttagggcccttgggataaagaacaaaattcaggtttttgtactggtcacagcttggagaaagcttgttatttggaacaaggatatggatgcaataaacattctgaggtttatcttgctttaatgacttgccttaagtggctttgatctttatatttgataatcattttcaaatggtctggtgtgttctgaaaattaagtagcggttcatggacttgagaacctccttgggaatgacaagctacaatcagaatttggaaatgggcaatgttacagaatttgctctatgagatggagaaacaggacaacctcctgtgaagaaggtaaacacattaatccagtgttgggaaccaggtttggctggtggagcgggaacccaacaggcactgggagctaaggccagttttctttcaatccatgaactagcttaaaacagaattctgcatctcgagggtttttcatgagttgggtactcttctaggcatttccttgtgcattacctccttgaatttttgtatcctcctttcttggttgaattttctaattcccatttcacatgtgaggaaattgagataccaagtgacagggtcagttgtccaagatcacagagccactttgtggaagaaggaggatttgaacgccagtttgtctctctcttaaaatcaccctctgttgccttttattctaacctgaaagaactgtttccagtctctaggttgcttaaaagtggcccactcttggccagtgttcagctcacacaaaccttcctccagttgagggcatctacgcatggccagtaccatctctgtgaccagccgcacccatcaagagcccaggaagcatgactctggcgtgacattgcttaaagatctcctcagctatcacttctgcataggggaagtccactgaagagtgacctgctttgagtgggaatagaaattgagagtcctcagtcttgatctgggctcactgtaagctgtaccattgaaacgggaaggccagtgtattatgcttctacaggtgaaaacaggccttctcacacttttttcccatgattttatttaacggatttgttgttgttgctgttgttgttttgcattttgaatgtggttcccttttgcttctctctcaataaaacaggccctgacagccctctcattcagattattacagagttgtgccatctcaggccagtgcatttaggaaatattttgttggcacttaccaacgagtgagatgcataaagaaaatattctaatgacagttgagttgagagagctttgatctccctccagaactgcactcatggctttgaaatgcagttctggcaaaggggtaaagtctgggcgccttggcaatcagggctgggctccctgaaatagacattccaggggacccgcaatctcaatagtgggatccaggtgcatgggttgtgtaggaagacaagagacactgagttaccactcttgagaggcggctcaggggaaagtttctaaatcaggagggacatttcaatctagccaacattttccaaactttgttgtttgtactgctgtttggtttttggcaaaggtggaagtgtgtaaggggaggggtgtggaggaggaattatggtcacatatttttgggtacacttcctgtgctatctgtcttactcttattttgcatatttgaggctccaaaaattcttgcaattaaaaaaatatgtatttaaccttgtttaacagaccatgtcccaaatccatttgactcagcgacatttttctttaaatattcatcattttcttacaaatttagccctctgtagaccatgatctggaagacattgatctatttcacaacctcactgaacaggtacggaccctgagctgcagaacaaccagcagagtatagtgagaagtggtcagatattcaggcaatgcaggttcccacacccaggtgtccagctgagggagagaatggaggctgccatccttcccatgatttgttctctaaactttgcagggaactgtgtccacctgaaggaagaaatgactttacttatgatacaaaattgctgctatacacaagtgacatgtacacaggttagagcagagaggtttgttggcaggcttttctacaacctgtattagatatatgaccttgggcaagtaattccctttccttgagctctggccttgctcatcctgttttgaaactatgtaatttgagagagaggtgctcagtagctgcccatcggtggtggttctctcttgaaggatacttttaagtgatacggagataataaagatttggtcccaactgccagaagctcattacctgatggaaaagacagatgctcacacagtgaatataacccaaagcagattgataagtactggaattaaaagtagggggcacagaggaaggaggactcattttcagatagaggtgatgatgatgatttgagtgttgttaataatttttgttttgctaacaataatgcagtaaaaggagcctatcctaatcagtgatgccttctctgtgccagtcaccatgctaggcacttaacccgtgttgcctctaatccttatgatgcccctgacaggtggtcatcatcatccctactctacagatgagagtggtcataagaggatacatggagtgcatcacatgtaagctggactttgcagggttcataagatttaaagggccaatcatcaggaagaaagattgcaaggcagaggagggaaactaatgggcattcttaagggttgggcataactggggaaaactagaggttctcagaataagaaaaccaagagaacttgagcggttgaggttgtagaaggaagaaggctgggtaatgaggaagagacactgaaagctgagactgggagagccacgcagaggcagactgtcagtttaggttctttcccagcaggagaaaataggagaccaggatatggggggctcacattttctagttatgtgctgggactgtgctgagctgtcttatttaatcctgttgggatccgcatgagctaattgatactcagagacttaaacctacttgtccacagatataggtctatctgtccaattctgagtagcaaagcttctacgcagattaagccacacagattaagctacagattaatacacacacagcttaatctacagactaatacatgcacagagttggacagacaacttgcccatagatataggtctatctgtccaactctgcgtgagtctgggattttgattgatttttctgggaagtgagtaatgtttgtttgcttttggttttgttttaagagatggcctattgctctattgcccaagtgggagtacagtggtacaatcatagctcactgcagccttgaactcctgggcccaagcaatcctcctgtctcggcctccgaagtactgggactacaggcatgtgccaccatgcccagctaaattttttgaattttttgtaaagatgggatctccctgtgttgcccaagctgatctcaaactcctggcctcaagcattcctgccgccttggctgcccaaagtgctgggattacaagcatgagccaccatgcccagccctgacattttaaagtacatttgaccaatttacgatgtatacacagggacagccttcccaaaaattgcaaaatgtaagtcacatggccattttccttctctcaccttcactatccctagacagtaatgttccttctaaatttgacctcctgtgctttctcttctatcttgttgacaaaagtgaaaaaaaaaaatcctttcaaggcataggggtagggaggtaaatacccacatggactcctgtcccaaagattttccccctgatatatttgagagacactcagcctggctctgtattagtgggaatacctcgggcagcaaaaggaaaactttcatccacagagctgtgttgttgctttttttttttttcccccctttgggtgggttcccctaggagaggtggggaagagagaggcctggattgctgctgtggagtcttcccccttagggaaatggaggcttcccaaagtatgaaaaaaaaaatcacatacaagccatgaagaggctcccacatcccacttctctgctttgggctaggatgaataccacttcttgaaaagattggcttctgcaattaccactgaataaacaaccaattaaaatgtctcccctgcccctaccccaccctttttctctcttgaagctttctcatctcagagctatggggcagaggtggctttctctaataacatttgtgttctctgcctgagagaacatttgatggaaatgaacaaatcaattagaaaataataaattatgtggaaagggctgatccaagaaaatctcagctcctctgtgttttcattctcctcccatgcattgtttctcttttcactctgggcctgggtgagcttggaaatgagggtgaggttgtgggaagggttggacacatctagatttgtacttggccttgtctccagttgtgtgatctctgaacccctcttccttcatctgtatgatggcgataagtgataagaatagctaaacatgcactgaggctttctacatgccaggcattattctaagccctttacactctctttattaactaccttaaccctctgaacagctgtatggggtaggtagtattatcaccctcattctttatataaagaaactgaggtgcaggaagttaagtacattgcccagggtggcccagacataaagtggaaaagctggattcaaaacctagggctgtagcttaagaatgagccatctcacccactctgttgcattgcttcaactaccaaacagggatgagacatgtgtacctagcacagggtctggcatacagcaaatgcttaataaatgttggctgtctccttcctcgttctcttccctgacgacagagcagactgattagaattcctcatgagatttccagcctaagaagttgaatgtgggttcttggggaagagaagggctcagcagcgagatttcaggtcaatatctgagtttgtgtggctattcttggaattagtcagctacacctagacataaatgtaagctctcctgggcccacctatctccaactcatgttttttgtgaaaacatgtacaaattatggtcacaggaatgtttggtttcgtgagcttggggctttctgtgacatgggcggccttgacacgctagatctcagacgtatcctattcacagcagggtagaggtgtaggttttccacccatagaaatgatctgtggagcatcaggcagctgttactaatttcaatgtattgataaggaaactgaggccccattagtcaggaattattgaatttgagactgagagttaaatatttttactcttactttccctaatttaattcaattccatcaaaatctactgagggctcaccaggtatcaagctttgtgcggagaactgggtaaacagagattaataaggcacctcgccttcccccaggtggccacaagtgtgtattatgtaatagaaagaggaagcaatttattgaaatggcaaatgagagacagtgctctgctagtaggaggtggacgagtatggagatgttaaaaggggtgcaggtgaggagagcatcagggaagtcttcctggaggagggataccagaacagactttggatttgttcattagagaacaaaatgctgatcagagtcccagcagaggaaacagcatgaataaaattgccaatgggataatgcaccgtacagggtacagagatgttttctgtatgcagtggggtgctcaagaaaggttgtagagatagatgaggctaaggagtaggttgtgtcttggaggctatattgggaacttgaactttgtctttcatacatggggagaccctttattattctaagaggggaagagcaggaaaccatcactaatgtgtgctactggctgggctctgtgagaactccttgggagagacagcattaagaaaaaggaaaacattgctaagtagcaacttgaacttagtaaggtatgaagaaggttctctaagcctctggagataacgatactacctacctctgtgttcataagaagcctaacaactttggcaagtctctaaaactctcgagaacttaattttatgatctgtaaaatggaatcatcttacttataatattattgggggaattcaataaggtagtatttttaaagtgcttagcaaaatgcctggcactcatagtagctctaaattatttggagagggcctgttatctttttgggggcatgataacagccaaggttctttttctgtttcagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtgagtcttagaaactccttcaggaggcaactagagtaggacagtaatacacttagtgcgatgatgatcattgttacgatcatgatggtggtggtggtagttgtgagggtgaacaaccgatttatttatcactttttaatttacaaaattctttagcatcctttatctcattttgaccaccaagcaattttctgaaggaaatagcaccatattattaaccatgttttatcaatggggaaatgagacccagagaggaaatggggcttatccaacatcacacgcaagacagtgacagtcacaattggaatttaagtttccaacactgcccattgtttgctttctccttataccctctgtctcctagttcctgcaaatatcttctcagtctggtaaccacactgtactggcacagccagtcatgggttggcttaaaagacaccaaagaggcaagaaaaagtgagtttgcaagaactctgtgttcctccatgttccacccaccaacaccaacaggaactcttcttacattcaaattatacatatccataaacaagacataagtttgtacaaaccaatcaccaaaagttagacatgacaacagtttctgaaccaggccctgtaagcaaacattgcagttctttaattttattttttccatgctctcttccaggacacatctatatgtaaacatgcatttttttaactgtacatttttaaaatcatagcatagatgaaattctgtgttcttttttcacttaatattatgctatctacttttttttccatgtcgcagaagtcttatccttaacttcccacccatatttttttcacttaatcacaaaagaaaagcacccttgtgggttattttcccctctctaaagccaagatttttaatagccacataatattcccttgaacaagggcactgccatttatttaatcattttccgtttggtagaatgttcccattatttacaagaatgaatcgtgatgactcagtgaacatctttatctgagaatgttcaggctcagcagtgacagtgctggatgtatcctcaggcctgcctggtctcctggtgaaacagagtccagtagcttctccattgctattctgtcttggaaatgagagatttaaataatgcaagttttgctcaatgaaaccatagacttagttccctccagacgactctcatttctcaattgttttttagagaatgaaaccaatttgtgtgtgtgtgtgtgtgcgtgtgtgtgcatgtgtgtggttgtataaataaagatagatacaaagataaatatctacttgttctcagctgggaggattttatgccccaggagacatttggcaatatctagagatgtttttgcttcttacaaatgggggaatgctactggcatctagtgggtagaagccagtgatgctgctacatgtccacaatgtccactacaaagaattatacagactaaaaagtcaatagtgctgaggttgagaaatcctgagacatatggtgtatgggtagatagattggcagatagacagacacagacaggtggggttgggcagaagagagcgtgcagcttaggcaaacttgaagatgatcagcttatatcacatgcctagtatgatatatgggagtaatgctagactagagccaaaattcgtgtttgttctcagctgtgactttacttagcagtatggccttaggcaattctctttccttcctcaggtctcaatgtccttcaatattaaataagcaggtcctaggaggccagaagaccctaaggatccttctcagttctgaaattctgtcctattagaaaagcaactgaaagggccatgatcagagtctgagaaggattgagtagcaggcttctactgttagaaaaaactactcctgataattccataaatttcagagtctggctcagggccaggaataagggaggctataaatccatagcatgttatagtatttcaggatgatgtcaggctcaagctatttcaccttttaagagaagcaatgaaacaggactggggcccaagtgctgtcactctgtgaaaaggggtgagttgggaggggatgaggtaaagcaaacagggctagcctagacattaagtctgcaatccaatcatcatccctggaatggtcctgtcctctcattacctcaataatgaagcttcatggagagacagagaatcattggcattattgtagctgcttattttagagctcaccagagatgcaaagtccattttccacagtcacaaggccagtgtgaagcagaacaaggattgcaacctatgtcagctaactccagctggactccaggctgccctctccccatcccaagagatgctgctcatgagtaattcctctgcagtagccccaatcaaacccaatttattacaaccatatttttcccctctttttctgctattacaccatgatccctggaaaaagccttgggtgggaagcggattatgtttcatgttatgattgacagaaaataattgagaaagatttcctgtctcaatttctcttcctccctgcctctgcctgcccccttctcatacccaagtgaatgtgcacacccgcacactcacatgccctctcacacatctttatctttgtgttagaaagctctaagcaattcaaaattgctcagaaattcaatctctgaaattaagtcctccagtgaccctaacacggagacagagtccttcttcaaaatcagagacctctgcatagactctatgagtcccttgactgagcaagcacaccattccagaggttcagtctaagataaaaccctccatgcccatgtggggcttgccagctcaaatcaacaagaccctacctcctcaccattcttttagaagatgctgctctacacctaaagtacctactttcaaggttcacagacctgagttttaaccttcccttaaacattttaaaattttaaagtttaattatctctctggcagcctgtatgcatctttccaatgcctaaaatgaacacagcacaaatactacccataaattctgctgagatctgttctgtctatctgcccaagccaagcaattctcaatcttctgaggcatgtgatatagaccattgcttctcaaaccagaatatacagacaagtcattcaaggctcattttaaaatacagattgtgcttctgtaggtctggggtgaggcccgagattctgcatttctactaagctctcaggtgatgatcatgctgcttgtcctcaagtgatgtacttgatgtatggaggtgctattctagttctcacactagattagttaaacctcacaaacttctttagataagttaacattcagcaaatattcaacacatatttaatgagatactctgctccaggccctgtgatagtcattaatcatagaacgttgattaagagtcctgctcaagtgacattagctagtatgaaaactgttacaatggtgaatacagcatggtgctgaccttcattagcgttcatgctcttacagcatcagggatgaagatatgagattcagagatgctaattactccactcgatgtcacagagttagtgaaggcaaaatgggaaccagaaccaagatctctgagcctgagggctttgtctagacaagaatatgtagaatatttggaaataagagtaggccttactttgtaagggaaaggttgcagcagaaaggtttactggcccagaaatcagagtttctgaattgctctccattgaaataatttgaaatcaccttgggtaagtcccttcacctctttaagcattggcgttttcatatgaaaaataaaggaattgtacaaaatgacttttgagattccttcctgctctgataagtcatgattcatgccataggttgtaacagctctcagggcaatggagtcctagggtggagaagcttgtgtttattttgggcagcatctctttatccttgatggacttgggggttcttgcaccaagaagcagagtacctagtttgcctgattctctggatttccccttacaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcaggtagggccctacactctgtagggtgaacaggtctggatgtcagatgtgggatccaatcctggctcaggggaaccttgaacaagctacttaccatttctaaggatggaaggcctagctctgccacttatccacctaatgtctttcggtcattctctttctgggtttcacttttctcaagaaaatggaattgttggactagcatctccatgatccttcctaaatgtgcagcacatttttctaagctagtggttgttgaaccttttttatttaacccatgtgtcccttagataagcataaaactctcacattctctgttattttgcaagaacaatgagagtgctttggactttgcaaagagaaaattatgacatgagattgagtatgattttttttttcctaactgcatatatcttatcatagtacttttgagtaccactagtaacagtgttaggagcattaggggatgccctgcacttccctttagcatgggatacatcaaggccttggagcccttttagcacctttggcaaattagaacaagacaccccttcctcagggctgtcatagcccttaccactgcacctgcagctaagagtttttgtgttagtcacaatgcacacaattgcacatggcaggccagcatcaaattctgttaccatactcaacttagtgtctttttccccactagaacaagcaaattctatcaagccaaagattgcatctaatacatcactctattctcagaagtcagcacaggggccagtgcttaataaatgtttgttaggaaaggaagaagtaaagaaagaaagggaggagagagggagggctggagggaaggaaggaggaaaatgaataaattctcttataacaggtatataaaatttattcttatcaaaagcaatatttctactcatgtaacaaaatattgtccagaaaggcctttaatatgctctctctcatttaattctcacaacaaatgtgtagagtcagaactatccccactctacagatgacagctttgaagctcactgaaatcatttgcaccaagtcacatatctgactccaagtatttttctcttttactcttgtatttcttctaaagagagctagctgatggttgagtggggaaattgagcaacctgggtggcttttacactctgttccacagggatgcttcagggcaactgccctggtggctatatgagtagggctttaggctctcattcctgctaaagccagggaaaacacaccccctttctgactattttacatttctgttgaggttttgcctcattgcatttgaagagaggaatttgctgctggaacccaaaggtttctgtgatccccagtggttctttctgcttgtccatttgggctgatgacccctgggggcctctccagtataaggttcctgcagtccaaatctgaattgaagtgtcaataacccacctctggtaccataaagagtcttagatttgagtgctcaaaaaagaccagggtgctgggtatttcctgaaaagcagattcccactgggctcccattcccagccaagctgacatcccacatccggtgccccatcccctcatacaacactgctaaagttccatttctatagcaccttttcttggccagctcaacacacatggaaaataaacaataacataagtttggaagtttgccggcctcttaggggctaggagctgccactagctaccagacccccataaactaaatctttttttttcccctttgtacagatctaaagggtgattgatttactattttttttaaaggaacccctcagctcagtgacccattaacagcagaactaattcactgagctacgataacaaacttacacccacaaaagcatattcaaggcaaccacgatctttgaaatgtttgttttccttgggatttctgatagatgaggtgacaaaagcagctggatgcaattcaaaatgcagaacaggactgggttctcagggctatggagagccatgcatgggagctctctccatcaagataattgggtgaagacattgctgggtcaacttcttctcgttgctttatcttcctgggtgcttcttcctcaggcctgatcactggtagggtaaaggtttgtggtgcagcactgccaacagaactttctatgaagatagacatagtttatatctgtgttggccagtatggtagccatgacctctactacccatgtggtaactgaacgattgaaatacaactagtgtgactaatgacctgaattatcaatcttattttaactaatttaaatcagaatagccacatgtggctggtggctaccatattggttagctcaggcctgcagtaattcttgagtacgtgtgacatgccggacactgtatgaaatttttcataggcttgtctcattgaatccccacagtagcccaaggaggtgcacaagttttacagatgcagaaaatgtggttcaggtagcttaagtatcttgcccagcatcacaaagataaaacaaggcaaaggtgaaatctaaactcaagtgtttcttactgcagagcctgtgttactaactagtaagtatctgcctcattttctggttgtggggaaggttgagagggccacaaatgctcagatcaagcaggcaccaggcagttgatggggggaagcctaattcagtaggcaggctggacagagctccagaggagtatagttatgttgaactcttgggtaactcttggaaaactcaacagataaaagagtagcagacccagttccactttctggagataataggctacaagagttcctggaggaggacactctggtcctcaaaactgcaggaagccaggctttctctagcctacaggagcaagtgtcctgtccccatctttctgtgtgtcatggcttcttaatatgcacacatagattgacccagcaattccacttctaaggaatatatccaaagcaaataagtcaattggtatgcttaaagatttaaccgtaagaatgttcttaatgatatttgtttcctaaatatttattaggcattcactatatgccaggtatagaaaacaaaatgtttgaataattagaaactgcttacaagcctaaagataatgcattgctgaagtgaactgcaaggtattcatgtgataggatattatagggccactaaagatgacagagaagatgtttgaaggacatgaacagaagtggaataacatggtggttcagagcatgaaatttggagtgaggagacccaagttgaatgttcggtgcccagctttgatcttcggcagtttacttctcctctctgagcctcagttatttcattaataccattgatgataaggatgcttgccttgcctgattgtaggtgtaatggtacaagtgaagcacttagaactgttgttgttctaagtgcccattaataatagactggataaagaaaatgtggtacatatggaatactatgcatccacaaaaaagaatgagattatgtctttttcagggacatggttggagctggaagccattgtccttagcaaactaatgcaagaatagaaaaccaaacaccacatgttctcacttataagtgggggctaaatgatgagaacacatggacacacagaggggaacaacacacactggggtctattgaagtgtggagagtggtaggagggagaggatcaggaaaaattgctaacgggtactggccttaatacttgggtgatgaagtaatctatagaacaaactcccttgatacaagtttacctatgtaagaaatctgcacatgtactcctgaacttaaaatgaaagttaaaaaacaaacaaacaaaaaagaactgtccttggtatcataattagtgctcagtaaatgatgattagtaggattattcattgactacttaatgtgaaaaaggtcagaaagccatatatatagtgtaagacctgtacatatgtatgtgatgataagaattatagaaatttactgtagatatttacatccatatacaaacacatatatatatacatacatatacacacatataccttagacatcaattttattatctataggtaatgagttcagggtaatgtttattttttgtaacattttgacatattccagatactctacagtgaagtttttattataaaattattatctacatctattattatgactattattactatcattatttttaaaaacatcaaaaagacagagagtttcacacaaggcaacttagttatccattcactagacattagttagcttgttaaatgctctcatcagctttatgagacagctaacatcttattcctcattttatggtgggtgaaaatgtggctgacggggggtcagcattgtgtccaaagtcctaagtggagtgaaggcatggtattcatgacctgaacctccatgcagtgtgccctttcagccacagatggacatttgttcttgagaggaagattcagttagcaaacccagggtaccgtatcaacagcatggggactggcataggcttcccagtgctgaagtcccgaagttctttctgctttgggacaagatacagacagaagaacaagatgagctggccactcctggagaccagatgaagtggccacagatatcaagaggggaggcactggggggaaagaagccaagtgggactgactctagacattagctaattgaggcagatcttttgtgatagatgaaaaccctttggtacctctccccagattttgatagctgctaagtctccaagtaatgtaccttgggatagatttcgacttcagctttttttttatttttattttttgaggcggagtcttactctgtcgcccaggctggagtgcagtggtgtgatctcagctcactgcaacttctgcctcccaggttcaagcgatttgcctgcctcagcctcctgagtagctgggattacaggcgtgcaccaccatgcccagctaatttttgtatttttggtggagacagggtttcaccatgttggtcagggtggtctcgaattcctgacctcgtgatccgcccaccttggcctcccaaagtgcagggattacaggagagagccactgtgcccagcctcaacttcagctttaaagttcaaatacattcctgtctccctactaggttccatcacctacccattttttcaaacttatttttatcaacaaatgtgaaaatggttccattttaagttataaaagaaaaatacacttttttgttgggggaaagcaagtaaagtagatgtttatacaggaaaaaacctactgtttttcagtgtcattcatcttgagaaatgctttttgtgcccttgctcattgaattctcacaacttcatggtttggagtttatttaaatgcccccaatttatgcacgagggaactgagtcttcaagttgtctcattttttggtcatgtctgattagtattctgttctatgtctgtgccttaaagtacacagccatttccctatgaatgaacagatgtgctatttctaatattttcaccattataaattatgcttcaagaaacatctttgtatgtctattttacccctgtttacccaagagtatctatcttttgaatccataaattccttattgttagatcaaagagaatgcatattttatatcctgaatttttttcctgcttccagttttctaacactcacacatacatgagcacacgcaagcatacacacacacaccacacacacactatttccaattcccatgtactaacatttatcatggggcaggcattgctcttagtgccccacacccctgcaccttggctgtgttttgagatgagcaatcgcgttatcatcactgtcttcacttcacagatggggtaactgaggcactgggggcagaaaatcacttgtccatttgactccagattctgtgtgcactaatctagtcacgtggccatacttcttcccttagccatcatgcccttctcctgcatgtaacctatttggtggcttttccaaagttttcaagatgaagtacaaagttcatggcaacaaagaaaaaagtgtccaattatctggcccttttcggtctgaggactttttccttgcaatagggagccatagaatgtttggtattcaggagttacatggtgggatctgggtttgagagagatttactcggttattcactatactgtgtttgttaagagacattgggctcttccacttctccaaatgtgttaaagacttccctaaggtgctggaaaggagattggcaaaaattactaaggggatttaaggcagcttctgcatagaacctccctcacaccctgcaccttccctaagctggattctcaaagccatgtatatagctgtccagcacctgcccaaatgtatttaatgtttgtttgataagaagaaaccagtatatgctgcaggattcccagtagcaagtttattttaagattggaagagccctgtactcctctgtctggggcccagctgcaggctccctgaccaggtggacacctctgggaagtggtgtttttggaaattaagccaaaacagtgcattgccctgtccctagggcagttgaataaaactgttggagggagaaatgcaagcgttctccctcagaaccaggtcttaggtcacaccctggaaaagagagattaggatcaaaggtccttagatctaaagacacctgagagattgtgttccaagctcccttagcctcagactcaactcccatttatcaaccacctgcaggattttatatccatacaatgtctcatttatgcttgaaaagaagttctcatattgatcagaagcatggccttgaagtcaggactgcctgggttcaaaccccagatgtatccctagctttgtgattttgaaataattatttaccctctgtcagctttaatatcctcttctgtacgataaggaaaatagtagtgcgtactccaaaactccagagaaggaaaggggtttaccgtgtctaaagcacagtgcaccaatggcagcatggagtgggagatgttactactcatattttcagcatgcacactaccctggtttgttcccaggtctgcctgactccctggcctgtgctctctgcctaaggcaccatgcctctgtagtcatgcagcactttctcctgcaatccctctcctttcttttccaatcttagccgtgcaatctgatcagcctcaactatctccttctttagaagccttcctggtcgcctgcctgtccctgcacccacccatgccgtcttcctcgctttatcagtgattgacatcacagactttagtagccttgtaacaaccttgactcatacactggactggtcttgactccataactagacttgtacctcatcatgggcaggaacttttaaagtttcatctttccatgcccttgggcacagagcagaaatgtagtagacactcagaaggtttgtttgaagggtaatatcagcacattggttaatagtgaaattaatgaatgagtggatgaaagaatgtgaaggaatgagttggaaccagtgagtgcatcaatgaatgagtgaatggataaacaagtgaatgaatgaatgaatgaatgagagatattgagtggggggtgagggagggagggagtaatggaattgttgacttagtgcccagtggatttgggggccatgggaaataggggaaatagctcatcttgcctgtgtcctttgccgtgacctctgggctgctctcttcccagtctcagccatactttttcagttacatccacccttccctccctcctgtttcctctcacctgtctccagaagtgatgactacactaatttgttcacaggccattaactcttgagagctggaagaggccagccctgagttggcaaggaacgacttgggtgctgactcttgggccgccaggagccgtcattactctctcatatgcctgcctgccttgcggcttggtgcttatctctccctctgcctgcttgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaaggtgagtgtgccctgtgtagtgttgatccctctctctctctcctgccaagaagaaggaaacttggaagggaagcagacttggagagggattttactgcatttcttgttcttgttcaaaaggtatctccaccacctagcatgttgtaaatttgggatcagggaataaataaatggtcattaatagaaacaaataaataacaataaatatttttaagtgaatgggtacttagattcactttgttattagaaacttggaaacctcttttgctacagacctcttctgggatggaggtaatagtctcatctccatgagctcaggagttgtgattgcctgggcaaaaacatttatattatattatatattatattatattaattatattgtatcatattatatatgcttatatatggatatatatatttatgtgtgtcacgtgtgtatataagtacatatttacatataagaatacatatacaaggccgggcatggtggctcactcctgtaattccagcactttgggaggccaaggtgggcagatcatgaggtcaggagttcgagaccagcctgaccaacacagtgaaatcccatctctactaaagcacaaaaattagacgggtgtggtggtgcgcgcctgtaatcccagctacatgggaggctgaggcaggagaatgcttgagcccaggaggcggaggttgcagtgagccgagatggcaccaccgcatctcagcctgggcaacagagcgaaactctgtctcaaaaaaaaaagaaaaaagaatgcatatacatatatgacatataaacataatttttgcaccaaatgttttttttttttattttgtagaactaaaggtagcattttataagaccagggaatgataaactgaggcacaaggtacctctattctgctgccctgactgttcgttaattaaccacatggccttgagcaagtcactttctgtctctgagcctgattctcccttccctgaaaactgggtctaatgatactacagtggcttgaaggtggagacctgaatcaagtggtctcttgtgatctttcccccatataaactccttgaggagctcaagctctaaggggaccagatttaaaagggtcatgaaaatagaccaaggtatttgcatctattttggaattttgccataattcagggaagattaatgtattacctctactcccagcccttctttgggatgcttcatctagtaatggtgatatattaatgatggtaaaaataataaccatgctaataattagttaatattactttattgtagttgctgggatctatcaagtgcttactatgtgatggattctatactaaatgctttacatacagaatctcatttaatctttctggtaaccttgtacaaaacaaatcatcttcctcatctgctagataaaaagagaattggagctgaaagaggctgaaaggtgaccagagggtcatggaaagtggcaggcactgggcttcagctcttgttttgtattgtgttatctcagactcgtatgtgctttcattaagttgtttcagaactagaattggagaaaaggcattacactgccccccgcaaggcaaaaaaaaagccacaaaaagaagcaagaaattctcatttacaagtgtatttgtctgcatttgtgtgtgtgtcaaagacatattaggcaaaggacctaaatagacacttcaagacacacaaatggccaacagctatgtagaagaaatgctcaacctcactaatcatcaggaaaaggcaaattaaaaccacaagaaggtgtcaccacacacctgttagaatggctattaccaaaaggaggaaagataagaagtgttagccagggtgtggagaaaagggaacacctgtgcactggcagtgggaatgtaggttaatatagccatcatggaaaatagtatgggggttcctcagaacattcaaaatagaactgccatataatccagcaatcccaattctgtgtatatatttaaagaaattgaaattagtatgccaaagagattgctacactcccatgttcactgtacattattcacaatagctaaaatatagaagcaacctaggagtccatcatcagatgaacaggtaaagaaaatgtggtgtacagatggtctccaatttacgataatttgacttccacttttttgtcttcacaatgacaaaaaagtaatatgtattcagcattgctttgagtattaagatggtataaacctattgtaagttgaaaatatcgtaagtcaaaagtgcattttcaacttaccgtattttcaacttaagataggtttattgggtgagtcctaaccccattgtaagtcaaggagcatctgtatagacacaatggaatactattcagccttaaaagcgggaaaattctgtcattttcaacaaaatgaatgaacctggaagacattatgctaagtgaaataagctaggcacagaaagacaaataactgcatgatctcacgtatatgtggaatctaaaaaaaatgaattcatagaggtagaaagtagaatgatgaccaccagaggcaggtggggtgagtggggaaagggacgatgttgatcaaagggcataaagtttcaggtagatgggaggaataagctttagtgatctgttgcacagaatggtgactctaataaatgataatgcattgtatatttcaaacttgtgaaaaggatagatttcaaatgtttttgccaaaaaacagtgtgagagatgatggatttgttaatttacccaatttaatccctccacattgtaaacatatatcaaaacatcttactgtactccatgaatatatacacaatcattatatgtcaattaaaaataaaatgttaaaaatttttgaaacctatttgatcacagtaccacataaaatgtgggcattaatttttcacattaccatcagtacctgagtctagaacctaaatttggtagctggcgaatgtgatcatcagggaaggaaatgcacttactatgctctgtagaaattccccttcccctgccccagccatcctcactgggagcacagagctgggtttgggaaacctcgtgtgacacttcagaggtttccagcaggccatagatttatttactttttctgtggtgatgagaagtatcagacttttggtcaagccttggcctccattccacttgaaaatggaagtttcataaatgaagcttcctgtgtatgtatttaatttatatttcataaagcagttactgtccattaaataaataccacctgattgttggaaacctatttgagggttaattgttgtgtaatgagatatgtctctattacacagtgtccttagcttcaatcaatatgtttttaatcacctatagtcagttggttcttgaggctcatatagtagctattctgttcagtttaagatttcataacatagttatcatacgttaaattaaaactgacatttccaaaacatatctaattagggttagcagctacgttgaccatagtctatggctaaaagaagtcagtccacaaattcaataaattgttgtaaagaaatggaactgtctttaacgtatatcactctcccatacagatggaatttatactcatgcaaattggcttagtagaaagtatacaagctttaatgccaggtcatacatttcccgtcctcagctttatcactcccagtcaatgggaccttgagcaaagccatctcacctctgatcctctgggccttcttccatcaaaatgtgctcatcctgcccacgtcacctggcttttgtgaagaatttagcaagataacggtgaaatgccaagcacacacactctatgttcaagaaacatcagctcccattttgtgcaacattttccagagctgtttagcttcttaaaaattccctttccctgcaaagcctctggtgttttccactacatccatcaatgccaacctctcgcccctggccatcctcatgtcctcctgctgttctcacatctgtggtctaagagaatacaagggtttcccttaaaaaaacatattcagatcctcccacagcctgtgtcctcacacatgggcaactgaataaataattcaaggccacccctggttttcctaactcctttatttttatctgtcttgcaaacacgtgttgactgggttgtttcagttatctgacaattggccatggtatattggaaatagtactggactgaaaaccaagaaacctgggtctgaagtctttgcgacctcatccattccctctgcctttggcctcagttttctgatgtgtaagccaaagatgttctaggctttctcaaccaaggttcctcttctaaattttaagacatggaaaatgatttgtgtaactatttcctcatttctcccaaagatggtatataataagtactattttagtttcataggagacaagttaattcattatatacaatggatgccttggagaaacactgtccaataggatttgctgcaataacggaaatattctatatcagtactaagattatagccattagccaactggggcttgaaatgtgactggtgtgactgaagaatcaaatttcaaattttatttatttttaattaaattaagtttaaatagccacatatggctaataggtgccatattggacagcacatacttagagctttaagctttaattttcatgaaacccaagtaagaaagatgagctctcccagctttggtatcctgcatgtctatgatttcattgtgtatgtttgtgtgtgtttatgtgtagatataggtatccatgaagacaatgtgaatgtgaaaggtaggaaacacatacaattcctagatgtgtaggacaggacatcatacatttgcttcagctggatgattatttgttcactcatccaagtatttattgggagcctgggatgtatcaagaattcactgaaactcaggtggctttatgtgtatcacccacaatgaaacatctaaagcacatagacgaaataatgaatgaccatcaaggtcagcatggttcctgaattcatcccagaacatttgtaaccccagtgtcagtctaaagccagtcatgtgactcaaagccactatgcgtggattgtggtcatcctaagggaatgcctccattagcagtgctgaggaagcctttctctccactcctacttttctgcatttgagtatatttgtataattgttattattgctactccaagagtaactcatgtatttaaaatatgtagaaaatttagaaaaccagaaagagtaataatagggggtgggatcaatcatcctatattccattgcccagaaattgctgctgataatattttgtttcatagtgttatttgaacattgagatattgctatagatttagctttggatgttactttttcatttaatattatagcttacacattttccatgaagttgcataatatttataaatatttctgcaataactgcttggcattccattaagcatattaaccatgggctatttaatgattctcttatcactgaatattaatattagtgtgcttgcaaaatttccacctacatatggtttcatatttacaatgataaggctgagaatgcaaaacctacaatttgaaggtctgcactaagttagccatgagtattagcacatgcctaagtgactggtatccatccatccatccatccatccatccatccatccatccatctatccatccatgcatacacccatccattcaactgcttatactgaccaacattataagataagttgtgtgctgtgctgtgtgaaataaaaagatggttattagatattgactttgtcctcaaggacctcacaatctattaggataaactctcctgcatgtcaaaaaaagttttcacagaggaaatgatgtcaaaggtgaacttgaaggaggagaaacatcagccaagtgaaaaaagtctgcagaggggatgtgggtaacatgacgcaacatgataggtagacagagcttatcatggagagaaacaaagctagagtgaagcagaggatagtatgaaagagcattgaataccacattatagggcattaggggataaaatcactgaaagaggtaagcagaggcatgacttgttcatcttgaggtttggggatgatctactgtccgctgtgtggaggaggaacggggagaaacagcacactctgatgctcacaagcacacggttcctgactgtgtgagcccagaggcatagtgaacgtccctgtgaggggaaagccataaggaaggcttcagacctggcttctccattgcatcctttcaggtagccaaagcacagaagttcttccaggaatgatgaaagagttatcatcaggaccattgcactttgagaaataatgggttgtgctgggacatttctcgacgtcttcccgagattttgtttccagtccctctgcagaggtcactcagatttgcagttttcagttcacaataagacaggagaagaggactcattcctctcccttctccacaactgcctcataaacagatgccaaatctggaaaatgagtaggatcccagagactctatagccaaaggaagattgaatccagatacacaagacccaacttggtaggggaagccatcataatattccacttctgggactggtcccattgagggattggctagccccttggaaagccgctacaatgaattagatggcatggtagagaaactgcttttgactgtaaaatcgaggagtgactcatccatccacagaatgtcaaggctggatggttctttaggcatcatttaatccagccctcttattttcagaagaaggaaccatgccatcttcatatttaatgcctaaaacacaagatggtgtctggcacatagtaggtacctgataaatattgtaaaaggagtaaactttgagaacgaaatggagcaagagattttctcataactacattgcaaatcctcagtggagctttatatgcctgataaaattaaaattattgcaggtggtgagacttcagcctgttgactttgtgctgctaaaagtcagagaaatgtatgcatcatcagaacagaagccacttaggctcaaacgaggttcttgctgggcaatggggaggcatttcacttacggttatttccagaagccttggcatatgtaggcaggaaagggggaaacacagatttgttgtgtcctctgccccattgactctggcctagtcccatcagttgctcattcaactgttcctaagtcggtgcattttccctctttccttggcctcctagagaattgggatcagcatgtcatctttgcctggaagggagaatcctggtgcagtatgcttccaacgcttcctccccaatgccctgcagcccatcaggacactggagccctcgtgaagcagaaggtaagccagccttctggaagctcattgacaggaggagtgtgcaaagaacagctctttcaatgtatatggggttttattatttttatgggtctttgccatgtatcatttcatttgagtaacatcatcctgcaaggttagtagtcaagcgctcatccatttgacaaatactttttgagcacttgcactatcctaacatgttgttctcatattacaaatgaggaaacaaagacaataagatattaaagaagtgcccaaggccacacacctgatacaaacacagtgtcttgggggtatttatatatccttcagaccccaactgcttgtagttacaaacaaggccactttagagtcaatacaaatattttggggcttcaaggcatcagtggtctttgattcttcttctgttatttcttagactatacagagcactttcacatgtgttgcaactattccttttaatttcttctatataccctctttttgggatctatttacctgtaagacacataaaggaagtgccttatgattgccactattatgggttccacccactatcagactcttccctgctcagggttgtctctcaggcttaccaaggaaccaatgatctctgtgctttcttacatcatcattgaaattaagagaagaataccttttgccaaatgcttgttgtcacactttgtcacttggcctcagaaccaggctggcagaggctccatactttcctcttagtctttcatctccccctccctggtactcagggatgtacacatagaccctgcccccacccagtccctcttgctcttctgcaggttagctcatgccagcagtcactgggtgaggacactattacaccagtgcatcagagggagcggaatcagtcttctcactgaacaccagtgagaactcctccgctatcctctatatttttagaaagaaggttgaaaagaaaaagccagagatagaataaagcaagggggaaggatcagagaggaaagtgaagttgaaaaacgacggcactgcactttattttttaaagtagcttaaaataaaaatgagagtcaaacttgggaagtctaaacaaatccatctggaatgtaaagcaagagggatgtctgggaaaagccctcagttcagcctcacagaatcacaggctgtcagacctgagagggatgcctggggtcatctggcccgggctccccccaagtgcaggaatcccctctatgtgcatcctcactgaggttccctggagcctgttcaagctccagttttttaggaagttctcgaaatctgcaattgtaatttttccacccaaactgaacccactttgggttgtcacagagaatgtgtgtctctgccacctgacaacattttgcatgcttgtatctagtgagcctgtctcactagtgaccaacacaggcactatatgctgggcactgtcttgggcacatgggcaaggcagtgctgagtgtctgctagggaagtcagataagtaaatggccaattaccattcaatgtgaacaggcttatggtaatagaagtaccaagtggtgctgggggcccataagaaggggaccccatgcagaactggagactcagtcttcccatgaaatatcacaacactattaacgaggtgcatctgagaatgtgaaaaagtttggtatgttcacagagtggctgttttctaaatctacttcagaggcttatagggttcctggagacgtttatagggtatcctcaaagtcaaaagtattttcatacaattacatatgacatcatttgctttttccactctcattctctcctgagagtccagtggagctatctgatagacacatgacatgtgatgtcatttgtgctctgatagctaatggagcacactcttctgtattcttgaatttttaaatttcttagctttagtttataaagcggaaactactaatagatataacctgcataagcaaaagttcagtaaggctataagagtttaagtaggttcagaacatgtaaaacaaggtagaggtggcagaggtaagacagatgagatagataatggccaggtgaggacgggtttggattcacagcaagggcagtgagaaaaccatgtgctttatgagggcatgatatatggtaagacctgcatgtcataaagattgctcagactgctgtgtgaagaagagatcaagaggatttggttgctagaggaagggaagcagcaaggtgactgttgccaaaatccagctgaggaatgatggtgggctggtgaggtcggtggctgtgagaatggagagaagtttatggggttgagaggtacttggaaggtagaattagcaagattctcccctgagatgtctctggctaaaattatcttgctttgttctaccacttgtttgaataaaattatttccagacatctccccacacttacatccaatgcaactattagttggtgaagtttgctcctagtttgttcctgaccttcttaaagcatgatatgcagaatggagttcaactggaggcactgaggtctctggttccctgagccaattcggagctccaaggaaacccagcagccttgggttttcctcctatgtaaatttagtacatgtgcaccaggaaaagacactgttctttttttagagcatcctattacagtctctgtgatccttttggctcagacccttttaatatccttgaagaaataaacttttccatgagccaaactctgcaatttatttctcaactcattctcatcctatttatcttcacatgtttaagtttttggacttcccaaactaacttaaaactcccaaattcatgagcaatgccagacatatctgtatggttggggaaaaaacatggggaatgcaggggagggaaaggaggaggattggaccatggtctcagccctactattgatgtactctgtgcccttgagtgagtcacatagcttctctgaaaatggcattgtatccacagaatgaaaagttgaaatataatatcctttctagctctaatattgcatggagctgtaacttcttttcatataatcccatattaactagcagaagattcttcatttaacaaatctttattggaaatctactgcatttcattagcttcatttctaagaaggtaaatacagtcatagaactgcttgcctttgttcatagacagtggttgcactcctaccccttgagcaaaaactgtatttcatacatgaatatttttgagatatttgacgccatgttttatctgtagcctataaattagataaatatatatttcttgatctgactgactcaaatcccagttaagatcacttatgcaagtataaaatagatcccaagtgttgggttttccatgagagattagcacatggcactaactgtttttattttttctcatttgtgtgttttctctatttttctgcccagaatatttcaggtgtgcttaactattcacctggaaaaaagcttggcaccaagtttttataactatatttgtgtcaacagctgcagtgtatatatatatagatatataacgggtgcctgtatagtgcttcacaaaagtaaatatagatcagcatgattatgtataaatatatgtctatacacatatatgaccttatttctagtggacagtttatataaacatgtaatttttaatttaatcactgtatatacaaaaggatatctattaataatgaagtaacagggcttttacacttagttctcttttcttctttgtttattcttttctccccttccacctttcctcctcccccttccttatcttcttccttcccttctcgctttgtttcttttcttcagctcctgtccttaccttccgactacatgtccaatcaatctcccagctgtgttcacttttcctccttaggaattctgacttgccatctccttgcatgctttcttgcagttcatatattgtctgcgttagtccaatactctcctaactagtcttgcaagactaaaagctccctgagaacagagatcatgttggcaagcttattctcttggagcctagcctacctctggacacacctggcactgaatagttactctttgaatgcatggaatgaatgggcggatggatggatggatggatggatggatggatggatggatggatggatggatggatggatagtgtctgtgtctctaaacagtggtttttcttttcttttctttttcttttttttttttgagatggagtttcactattgttgcccaggctggagtgcagtggcgtaatctcggctcactgcaacctcagcctcacgggttcaagtaactctcctgcctcagcctcctgagcagctggggttacaggcacgtgccaccacaccgaggtaattttgtatttttaatagagatgaccatgtaggtcaggctggtctcgaactcctgacctcaagtgatctgcctgcctaggcctcccaaagtgctgggattacaggcatgagccaccgcacctggccaacagtggtttttctaaaaggcgaccctgatgtcactcatttgcttaaaatttctcagtagctcttcgtctatttcagtgtaaagttcagtttcctccttaatgtagtatacaagccacttcacaatcttggttctacttagcttaccagcctcagcatttgttgctctacaattgcacttgaaaaccatagtaaccttaacttacactctctcccaactattctcatgcttggaatacctcctcttaccaatattttccttgttaatacgtccctactttccaggacagagctaatatatttatgggaatctattaatgatctcatcctatttgaggtttacagcaaccttgaggtaggtaacattacagtaggtaacacaatgagaaaccctataactgatattttaacccaactttcattccttcaaagcctggcacgctgcctggaccaacaatatcatattctactccctgccagggaatttctgaaccatctgagtctcagtttcctcttctgtaaaatgaatttcataagacctgcgtcacagacttagtgccaacgtaaaaagacctgaggcgtgtaatgtgcttggcacagtgcctgcacattgaggatggtcaactcgtgaaggctggcattattaatgaggttgctgctttggttatggttacacttggtgcctctagggactcttttttacatctaagggtttgtctctaataaccagacaaccacaagctttgctaagatttctactcctgtttacttgcttgagcataatgaccagactcaccttcctgtcctttggaagtatttggtccctctgttgattaacaagaaactagggaggaaggatgagccaggcagatttgtcatctttgctctcctgtggcttcccacccctgacagtcattttctccaaggaagggaggaagattacatcatcccttgccagttgcaggagaaagcccatggaggggtggaatgttcacctggcacccaccatcaggaagcatgctttaatgttctatgctgtaacttttaactcaatgttaacaggctagaaggttaacaaatatttatttagcatctgctatgtgaatactctatggactaggcacactgtattaagcaaaagctacatggcgttgagcgaagcagtgctctttaatagagacaaaatgacaacgatcttacaggattttgatgacaatcagatgagttaactaataactaggagatgtgtttcatatactgtaaagtgctgccttcaatgaagttgactgaatgaataagtgatacatgtgtgtcaacatcccacaaagttaagaaagtcaggaactcagtgtgtgggaaagtagacaagaagaaaggcttcagctaggtggggagtcctacttgtgttttacaccctaaactaaaggttgctttgagccagcagttactgcaaataatgaatgaaactagccaaggagagatagaggaaatcttgtaattaaatccatcttttcttgctgtgatgcattatatctaagaagcctctgtgtattttctcacccctccttctcttttcctcttctcttctccatctccacttggtggcttctttctttccttggctaagcagaggcaaggaggttagaggcatttacagccttcactggcatagttttttcactccaaataactttctagtattgacattatagtgattcctgttaccctgtaacattaccacaaagcgtttttaagcaaagatcttttttttttcttatttgcttcagaaatgtctagggtcaccaccaccctcccaaccaaccactgaggctgaagaaaaaaaaagaatgtggctaggtgggcatggggacacatgcctatattcagctactcaggaggctgaggcaggggaatttgagcctgcaatgagctacaatcagaccattccactgcagcctaggcaacagagcaggactctgtctcttaatttttttttaaggtgtctagttgggcaacttgaggtccttcatcttaccatccggtctgtctctctcatgaggctcccttaaacaaattagagccaatcactacattgagtcctggttattttcctcagtagtgcaaggaagagctctctgggagtctagatgtgatctcagcagagaaaaattcagaagtcgctgcaggctgagatcagtggggatgaggcatcatctccctagggaaagaggagaagaaaccctccttccttctccccgctcctcacccaaccctccccttcctgagtgagacagaacagagtgcggagaagctcagtggtatggaatgactgcatgtagagaaggggaggaggagagataagagggctccaaggctgccttccagctctgttgttcatggttctagacagtttcctcccaggtcctcagtctgcagggtggatgctatttatgctcacctattctttgctggtcggggggtggggttaggatttctgtcagtccaagtaggttttaccaatggcagtaataccacaaggattctaatttattctactgtcccctgcatccaatagggagaacagcaaagaatacagattccaaaatgaaacaaaactcggttccaatgctggcttttacacttcaagttgtatgaacctgatcgattcactctatatttgggagccttagttttatcacctcctaaataagtccttgcaagaattaaagttcaggggacacagtgggtgtttagccaatatgtaccctttacttcttttcatcttaggcagcacagcctcctaagtggaagatgaggaaggaaagtttgaacattgactcggtagtgagatgaaagcagtttgactgaatgtctggtgattcctctgaaatctgtattgcaggggtggggatgagatggatgctgtgtgtatagcagattcaccaaggcaccaagaaccttcctctccttttcccctctgtctaagttctagtcagaccaatttctcctggggtccacaggaaactctaaggatgggaataaagctctttccccaagaactcattccctcatctcttctgcataggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatgtaagtgcattctctgaatagggagtttattaagtgggtgggttgtggaggaacgtgaggtgggtcagagaggcctggacagggggaaggttcatcacagtcaagactcactctatggattgtaacccatcattgggtgtagatttgtcttaacatggcagagttgatatcatgggaagagcaatagggaaggaaccattagacctggatttagtgacaaatctgatgtgtgaccttaagcctcataagcctttcttaatcttagtcattccaatagtaaatgaaggaggttggatgagagtagcagtgagaaaatcatttattactaatgaaagtagaagaactgaagtttgctaatgattttctttttatattaaattgaagacaatttatgcattttgattgctttttcagtgggtgaatcgggggtgaagttatagtagattgggtgggggttgggcacagtcctaggtatttgcacaaaaattgtgctggaaagtgaatatcaactttaacagcacttgtttttgtcttatttcctgaggcagaacagtggttcaaacccatttgatccttagggcctttgcagctttaggtttccgtaactctttctggatgctcactgctcttatgtgaagtagtacttgtctttcatactcacttcccggccagggaggtggctcactcctgtaatctcagcactttgggaggccgaggcaggcgggtcacctgaggtcaggagtttaagaccagcctggctaacatggtgaaaccccgtctctactaataatacaaaaaaattagctgggtgtggtgatgaacacctgtaatcccagctactcaggaggctgaggcaggagaatctcttgaatccaggaggcggggttgcagtgaaccgagatcatgccattgcactccagcctcggccacaagagtgaaactccatctcaaaaaaaaaaaaaaaaaaaattactcacttctcaagccacctctctattacttcttccccaaacatcctcagaatttctgtcttaggaggaagaccatcttataatgaagccattagtgcttttcctgtgtactagaaaatgggctaaggtctttgcatcttttactcattccatcctctccacaaccatagccctattattcttattttacaaagaagaaaactggggcttagagatgtgaagtcacttgtccaagatcacacagttaggaagcggtgaaggtaaggattggaatttcgttctgactcctaagccactgcactcaactggtgctcaattaaagatgtgattccaacttctgttttaatctacaaaaaggatagagtcttcgccatctaacttgggtgtcaatggtttctataggccttttgtggctctttatttggttctaaaatgatgtaagacaatctctgctctgtctacttgaaaatattcactaagccaatcattaatgggaaccaagttctagaggaaacttttaatctttttaaagggcagaaccactttcaaacactttaccagcacttccttttacatactagcaattaatgtgcacatcacaggcaaactcttgctaattcattgaatcagagatgaggaacagctgtttaagaactcagaaagagcacttggtttgtgtttgagaatgtacttaaaatttaaaggatagtcttgccttaaaaatattccataaccctgtctcttccatctcctcacttgtctagagtggtagagttctataaatatgcttccacttaaactttctttataaaacaatggagggaagaaataatagatgttttaaaatctcagtttaaactcagctttcctttttttgcctcgagttacgagcctatgagagctgccatgggttgataagtttgaaatggtgaaaattaaactgaataaatgaaagaacccttagtgatttagcttagttctattctcagcaaaatctcagctaaatcactaactggctctaccctcttaggtgagtcacttgtcctttctagtcttccgatgcctcaactttgcatgcaggaggttgcactggattaattcttctctctctctttttttttttttctttccaagacagtcttgcactcttgcccaggttggagtgcagtggtgtgatcttggctcgctgcaacctccaccccccaggtataagcaattctcctgcctcagcctcctgagtagctgggattacaggcacgcaccaccacgctgggctaatttttgtgtttttagtagagacggggttttgccaggttggccaggctggtctgagaactcctgacctcatgatctgcctacctcagcctcccaaagtgctgggattacaggcatgagccactgcacctggctagttcttctcaatttggattgcacatttaaaaactgggacatttaaaaattgcctgggtctcacttgtatcccatctccactctcccccgagatatttatttaatggttaagaataaggcctgaccattagaacttttaaaatctcataaggtgattataatttgcaacaagtttaaacaagtttaaaaaccagtgcacttaaacaagttctcaaagtgtggccccagaccaatggcatcagtatcacctgggaactgagaaaggccaggctctcaggccccagtccagcctagtgaatcagaaactctgagtgcagggcctctccaggtaatttggatgctagttaaagtttaatagccactgctctaaattatctccaaggccaggaatctccaaattctctttcactcatgcaactacttgctcaactcacaaatatgtaatgagaacattctatatgccagattctgtactggaaacagtattaggatgactcagaccagtccctttcttgaaggcactcaaacttaagtgctgagctcctacccactttgtaaaagtgccacgtactgtgccaaatcatcagtagtgaggtcgacactcttatgcacaatttgttctttcattcactctccaaatatttctttagtccctactatgtgtcaagcacaagggctagactgaggctttcatcggccttcctcttcgaatcttttgtgtttcaaggagtttattggagatctgggctgggatgggctgggcttcctgacctgaatgttctctgagactgaaaaaagagaaacacatccttccaaatcaacctaccatttcaactcctttatctcttggtaatttgagtcctgaaccccaccacaaatacctctttgtgtgtatatgtgtgtgtatgtgtattttgctgctttcacattttttccatatcaaataaattggctcttatacaagttctatataaagactgttttggagaaaaagaggagagggaaaaaatgctttctttttctttcctgactcaacccattacatgattccctttgacctttgtcttcattttttttctctcaacaaaaatatttattctttctgttatctacactggagatagtttcccaaggtatgacagtgatgaagagagagccttctgtgcttaccccatggaaacttctagtagactgattacttttggccaggaccagaaagaaatgtggaacatctccatctcccttaagtggaaacccctctatcgaatgagaaatgacactatcagaagaaagggtaccagtgccaactctgctacaaactcaccatatgacacaaagacacaccgcatcacctatttggacctcagtttccatatctgtacaatgagaggccaacacattaagcccttctctatgggtagacatagagaaggtgtctggggtaacaggtgattcacatacttttttgtagtaaaaggaattcaatagggattatctgtaagaatcagtacccagaggaaacctcactggctctgtatgccctactgaaatgtggaccacaataatgacaaccatttactaagtatttcctctgctttaagtgccttacaaacacttctgaggtaggtgaaaaagcttaaattcagagagtaattaaactaacctcatacagctagtaatgacatagacaggcctcaaacttaagtctaattccaaattccaccttcctaaccactacccatactacttcctactacaataatgtaaaggcagaattttagagctgagaaatgcatccaatctggccaaagctctaaatatagcaaggggaagacaggcttacaagtcagaggccactagtccacaatcagtccctgtggcccacccttgatgtcttggtgtccaataacacaaattacacagacagttctttatgcttctggctgggaagaaatagcagggaagcatctttttctccacttggctgtcaagtgcttctacactgagcactgtgctccttggcctatatggaatcttcagatttctccaagaagtaaatactctggacaaaactgagaaagcaaagtataaagcaaaccaggaacagtgaacagtagctcactctcatctacttattggtctgtctcattcatccatcacttcatgcaacaaatattcactgggtatctattaggtgctatgcactattttaagaaatggtgatccagtggtgctgaaaactcaaggtgctcacagtctatgggaaaagagagggacaggcaagcagtgtcattgcagtataataatattctgatggaagaaacagaaacacagagtcagaggtttctaacccaaacttggatgaattgaagtctaaacttagaactagaatataaactccccgagggctagatttttttcctgtttttctcctggtgcattccaagcacgtagaacaattatagacacaaggtaagcactgagaaaatgttctttaaatggttctggaatgaagaatgagaaggaatttagcatttgaagagaaatggagaagccaaaatgtagtaagcttgtactatgtgtcaagcactaactagggactttacatagataatctcatttgatctaatcatcccaacaaccccacaatgtaggtggtcctatccccagattatatatagggactggaaactcagagaaggaatgtggattatagtttacagctatcaaggggcaaagctggggtctgtaagtagatctgtcaactccaaagctaatgctcttgatcattcattctctgattgaacaagtatgtttgtttatgcctctgtcttcttaggatcctcagttgagagctagaaatattcttaaaagtcatctctctcaactggcttatttgtgtatcccaatttagtcatctattaattcttctctcacattcagacctgtaaagcttccaacacaatctatatctattttatctcacctccttggcattctcaatataattctttggggaaatgaatagacataaggaaaggagatgtttatatgatctgggtggacattcttgtgagtccaaattttacaaatcagatccaaatttttgcctctgaactccaaatgctttgaatacccatcaattagaaactttagtgcattcattaattcacttgctcagcaagtatttgttgacttccaacatgagcttaactactttctaacctctagggattcaataatgaatacagcaagaaaaactttttgtttcattgattattatcctgtagttgggagagataaaagaagcatgttattatataatatcccagttggaaaagatttagtgatttttagataggtggtcaggaaagtcctctctgatgagatgacatttgaacagaaaccagaagtgtcccccagtaacttataatgaaagctagctgagctgccatccctgggatcccagcctgtttggaatatgaatttcttataacatgatccttagtccttgatcacagtttgtgttgtattatatttaacagtgcttgtggtttttccttcacctggttcatattcttaagtacaaaatttatgacacttaaatgacacaataggggctccatggatacttgttgatcatgtgaagaataagtcagcagtagcacaaagtgggctctaagaagatgcgtctcttgctttcagatcttagttataacattgatatgtaatgtcatattaagcctcagaggatttggaaagtttaccccaaatcagggtcaggtgaaggcacaggtggctcttacatgctgtttctatggctcttgagctgagtcaccactttctttcttcctttttttttcctaagcctcatttctttttatagctctttccgtttctcaccttgtcatccatcctttgttcttgtatgtattaatttattcattcattcatccatcaactagtgaaaatctaatataatccatgttaagtaatacttgtcccatttaacaaatatttattaaatatctattctgtgctacgaatgcagccctgattaatacagacatgatctctggcctcatgagcacatggttctaaatgaaaaatattatactgcagcatgaaaagtgttatggtgtgaggagcacggggggcaggggggctgtgagaaaacatgggaagggtgtctaactgagcttgaataggtaaggagggcttcttggaagaagtgacatgtaagctgagacttgaaggatgcataacagctgatcattgaagaagttcaccacagttcaaatggttgaaactaagtggatgttcagccaagattgataaatgaatgaaagaataaatgaagggaggaaggaacaagcatactgcatgtcagaagggcatactcaaccacagatcaaatgtacagctttgagatggaaattgtattaatttgggatatctatctacttcaattcttagatatacttcaatctttttagctgctgtacagtatcccacagtatgaatgtgctgcaggtaatttagccatacccttaatggtgggcatttaggtcacttcacacatttttctgctgcaagcaaatgttgcagtgagcattctcgtacaaacatccttgcaggcacatacatgcaagcattttgctagggtgaatactgagaaattgccggtgataagctatgggcctttttcattttaatggacacaactatgacattctgggcaggtgaactagcttccaccccactagcagtgtgtgccaagacctgctattttgtatcatgactgcttattatttggcataatgaaagtgttttttctttgcacttttttacccactttgatgggaaaaatatgacttctcattgacatttctgttatgtgctcttaagtaagcatctactcaaatacatttactggataattgcatttcctgttctatgacttgtctattcatatccttaagatgggcctcatctttaatctccttcacacctctatttctcattcgttaaattgggatttcaatgtcagccctattgcatgtccattaatgttatcagaatccagggtgaaataggaagttaagagggaaatagcatttatgcagaagttactctgattcttcttttatgtattgatatatttatcaaatgctgatttagtacaatccctgtgctaagaaccatgacacattctgaagatacaataggtaacaaaaaccagcccggtttctgctctcagcagggcttaaatttagtcactgtgttaaccatcttcacattgctaatatgatttgtagcatttactactggtagcactaacattactgctaacaataactaccatctagtgaaaacttcatatatgctcagtacttttttataagtctaccaatggtgtttaggtattagcatgcctgacttcttagatggagaagctcagactataagagataaggtcattgatttaaggtcccccagttaatagatgctaaagccaagttttatatccctttgcctgaccccaaagggtgtgcctggcaagatacagagcacagtcattgtcataatgactgacaaaggacaagatggtatcttgatcgatggagaaaatgaatactaaaattagatcttcttatttccaaaagcaatagaataaacaccaaagagaggagaaagcaaaatttttttattgtttttttgaacatttaagcagatgaggaggaggaggcttaggaagtgtggacatggccaaaccagcatgatttccagtaacctgttgctgaaatgcatgattcaggctggaccccttcctgagcagggccttctcccacgcctgcccagcatggttttgcctacattctgatgtcccacccaccagaagagatgagcagcatcagtatagagagttgtttttccaagcccagaatgaataccactgctcttagctcaggccaggggagcacatagtcagcacaatctcactctggttctggaaaccaggcattatccacctatgactccctctcatcagtcttggccaagtatttctcagaatgaaatatgggttctgggaatattaggataagcaaaagggcttaacaaaatcaactgatctccagggtcattaacagccatagaagtgctatctccaagtgccttctcaattttgaaagggtgaagggctcctgtttggtgctaataccaccaaaattgcttatataaacttttatagattactctaatgcactactaaactttgtagtaagtgaaccattataggttctcttctacagatgggcaaactgagacccatagaagttaaaaattgaaccgatagttccattgataaatttattcatttgtttgtttctacatttattcactcgtgcatttaataggagtgcctactgcatgtcaatctttgtactgggagtgtaactctgaatcttataatctggtaggagagctgaataatagtacacacaaaattataattacaaactgaagagtattatttcaagaggttataatagagtatacatcccccttaaattaagagagagtctgtagaagatgagtaaagagataagaaggagccagactattataaaaagataaaaaataacagatgttggtaagggtgtggagaaaagggaacccttatacacttctgatgaaaatgtaaattagtacaacctctatggaaaagagcatggagatttttcaaagaactacaaatagaactactgtttgatccagcaatcccactcctgggtatctacccaaaagaagataaatcattagaaagatacctgcacccatatgtttatcacagcactgttcacaattgcaaagatatggaatcaacctaagcatccatcaatggatgatgggataaagaaaacgaggtatatgtacacaatggaatgttactcagccattaaaaggagtggaatcttgtcgtttgaagcagcatgggtggcactggaggctattatcttaagtaaaacatctcagacatagacaaatacctcatattctcacttagaagtgggagctaaataatgtgtacacatagacatagagtatggagtgacagacaatatggacactcagaagggtgggggaatggaagggggtggatgatgggcaattacttaaggggcacaatgtacattattcagaccgtagataccccccaaaccctgaattcactctgccatctatgcatgtaataaaattatatttgtaccccataaatttatacaaataaaaaaagaaggggccagattatgaagagtttgtggctcatgttgagtttagatttattcattatgaaatagagggactaaaccaatcaggtctgagattttacaatactgccctggtattctgtgaagaaaggattgaggaagggtgagtgaatccatttagggttgactgctgaagtccaaaccaaagatgatgattatttgcatagaaaagtgaatgaattggaggtatgttttaaaggtagaaccaacaggacttggtgatagattggattcaagcagtttagtaagaagtagctgtttaatgattctccaacttctggtttgaatatctggaatgagggaaacgttatttcctgaaatagaggaatatattttaatttattgttttgttgggcatggggtagatcaagagttcagtcttagacatattgtgtttgagactcccatgagtcgtaagagaggaaatgctaagaaggctgttaaacacgtaggactgaaattgctcatggctgaactggaactattgccacccatgtctacttacaacatggtaagaaacctctccgcaaagtaacagaatctttttccataaccataaaattactatctcatccaccatattttctatcccacttatctttcagaatcattaaaaataatctgctcaatcctgatgccatccaaatagaaagaaagcaatattctatatggaaaattgtgtgtagttaacataacccttcctggtttagaatgattttaaaaggctttgagaaggtgttttaaatgtgtatttgaatgaattatccaaaatgcattaggcctgttccccatataatgataggaaaaatgtaataggtctttacaatggacctgacacacttcccattaatatataatctcaaacagatatcctaatgtcctcaacagatttttcccccattctataaaagatgctcagataaactatgtaacgggcccacatacacccagctggtaaaataatgggtttgatgactctaagctaggactatttgtgttattatacaagtgtaataattatatccatcatttattggctatgtacaaggcattgtgctaagtgctttaaaaaatttttcttatttaatccttttaaaaaattctttgagcttttattattagttccactttacagctgagaaaactaatgtttaaggacattaagaaacttccctctggaagagttagaggtgagattcttagccacttcaaccttgtgcctcttataaacatgcatgaataaacttgagtggaaagaaacttcctggcatgcaagactattggttagaattgagatgtttctcctcagaaatgatcagagtctagacattgaagtcaagtttgctaaaaagcaaggttatagatagaaaagaaaatgaaggccaaatgcggtggctcatgcctgtaatcccaacaatttgggaggctgaggtgggaggactgcttgagccaaagagttcaagaccagcctggacagcatagaaagaccccatcttgacaaaataacaataataataatttagtcaggtatagtgatgtgcacctgtggttccagttactcaggagggtgagggaggaggatcacttgaggctgggagggaaaggctgcagtggtgagccatgattgtaccactgcactccagcttgggcaacagagtgagaccctgtctccaagaataaaaaaaagagagagagaaaataaatgttgttaccttggggaaggagatgatgggtcttgatcatccagctgcaccacattgatagaggaaatgtgtctatatctctcagcagaaaaacaaacagagcaattgttatatgtccaaatatttctatagatgtctatggattaatagtttcatgacatattaatatcaattctgagagggaaaaagaggtctgtgtgtatgcaaggaatgctagtttcaactctattcaggaggtcttgttctgcagaacttcacagaacatgctacttttccttttaattgtgaggctcccagaggttgctgaaatgctttatgtagtctattctgacattgtttgaaaaaggtaccctgttttcttatcacatatcatatgactagcgttactgaggaagctcctttggaaaatgatgagttagtgaaatcaggttgcaatgtgtgtcctggtgtcacctactactttgttattttctgttcactctgggggtaggtaggatggactagacttggttgtgctgctccaattcctgatttttaagaaaacaaataaatgaagaggaaagagaaggaaaataacagctgtcagagcaattacagatgtgagaagaatggaggaatttatctcacactgggcattggcaagaggaatggacaaaatctattcagtctgtgcttggagacactgagaatcatgagggcaggtcttggtgggtttatgttgtgtctgttaaaacacaacctcagacaccactttagagatgctgaatttggaatcaagagatctgactcccacaccagcaccagccttgctgtggaacagctttcttccattgtttaagcttaagttccttcccttggacaaagtgggtgactgtccatatagtctaacaaggagtggtgggaaaaactgataagataatagacttgcaagaacatgatgcaatctagtgaactgtaaagatttaaatgttcatgattctttctattgtttgatttttcactacgcttgttcttggccagagccatgatagagagtatgtgtaaaaggcaaacactctgacacatacagacacacacacatcaagcagtttcccgtaaactctaccaggagttgctatgcttcagtgttgggttagaagaaggaaaagataaattgtactttaacctttgtaactgagctaaagaaaaaataagagagaaaacacaccatgtgctggccctggatcaggagacctggattctagtactggtatcctgaaattttgttgtgtccttgatcaggtgggtccccaactgtgggcccaagacccctgtctataaaataaaggggtaggtcatagctctgaaattctgttcagattatcctttagctctcacctgcactcagtgcatctaattaagtaaagacggaggcagcaggttacatgtcatgttgttagtaagtctgaactttgagtttgggggctggccatctagatctaaagaaagcctccaggcacagtgggactctcaggactccacctagacccagcctctctcttaggacttacaaagctcttcctttgagacaatttcaaaatgttttggtgcatttttcctggatggcattttaacttgacactgagatattagaggtgggggctgtgtaatatctgccatgttattctctacccctagcttcttgtgcaaggccagacatcatgtagatggtcaataaatacagataaataaatgcatgcatgcatgaataaatggatcagtaaaccctgtggtacatcaataagtggtcagaaaatcatgataatacacatcatatctggtatattgaaggtctttcttttaacttctaaggtggattagttactagaggattgaaaggacaaatgagaatcttacagcatggtcactgctcctcttggggcctcagctctcttatccttaaagcaaaggcattgggccagaaggtgtaattctgtgtttcattcattcaacaggcaattatttagcactgtctgtgtaacaggtcctatagtaggcagtgaagataaaccagtcagtaagggacatactagcctttcaggagcttagtctacttaatgtgaaagtaaacacataaacaagtgatatctaacagtgcaaaagctattatgtaaagggaagcacatgggctaagagctcctcactcagcttcacaggttagtgagaatctcctgaaagaggcagcaactaagccaaggcaagaaaatttagccagggaaggaaagtgagactgcttgctcagggtggtggctgagggtaaaatttcaagaagagagtttgagcaaagaggccagagaagttgacaggggttagatcatgatgatcccagagttcattgctgtaaggtctggacttcatcctgagagtggtgatgagccattgagtgtctgtaaggtaagagaagatcttcattagatttggttttaggacatctttttggctgtgtgtgtatgtctggatagaagtaaggatggaggcatagatcaaaatggtaaacgaggaaaagcaatgttgccaaaactgaagtagatgatggcacttgtctatggtggtcaagtggaaatgcagagcaccgggtggggctgagggatattaatgggataaaatacttggaaaactaatcaaaaggaggaggcaggtgagtgtgttatgaaagatgcctgtgttactggcatcactgaaacacacaatgaatgcagctatagaggcatatttgggttgggatgaaacaaggagaaggagttcaaaagtgccttccagttgctggcctgtgaatcagaggcaggcatacagggcagttcaccttcagccacaacatttctttcctatgcagagatgcaggagcaattgaggcatacatatgcatgtttgtatgcatgtgtgtgtgtgcatgtacatgcatgcatgagtacctgcatatgtgtgtgtgtgtgtgtgtgtgtgtgtgtgtgtgtgtgtttggagcaggcaaacaaagacctgtgagaccacctgttttcatcatctgctgattctcaaagtgtagtccaatgttctaaagaggtcccatggggtatcgggggttaatcttccatagaactaatacctataacgttacaaggctcaggctttgttttctacccaggattaatcattcactcatgggctttaatacaagccagacacaacctcactgtgcaaagcaatgccagctccccttccattctgatgctagcttttacattcttgttgtcagagtgggaactaggtttttgccccagtttcagaatcctatgaagtgaaaagtttagaaacttccatccaaggatgttagtcaaaaatgccaggacagctggactcagccattaatttgccatatgacttgcggccatttatttcccatatctgggctttagtatccatcccacaatgagaaacttggagtaagtgatattcaaagtcatccagctctgatttctacatatttgtgtttccttcttgagctaagctctgtgtatacgaagtcagtctccaaaaattttaagcagagaattttgagatgcttgaacttcttactgtctgggaattagactgaaaaactctcagaccaggaaagattattgaagatcatctatgccaggactgacacttgacatatgagagaattgagctgaaagaggaagccacttcttcagagtcacacagccattcaatggcagaacagagaattgaacttagcgctcctaattcccagtccaggtgtttcttcccctatgtaacagagtgttggacattggccagaccttgggactcacatttgaactcagctccctctgatcatagagaagtctcccttgtttgctgggaatgaaatcttagagagctgacatagtaacgtcatggcagctggtgccggtgatggggttggtataggaaatgagagaacacatttggctaagctcagggttcatgtgaccctccaagagtcttaatttcaaaacaaactcaaccttttaggttcaagttctctctctcatcagaaatgtgacttcctgcttctaagaagcaaggcttacaaaagagctcagaagacttcgtggacatcaaatagctcttacaaaatagcgttttgatgagttaagtgtaaatgaatcagaaacataaggattacattttccccaagtgcacatgggtttcagaattgaggggaaatgtagtttgctaactgcacgctggttttcatggaactcaagccactcctgggaagggtaaggggagagaagaaagagaagcccagtccccaaatggttttagatgtggtgccaaattcgaaaatgctgttgggtttgccctctgccagtaataaaattgctggccacccagagaggccacagggaggagaaaggagatggctttccttactggcccctagtcctccacaactgtgttcagttagtgccgctcaatcaccagctgtcactggggccctccgttggactccctggccctgacttggcctcgattttcacactctgcagcatgcctgtttacctccaactgtatctggtgttttggctcccagagtccttggtgactggtcagcttgtcacaagcccctgctctgtaatcaagtgacctgtccatcaccagtagaatgtttggggaagctgtcacacatcgcctttggttgcattcaggaaaaaaacaagagttctttgtagatcttttcctctctcccttctttaatgctatccaggtgtggagtttcctccaaactgttaaatgtcttcccttcaaatctcagtctgacacaaattaccagttaaatctcaggaccgctgttacctcgtcccgggattcgaagctctggatcttttataatttccacattgtccctccattctttcccttctattttgttttattgcaccaagaaagtagaaaatcatttcaattggtggtaaaagatgattaaaacaaaataacaaaggccttggctgcaaactgttagttttattaaattggctactgtgttttaaattagtaccagggcaaatctttggacaattatatcaaagattgctggaattaatcagtcacatgtacacaattgctcctttcagagccttgtacagagtaaggatgtcgttgccagtaggaaaagaatgagttttgcattacctgtgtgagagggatggaccctagccccattgagaaggaatccaaatgcccaatggagtctcagatctctgtcatctcatttttcatttatttaatccagacaatgggttggagctcacagtgaccaccaggagaaataagaaaatggatgttacagggcaaaaggccattttcccaaagattttttcttggcactgagtcctcagcatgacagctttgctttaataagggggcacctgaagtggaagggctgcagtctactgagtagctgggtccagaaagagggaagatgggtgtggtgggatcccaggctatacaaagactggaggcagattcagtatctcaactacccttagcacatctaagttctgacttctacagctggagataggctggaggcttggagaattattgcattcagttccttgcgtttacaacagtgattctccgtcacttgatgattcaagccccaacatctcacctcagagcctcctgccatctactgctcactccacccaaccattttagcgaaacgtttccacttcctttggtataccgtgaatttcagtctaaatgaactgttcttaatctagaaaaatttacctctgtcttgttttatgctgtttctactgctcagagcactatacttatcactcacattttttgatatgtgtgctttctcaaactattaattcattcaacagatattgctgagaacttattctgtgctaggcactgcaccaggcacagagatacagcaaggaagggctaatattctctgtccttgaagcacttaacatacaccaaggtagtcaggcattcaacatgtgattgcaaaatgtgtgctcacttttgtaataaagtatgggacactaaggatacctgtggaaggaaaccaacataacccagctatcaaaaaaaaaagcctccctaagcctttctcgttctttaaaccactatttggtcttcctctgctagcactctccaaactctactttgtgttacaatcacactctacttggtttatcctctcttttgccctttgaactgtttgaaaccaatggcagtatcttcttcatctttgagtcctccattttgactgagcttcatacatttttttaaaaaattgaacaataaaagtgatgtccagagaaaaatagctgattgggccacaatcacaacaaaaactaataaaacagtagccatttttttctgatacttggtccacagtcagtatgttaaactatctttcaaaacatttcttcccaagggcatacaatactttctgtctcagatccttaccaaccacccctcaccaccaataaaaagtgagaccaaagtacctctcagtcaacagaaataaaaggtttccttaaaaattcagagtaatactcagacaaaattggaattaaggcatacatagtcatcactcagtggaaaaaactgtgtgtatataactttaatatgtgaatattaagaaataaattcttttgagaagactaatcacagctccaacgccattcagtaaagaaggacattttgtaagttttagttattgttaaataaaatagaatataaaaatatctagcatactaccaaaattttctaggtactcaatttattccatcctacagggaatatttggtctctttgccttcaggtactgccttttcaactttccttccaaactcattatctatactgctacctaaatggtcttccaccaaacaagtatgatgatgtcatttgctgggaaagccagtcctttcctctttctcctgatgacttctgactttctccagtcaagccagtatacctccttgggaaattttctcactccctccccatcatcaagggtaagaaaccaaccctctgtgctcctacagcccctacattttttaggctgttttaaagcctcaattttaatgttgtctcttccttgccatccaatgagcatcctaaaagcaggaccataatgtgttcatctttgcatcccagaaaccagtgaaggctatttcgttggataagtgtaagcatacctaaaacaatacaaatatatttattcagaaattttaaaaaataatcaaaccataaatataatcagctagcattaagctactatctgggtttacttgtcagtctttcttcatgaacactaaatatgaaatgatattacaaatttgtgatcttatatttatacaaaataatgtgtgtatgtgtgtttacacgtagaaagatactgaaagggccgggcgcggtggctcacacctgtaatcccagcactttgggaggccagggtgggcggatcacaaggtcaggagatcgagaccatcccggctaatacggtgaaaccccatctctactaaaaatacaaaaaattagccgggcgtggtggtgggcgcctgtaatcccagctactcaggaagctgaggcaggagaatggcgtgaacctgggaggcggagcttgcagtgagccaagactgcaccactgcactccagcctgggtgacagagcaagactccgtctcaaaaaaaaaaaaaaaaaaaaagagagaaagaaagacactgaaaggatcctgaccaaaacgttcctggtagctgtctcaggataatggaatttgagattattctactttaattctttcatatagccttctaatttgctataataagcatggatgatttttattttggggagaaaaaagcaattgagattatatactgtcacttcccagtctttttttaaaagtcagcttccattctaaagatatgtttgcgttgaaacgattgttctctacctttctacatttaaaaaatatataatataatatactctgagtttcaccttcctaaaatactttagaaccataaagggaagcttgttttatcttcaaatagtttttgtggtctgtattttactggatattactatatggctcactagggtgtgcccatccaaaaagtcagctcaatgtcttggaaagataaagggttctagagtcaaacagcatggtttaaatcttgttttataattgttacatctctgacattgagcagatgactgaactacattgaatcgcaactaaaaaattcaaataatttctgcctttcaggtttatattagaaatagtatggaaaatttggtaaagtaactaaactaaaaacttttccaatatgagcatccattggatattctagataaaatattacagatataactagcatcctttaaaatgcctgattgagattagaaaaacagaaaaggatatttccaggggcaagacatgcaagaaataaaatagaactgggaactaaacaggtaaaccctggatctaaatttgtggttggtatagtttggataagggagagccatcagttttggcaattgagtggcttgaatattcttgttcaccccaggagagatgtggctttgcaactctgcaaggtagtgtattgggactaacacttttaaaataaggattttaaatgagattttcaggacccctgaaacgacccctgaaaatctacatgtttggtgaaagggtgtactagggaaaaaatatgtatatgcatatgtctagctacctaccttaataccatgataattaacatgatttgatttaactgtcatcttactatctttgcctaggatctaagtggaaatttataaccattgtcttatacctcaaaagacttgatgtttgaatttatactgctcagtatggtgtgaaaatgcctgagctgaaaaattaagtgaaaaaaaaaaaaagattccaggttagtgatgttgcagggatacctagaaattaacgtaaaatcgctctgagggaggacatggacttgacccagggagcacatgattcccacagattaaaacccactgaatctgaaaattaaaaacatgaaaaaagtaaacaaggcatcaaaataagggtcagtaaacaacctaagggctttttactaaattttgactttggtgagaagtatacaaattagtattttagaataaacagaatgcaataacaacaaaaaataaataaaactagaaagtacaattttcacagttaagatgaacaaagaagagacaaataatggaaatttaaaaattcgataaatccaagtgaagggaagaaaggaggaaaggaataaataagcaaggaaaaaatggaaacataagtcattatactaatcagattaaagccaattggatgaagatagagcttctctagtcagatttaactcaagagttttgctgaaaggttaaaggtaaaggtggggacaatatttaccaggtaaatgctaactaaataaattaatatagttttcagactaaggaaacatttggcaaatatgttactgtgatttaaaaaaagaagtcaccacataatgataaaaggaagatattatgatttacaacctgaatttatgaaataatatgacctgaaaatatataagtcaatgacttttacctaaaaaaagataaatgcatgacattgtgatattttaacacatttttctcaataatttatagatcaagcaaactaaaatatagtaataatctagaagatcttgaacaacacaaaaaagtttgagctgataaaaatgtatagaaccctgatacagaactaaattatgaatatttccttcttgaatagagatgtagactattttttaaagttttttttttaccatgtactaggccacaaaacaaatttaaacaaatatcaaagtatcagtatcagatagaacataagctctgtccacaatgcagcacattaacaaacaaaacacaaataaacaaatgaaaaaggtaaaacttttcaatcaatggaatttctaacaagcgaaaatcttatatatttgccaacagaattcagcaatgtattaaaaaccacatataatgttaaagaggtgactttaatattaggtggtctattaatgtaattcacaatatttgtgaattaaataatttttaaaacaggaatttttactagatgtagtttttaaaaccctgtaaaatcagattccttcatgatgaaaaaattatagtaaactgggaataagtacaatgtaaaaagttttttgatcacagggtcatcttcagaatgcccagttttgccattggtctcctacctagcgcagctggacaaaaaataaaaacaaaaggctgggcacggtggctcaagcctgtaatcccagtgctttgggaggccaaggcgggtggatcatgaggtcaggagatcgagaccatcctggctagagacggtgaaaccccgtctctattaaaaatacaaaaaaattagtggggcatggtggcgggcgcctgtagtcccagctactcgggaggctgaggcaggagaatggcgtgaaccccagacgcggagcttgcagtgagccgagatcgcgccactgcactccagcctgggcgacagagcgagactccgtctcaaaaaacaaaaaaagtctgaggattgaaaaggaaacgacaaaactaacattattcttcatctactggaaacaatatagaaaaattactaagaatcaacaattactagaacaaataaaacagtctatgaggacttctaaatataatataaatttatataaaactcaattatttttattatccccaaactattagaatacaaataaacctacacgtaattatgtgtatgtgtgtgtgtgtgtaaatagctagataaaaagctactatttactgtaggactgacacctataaaatgcttagagtaaggcatatattgctaataaaaaatcatcaccatttttataatgaaagctttaaaactttactgaaactataaaagaagacctaaataagtaaaaagataaactgtgtgcataaatgggggaagacacagtatcataaaaatgccctttctcctcaaatacactgatacattcaatgaaattggaatcaaaatcccaacaggcatttgtaaggagaaagcttcacatggaatttcacatggaagagcaaggggcccttttgaaaaggaaaactatagaatgaacttataatgtaaatcaagacttttatgttgctgtggaaatcgctatagactgctaccgataaaacagtagataaaaaatagaccaatgaggctgggtggcatggctcatgcctgtaatcccagcactttgagaggccaaggcaggcagatcgcctgaggttgggagtttgataccagcctgacgaacatggagaaaccctgtctctattaaaaatacaaaattagccaggcgtggtggcgcatgcctgtaatcccagctactgggaaggctgaggcaggagaatcccttgaacccgggaggcggaggttgaggtgagccgagatcgcaccattgcactccagcctgggcaacaagagcaaaaatagaccgatgaaacaagataaccccgaaaaaaaaaattatgaaagtactgaaatgatatatggcaaaggcagtattacaattcagtagtgaaaggattaactgttatcttaaagagattaactagtgctggacaaataattttaatacatatttggggggaaaaacaatccttatttcacatcatttaaaaaactatactgtgggccagacatggtggcttacgcctgtaatcccaacactttgggaggccaaggcaggtggatcacctgaggtcaggggttcgaaagcagcctggccaacatggtaaaaccccatctctactaaaaatataaaattcgccaggcatggtggcacatgcctgtaatcccagctacttgggaggctgaggcaggggaattgcttgaacatgggagacagaggttgcagtaagccaagattgctccactgcactccagcctggacaacaataatgaaactccgtctaaaaaataataatagtaaataataataataataataaaaacctatattgtaggtgcttgaaaccatataggtaacaaacaaaaccttaaaattattgaaaggaaataaaagagactattttatgatcttagattaaaggaatgtttattcaacaacatacgaaaaacacaaatcatgaaggatacaaaattctcttatcaacaaagcagcataaacataatgaaaaattaggagtcatagaccatgaaatggtatttacaatggctttaattataaagaattaatatccagtatatgtaaatatacttatgtattaatatagaaaaacaaaacttaatttaaaataggcaaaaagatgaacaaacaatatgcatgactagaaacctacttgatccacaaacatgtgaaaagatactcaggcttgttagtaatcagggaaaggcaaaataaaacaataattaagtatcatttagtaaccatcagattgaccaaaaaaaattacatatttggcagaatcaagtgctgacaaggaccagcactttgggaatgggaagcctttgtgcagatgtgttaattgatacaatcattttggtaaatactttggcaatatctaatagttgaagatgcaattatcttaacctaatgataccattttagccttttttccctcagaaaactcttgctatgtgcacagaggaaaagaacacaaatatttcaagtaacattgtaaataataaacacagtgattaaataacaataatagcaataataaaagaaccaacctaggtatctatcaagaaaagaatggccaaataaattatgatatattcatatggtaaaatatttatgttagtgaaaataaatacgccagatctacttgtagcaatatgtgtgatctcaaacaatgctaaggaaaaaagaaaaacagccagctacaaaataagtatagtattgaaacatctatgaaatttaaaatatgtaaaacaatacactgtgcaaaaagtgtaaaaatgtgcatgggaaggaaatgagatacaggaggagcatacaggtgggtttaaacttgatcagtatttattcctttcacaccaaaaacaaaagatatgaagaaaatatggcacaatgttataatttgacaaagctgtatagtaagcctatgaaaatttgttatagtatagtctgtacttttctatataagtgaagtattttctaattaaaacaataataatagcatgtatagtctttggcacatcatctcaggctcaaaaagtgaatgtttccttcccttcccattcttggctggagggttatatacaaagtgcccagacattaccctctggttcttagctcaaggctacactggaatacttggactcttcctgagccaaagtcatcctaggtggtcccatcttacatcttctaactcagacaatctgggtggtaggtccagacctacacacgttctcagtgcagaattttaaatgctgaagcagtttctagcctatggaaaagctcaagacataaggatacaacacaacactcctccttaaattagacccatggattgcagaactaatcatcacatccttcccagattcttctttcatagttaaaaaaaaaatgggtggacagaaagaggaaatggcttgtccatggtcaatgagtcaacggtagtatttcatagggaaatactatgaaattaatacagaaaaacaaagatttggaagtcatgaaacacaaattccaaatctttcaactggtctttgtatgtaaggtctttgtgatccaaaacaaagtcttttgatttctattctgctgtactttgagaaagcttggggcttctgtctttggaaagcactgtcttggaatggagttagacagaactggttcaaatccctactccatgacaaaaatattgtgactatcggcaagtagcttaatcttcctaagtgttagtttcctcatctcacaaggaggataattattcgagggattgttcttttggttgagactgtaaatacaaaatatgatacgtagtgcgtagcatataataagtaggcaacacatagaaactatgatagctgtttttattccagaggatgaagttttaaagaaatataacacagtttagttatagagactatttgaagagatagacaatgataaacgaatgctatgatatagaaacaataggatcaataatgagtatttaaggagctcagagagagttttctggaagaagcaaaatgtgatgtttccatagggtaatgagcctgtctctccccttcctcctatatgacttttttgtttcttatttgaccttcacagtggtatgggacaagaatcaaacatcctaattaaaagacagaaaaacagacccccgcaaaatcacatgacttgtctacagatttcagataggttttaattgacctatcatattaactacataccaataaactttaatttatgcattttaaatgcatatttaagcttaagtcataaggtgcttaccctccttatgtatatattaatattttagataatgatttcacaacctgtaattaaattttagtgtaagttgtgctctaaattcgatacacatttaccatcagtatgactttctgaggcagaatactgagatcatatcaaccagaaatgccagcatttttgtttctaattatcagaaatacaaccctatggcacatatgccatttgcgatatgtgttaaagaatgacggttaaatgtagaaaaaagtgttttgttttgttttgttttgtttaaaaaaaaaatgcatgagggccaggcacagtggctcatgcctgtaatcccagcactttgggaggccgagtgaggaggctcactggatcccaggtgttctaaaccagcctgcgcaacctgattagaccccatctctacaaaatatattttaaaaattagccactgtggtggtgcatgcctgtagtcccagctactcgggaggctgaggtgggaggattggttgagccagcgagtttgaggctacagtgagagctgtgacttctgcctgggtgacagagcaagactgtcttaaaaaaaaaaaaaaaatcgcaaagattccacagaacaacccttcaaaatagacaaacaacttcatcacatttaaatatattagctacaaacataaaatattcagatgcagactttatgatttactactacggatggttgaagtttaaaaagaaaaaacttaaaatggcattcagaatttgatgtgagaaatcagaagtagccaaaataatcacatctcaggtgatctgctaaaattttagttccaaagaaagagtaaattggaagtttcagcttggtagcaagctgctgtcgctgcactaaatgaaaagattttgagctggacagtggctctaaatttaagaatattctgacgatgttggcaagactggaaacgggatatgcttgaagcaggacattaagccagaggctgctttggccgtcaagattgacatatgggcctcaggagagctgaagaaaggatgacgtggaaactcctgggtggggagaattgagagggcttagggtccatctgaatgtaggaggcacaggaggggaaggagttcaagtgatagcataaggctttccagatggttttaggagcagctgaaaggaacaacttgacaaaaatgtcctacttttagaccaacaatgaaataggttctaacctccagcaaagccttcagaagccactagcttatccttctgaaagaaatctattctacctaggttcttgagaaaagagccctcatttaacattaactctgacttaaacttgggtaaaatatagttttatcataggaatttttccgtggaaaacataatctttttagtaactgctgtacccatcccactgtccccaccttttaacttaagggagtgacttgggtttttatttttcaatctgaaaacttgggataacaacaccttcctcaaagagctgcttaagcttctggaaaacaatgaaatatgaaccacacacacacagctagaagaaggaaggttattaaggtttctgtactaatcaaatatgatgttagtggataagaaggaggtcggtgggtagacgttacagggacacagatttcgccccagggtaaagagaaaccttctgggatccagaattttcagaagctgaaatgggtcacctggaaagagagcaagctgccaggcactgggggtgttccagccaagtgaagtagtagaaaagatattttcatcaagccacggcacacatggtagatgatggctgcatcttcacgggtttgcctcaccaaggttacattacttatttgtctctccatctcttctagtaaggggaccatagcataaattcagtggacaggaatgttgataattaaccattaattgtaatggattaacatttattaaatgttcgtcataggctgggcccatatgtgctttataattgttctcatgcttcatctgcagataaatgctgtgaagccaggtttatgactgatttgaaataggctcagaaaggtaaaacaccggcccatgacttcctggctaataagtgaggcagccaggacagaaacacatgttttcttgtctctgtgttgatatttattgaggaaaaggaggaggaagagacgcgacgagaggacaaagtggagagaggagcaaaacattcacaaatattagccaaccaccttaaatatcatcagccgcaaatcactcgtgacacatgccagaagtgaaaaacacaatgtagagaagtacttttcatactcacccttttccagagaactacccccatctacttagacaatgactggatagccccagtggactgggatgtagtctgaagaaaatttcttattttatatcacaatgtggccgtttaaaaaatataaagcatgcctctgtattttagaaaaaaatgaacgcataatacaaggcatgtcatatttatcatgtaactttgtgtatcccctgggattgttacttttttctccaccccactccagttttagaattatcaccaggtgaagtatatgctcattagtctagatgtggataaagtagccaataagctaaatgaaatcataaaccctataattctatcaacaaattaggattcgaggtttacaaaacaaccatcactcatgcataaaaatctctcaagatattggtatgtccacctatttcatcttcattggcagagcactaaatctccagggatttttggtctacccacaatattagcagttccagtgctgctaaaacaaactccctttggggtaatacatccaacattctcaggaaagttgtgttctttcccagagtccttcaatgctcataaactccagctcattattgtgttgagagtctgaagacattctctgtccattgcccctgcacctgttatcttgttggccttaaccaaacagcccaagtcctaacagcagctgaaataacagacgggcaggagaacttgagattttttgacatcatccttttgtttatgaaatcccccccaatgctggaatctgacaggaattctcttcattatcattttgtgttttttcccatggtactttgttgttattaaaaaattattactaaaaataattgatgcagaggtagatgaaagataggaataacatcttcatttgaaaattgtcaaaaaggacatagggagggggatgtggtcgtgtggaattgacataaacatatatttgccttggaggataattggcagtagctgtgttcatttggtggtgtgtttgtgaggaagcccaagcaggtactaggaggtctttaggtcagaggagagatgcagtctaggcaagttggaaatctggcaggaagcagtccttggaattgcgattcccaggacatgacccaactttgcaaggggtgaggttattaaaacagacctaaaatagggataagataggcagaatataggatatcacttaatagcatatgattgtaagcaagttgctttaccttcctatgcctcagattcaccatctgtaaaatcaacatgtaaatactagcagccatgtagggatgttttgtttctcaaataagaaattcatgaaaagtgtttagcctaaggccctatattctattaatggatgctgctattattattattattttgtcgagagtgaaagaaatagggagaagcaagtggcagggaggcagagagccactgtacacacagcatcagaaaagggtttgctcacgtgtaatggagtttctgctcaggtcttaaaatgaggaaacatgatcagataatgccctaagaatctgatgtggtgctttcccacctctgtgcttttgtttatatttatttttcctggatggcttcctcacaaacgtcttcatttttagtcatttgccatctgatacttttccaacagggttgctgtataggttaaattaaagaaaaaaacaacacctagtaagtacatagttatcagtcaattgatgctggttattactgtacattttagtgtagtccattatacttagctaactgatgtagccatagtggacaatagaaagtattggatagctaaatgtgcatttgatttcaaaaatgagcaagactgatagaacctactccaggggatcaattttccattctctctttgtctgcccagtattgtaattgtataattatgtcttctttgtattttccagggatctaaatcttggcagtgtgtaccagtattgggtcataactatttcaggaactgaagagagtgagccatcacctgctgtcacatacatccatggaagtgggtactgtggcgatggcattatacaaaagtaagtagatctaattaaagaaagaagaggagggatgctggttaggtcaagagatggttagggtgctgaacagaagagcttatgacatattcttcagtgcatgagctgtgagctactagtggtccccagcagtctctggattggtctccaaacaatttgctgaactcagaagaaaagcaatgactctttttgaacacgtacattttgcgactatgtaatacaatatatgatttagacagaactacccttatgtacctactaccatttgctcttgctctcagttgctttatgtgtgctacaaggattccattagatttttccctcacagtcacagcgtacattcagttaacaggacacagttcatctaggttaaaacacttttaagttctttgctggttaccattcacatttatgaaaactgcatatttatttgttatctctattgtatcatattatacaacaatttacaaaatgggtcaaaggcttataaaaacagtggagtattttaactcactacaatgtttaaaccataaataataaacagtgctctggagtgaatattgaatgtgaatatgagtacactgaggcaaatgaagcatcatttgtgggtccaatcagtaagtgtggattttatcagattatcaacccattcatcttcctgttctcaggacaagatgctatgcaactggcaaacaggggtgaggagccaccaagacttttgcattgtttaaaactcaataaataaacttttaagtgcttttcctccagaataagaaaaaaagttttctagtacaaaatagagaattttgtctctagaggtggaaaagagaccaataattattcaaaattaaatctcttattgctaaaattatgttcctcattgctaaaatgtttatttgcaagtcacactattgctaagagactttttaaactattgacagatttaatgataaacattacatgtggagaaggcaaaacaagctattggcaaaattccttcattaaatagcactgttgggtgtcacataatatctgtgcaatatggaattgcaattactatttctataaggggaggggtggtatgaaaaaagaatttgcttcacagttggatgaaaccactgatgtgtagaacatgaatcaactcgtaggagtagtacatatatgaaagagacacattagatgactctttctttctgttcatcactaacactaagctagaggggaagaacaatttaatttgtttctgatgattttgtggtatggaatgtaaactggaaacctctgctttaggatgaaaggaccagctaggaatacagcaaggatgatgcagtaatgcaagtgaaaagagctggcatataaatactcatccacatagacatcagttatttgccagcagtgttctttctgaacatgatttaacattaaaggcaatagaaatattgcaaacatgatcagatgattggtaaattatatcttttaaacttgctgtgtaacaagatagtagcatgtacaagattctgttcctctttgctccccactccacaactaaagtttgccaactgttaatgaaaagataccaactcaagtttttaaaataagaaatggcggccgggtgcggtggctcacgcctgtaatcccagcactttgggaggccgaggcgggtggatcatgaggtcaggagatcgagaccatcctggctaacaaggtgaaaccccgtctctactaaaaaaatacaaaaaattagccgggcgcggtggcgggcgcctgtagtcccagctactcgggaggctgaggcagaagaatggcgtgaacccgggaagcggagcttgcagtgagccgagattgcgccactgcagtctgcagtccggcctgggcgacagagcgagactccgtctcaaaaaaaaaaaaaaaaaaaaaaaaaaaagaaatggcattaaaaaaatattggcactgatgaggcaagtaattatttgcataatctcaagtggctttctgaagcaggaacatagcaggaacatatatgtatatttatctatatatttccggatcatatgtttatttcttaaatgtcctacacctaaaattttatatctgaattgtcaaaatgtttaagattgaagagattagtgtaagggtttataactgttgcattatggtgcaaatcagctgattgccaagaatttgactcctcaagcacagaatagaaagctcctcacttgtttgagctatttaacatacaatgctgtatgtatttaagatccacattcatatgaagcaacagaacaagaagatacagtttccaatgcagtaaaattggggaaagggaaacttctcactgttctctcccacattaatacatcaaattccagcttttgataaagttgctgtctgatggaacattgaacaactaaacagaggactctccatggagaaagtaccccatcatttgtgggtccaagattgaacttcatatctagactatccagaaaacatttgcagtcactggtgataactcataattgtgatttgggaatttctaatttagcccaattttttttttaagtcatcagatttggagcctcatctacagctcatctcagctcatggtggaaacagatatagatgaattggttaaacactgcaaatgatatcattcttgctgatctaaaactattagtatcataattattattaattttaaatagtatacttaatacagtttttttttagtatttttacctagaattagtatctttcataaacatcaaacacatgttcagttacctgtagatatcaaatatttgttgatatactttgtagaaaactaaatttagcttatggatgtttccctaagtaggggtgggggggtaggggggaaggaaaactttggggaaaagaagggatatcatcttagctaatacgatttttcatggaatgatgcaagttaatttgctctgtctgtaaaataatttatgaagaaatatggatagactcagcactcagtgaggcccttaatggatgagtgctgtcttaaatgatccatagcaacaggttctacatttgatagatcgggtaaaggtgaaggcaatggatgaacgttttgataatgacaataatatttatacacacttcttgagtctctactgtgcatgaagcactgtgctacattattgtctccttgagttctcccacccaacagccatgtgagataggtcttattataatactttacggataaacaatgaatacacaaagagattacagaggttttctcaagcttccacatctggtaagatgtagaaccaatacatgaacagagggcccagattctcatctggattccccattgcattgttgtgtgatgtgacaactctgcaaaactaacaagtaaaggagtggctgcatgctgtctgttatatcctaggcactgtgccagaaactggggtgctaggatgatgaagactctgtcacttcctttggcaaattacagcctcttataaggggctctcaagtaacaggcaaaggcagtcagtttgacaagtgctgtgatagatggagcaagatgtctgtggacacagagaaagatggccacccgctccagccccagaggtcaaataaggtttcgcagaacttctttatctaatgatagatctgtcatgcctagaagatatttgtagtgacccgaatattttgtttaaaccagtagaacactgtttgggtggcgatggaagggaggttgaaagtaagctttgtggcttagggaaccagcccaggtatttttttgtttttaaagtcttttccaaaacaacctatgcattagcttagaagcacaaggtcatcggcaatttccagcaagcaagacccactgccagacaatgctgagaccagctaaaaatacaaacttcttctttgctcataggtgtgcagacaggagaggacttgggtggctccttggagatcaattcaatgccctagccatcttaaggattgattgcaaggcattatcctgctactctgacacctcttaaaagcaacaaacattgcccagtgttaattgcctgggtgaaaggaaaagtctaaggcctcttccatgctgtgacaggtcccagctggtctctggggagggagggacagctgtcacacactctgcagagacctcccaacgcaaagtgggaatggggactgtgattccttgagcatcttctatgtgtcacccactgtgccaaccactttaagctactcagaggcataggactaattatctccattttagcacatgagaaaactgaagttcagcatccacaggagcactgttcaatggatttttctgcaatgatggaaatgtgttctgtgctgtccattacagtagccactagctacatgtggttcctgaatacttgaaatgtggctactatgactgaggattggaattttaattataattcatttcaattaatttaaatgtaaatcatcacagaaatatcagatcaagaggtcaagtgactttgtcaagattatacagttagtttgagacatggggttctaaacccaagtgttttgttttttaaaggatgaccgttttccagaaagcagtaacccatccagactttcaggtgttgttcctccttctcatcacctaagcccaattcaaagatcattgctcattttctgcccatcccaaccctttgcaaaatcatccttaggtggtggaaataattccaacaaaaacaaagggggcattagtatttcataacagtgtagtctcgcagcccttggagttcttgacaccaacaaatgacacacccgatggagaaagcaaaactttccaatggaaggatgactaaacttgaatgcatgaatgaaaaaaaaaaagttacctttaagtatattgggggaataagaaggatatcaaggcagggagtggtgaaggaccagaatctctacattttccttcaaatatgctttttttaagatcagagacaaggaaatgtctgtgagacttcctagacactgtgggagcaagaccatttatttgttcattagttcttccatgtcttactcccatctgacttaactgacttgagatctcagagaatgagttggaatcaggacttctactttgtcatcagaaacacaaagcaaggcaaatgtgaaagtatcttataaatccataccttttagaaatctcattttgaagatgaagaagcagagactcagacagagaaagggatttgtgcaaggtctcactgaaggttcatggcccagggagggacttttccatgtccagccatggttttaagactaaattggcaaatttctcttccatatctgctctgcagagaccaaggtgaacaatgcgacgacatgaataagatcaatggtgatggctgctcccttttctgccgacaagaagtctccttcaattgtattggtacgtctttttcatttcttgtggccttcatgaagaaatgaacggtgcagaatggttggtcaatgataatgccaacaatagttatgactaaatgatgattcactcctttgtattacacctgtttattgagtgcctcctacatgccaggcactgttttcaatatcgggaaatacagcagtgaaaaaacaaacaaacaaagcaatccctcaagagcttaagctctcatagatgatgccaatgacgggtaacttcttttgatcaagctttaccttacaaacatccctgcttttcttcacactaactgtccaggatgggtattactggagatgttttaaggcttttattcctacttcagagataagaaaaaatcaaacgccagaaaaatttcaaaagttgtccagagttatacaggtcaaaagtgattaaagacagaatcaggacttgaacctgattttgtctgattctcaagcacgtgctcaactcattttgctttgcaacctccagccgtgatgcaggaaccaccaaggtcccctctgcagactcagaaccttgggcagtctctctgatctgaggaaggaggaatagcagaccagcctgtgtttagaaagcaaatgtccttttcccaccttcaccgagtcatttgggaaatttgttttcctctgccttctcttggagtctggctgatcttgttgtttcagccccacttgggaggccctggtcagccccgggctggtaaacagacaggggttgggaggggcaggggtggaattttgagctggtccagatgagatcatacttcctttaagatgcaaatcgatacctgaagatcaaaggtcccccagctaatcccctgggctggaggtgaaaactaatcacaattcatttgcaagtacaaaagacagaggtgctctatctgaagagagaaggggcagttacaagcggatgaaaaccttcgtgggaagatttctcactgacaggcaattttctaggactaaagaggaaaagatagcattgcatcctcgcatctgcagtgcattacaggggtgcatttagacattctttctcccagtagattgtgagctccgtgatggtgaagaccatataccatgtgtctcttattcaattctcaacacgcatttgttgagcacctactatcttcttggcacccagtaggggttgagcaacacaatagaagtgctctgtaaatatttatggttggaagataggtagatgccccaggagaaaagacatgggagtttctaggcagggccttgggttttaaattgccaaaaaattttctctcctctgttgatttgaatatggtccggtccctagtaaaagcttgatattagcctagtgatgtggtggaaagaactttggattaaaattaggaaaaccaggttctagtaccaactgtgctgagaacttacataaagctggccaagtggcttccctagtcttggcctcagtttacctactgtaaatttttaaatgattgggttaagtggtcctaactcttaacttaagagccttacctgcacttctgttgtgtgattttttgaggtgggtgactgaattccttctaattgtgaactctacctgagccaaactcttacctttgtcgtcatccttatggcaaccaacactagtcccagaccatgctgaaaaatatctgcctgtttgacttgcactaatgtggcatgtaatttatgtgcttctggaaagaaagtaggatggggtgaaggtaggatatggtaccctgaaagagatgcttgagccttgacattcatctgctgtgttgatttagagctatgcaatgatcaggaaaaataaggacatctctaataggtagaagctcctcatccatggaaggggtctgcaaactatggtccataggccatagccagcctgccccctgtaattgtaaataaagatttattggaacacagtcacactcatttgcatattgactgtggctgctttcatgctacaatgagagttcagtgatgacagcagagattctatgacccaaagaaactaaaatatttattatctggtattttacctgtgaagtttatcaacccttgttccatgaatttgggatattttatatgcttgtttactggagccaggtgcagagagtaggtgaaaattataatgtggttcaccatttcttgttaacaaaaaactgaattttaaacatacagtgtagctgggagtggtggcgggcacccataatcccagctactctggaggctgaagcaggagaatcacttgaacccaggagacggaggttgcagtgagccgagatcatgccattgcattccagcctgggtgacagagcgagaccctgtctcaaaataaaataaaaaagatgagggagtttccaagaggatgagactgagatcctcctagattcattttatagactgttgttctctaccagattctgtgttctgctgctgatggtgatatttgcttaatacttcttatataccaagcacatttataaactcttattctcgtaacaactcttttactgaactgctctttcaaaagaggaaattgaggtatggggtgatgatctaaggatacacagttaaatggtggagctggaatttaaacccagagagcctgactccagagctcactgtggtaagctacctgcaaaaaaaaaaaagatagctcctggtcttgcaggctttcagggtgaatgaaaaaaaaacattgcaaaacaagtcgtatcacaaattaatggaatggaatacaaaaccatcagtgttgtggacagtgtctagggaaggctctctgttacccctgtatgttcagtggaatttgtattacaggaaagccttcagctacgcccttcactggccacttaaaatctcattatagacactcacagagatacaggcatcccagagatcccagctcccagggactacattccaaggacaaatcgtgtagctgaagtctagaaaactatcttcctccgaaaggaacagctgaaaaatagacagtgaatctttactcccagcagaccaatctttaatgagtcagagaagagagacaagtgtgggaggctgtgctgaggttgacattgttcccatgattgcatttgttaagacagtggtcaagataacagtcaggagatcaggcataccatgacttagatgtgtaactttggctaagcctcagtgttctcatgtagaaaatggtaaaagccctagaacccaacagtggaagatattgaccaatatttttggatactttctatcagaatttccttcttagacttaggagataattattctaataaggaagagcccaacgcttagtatagaagttgattatccaagcatctccttctccccgtcttctgggtagcttgagtgtgggtatatacaacctaggctttccctctgccctccagtcagacacaccaacccaagactttgaattggaagctagtagtgattagacttagggatactgtagacaccattttgctgaggatggtgggagtagccacatccataccagcctcctaagtaccagggaaggcatctagcatcaaagctgagctagctatgcacagcaccagctctggatcccctcactaaactagttctgggacctaatcttgggcttggaattgagcttcagagcacgcaagcctggctctccagagagtgttccatacgtaaccaatattctttgaacaaattttgcttgtttgttttgcttaagttatccaaagttggtttttgttgactgtcactcagaatcttgactgaaaattattgccataagataatgtgagatttaaccccatttctagcaagttggatgtgcttgatgcacagatgcacattagctattacttttctctatgtgtgtttgtgtggaatgttgcgggcacaggataccagcaacaaccaccatttatggatacccactaggtgataggttcttcatacgcatctttgttttctgtgaactacgggtcgtctcttgtttccgtatgtgagatctgaggtctcttatgacatcttaacttgcaccaggtcacacagcacacagaggtatgatcctctctccagtctgagtagagaacctggctttttctactctgccactctgcctctccatttgaatgactttcttccttccactgttctttctttgttcttcttttctcttcaccccttcctcttccccctttttcctctcctcctcctcttcttccttcactccttcttctgcctcatattcttctcctttttctccttctcttcctccacctcttctaccttcttgtccttctcctgcttcaatttagaagggctgatgttttctctggcttagtaacaccagcgttagggtgggtgacagatttatggtgacattcccattcacttttcagaagcccacacatccggaagtattcccaaggtgccagtgtgttattatgcaacaccctggggacttcccgttctcaatttcccacccctggtgccctcatcccccagcacataataagttgcttgttaaaatgaacaccacccacatgacctctcaggcaaggcaggcttcatccctttgcaatgtggaagttatcttgtctttttttcccctcttttaaaaatataacatacaccaggcctgaggtttcagtgaaaaaatgtggtatcagtaaaatgataactctccccaacaggcactggctgcaggcattgttcacagcattgggaattctgtctctaaagcattgagtcataaactacagacaggctgctgataaaagctgaaggaggtgggataatagtcaaattagtcagacaaaatgtgaagggtccccaaaaggggttatactgtgtaatatatctttagctggtgctggaaatgtgttaccttctgagatggaatctagtgcattacaggagatgcagctgtggagaagccctcatgctctgttttgactttccaccctgtattcttcagcatagttgggtccagttcccagtttagatctagaggcctcctggctgcagcttagcacctcagagcctcagtttcttcctttgtgaaattagggagactggactgagactctaaagcttcttccctcatctgatactgaggaatctccgatttgtcaaacagctatttaaaggctttaggtttcaaatcctgcctgacgctgatatatagttaagaaaacaaaggaaagggacccccacgtcgtctttcccagacgtggaggcattccctgtgtgtctctttttctccctccctccccactcctcttctctcccctactcctgccattagcatcactctgtgatccctgacacagcatccccagccctgtcctagagccagggccagtaactcaattagcaacccccagccccagctccctcccctcccctgtgagggacatcgaggagaggagaagaatcggtctgcctccccaccagttgctgggaggggcaggggttcaccgagccttgtggcccctctgtcaggctgctctggcctgctctgagccaaggcgagaaaggaaaacaagaagatgaatcgccacgtcttcttggtggaggttccgatgagactttagaacaacagtgactggaaagaaaaacagcatctgctggaggagagggggaagaatgggctctgctgggagttgcatttattattatttttctttctaacaacgtgaaatcataatagatgatccacctctcaccttaaaaaaattaaaattaagaaaacaaaataaaacttctccagactgcatgtattcaatcagacctccctccgtggaaaaagtagtaactttccccagaacacgtttttgaaataaagcttcccttggcttgaaggcaggcctatgaaagaggaaaaagaaagaggaatataggtgggggtcatggtggtagtgattaaggtgacgacgagggtgataatatctcagctaggttggtggcattcttaacactggagtaatgacatagggtatccattgttaagaacacggattctgggtggaaagcctgtccctgacacttagcttgtgtcgcagttttttcaatcataaaatgggttagtaagttcctacttcttagaattattgcaaggaaaaacaagtttatttttgtaaagcatttaaaatggtgacacctgcctgacaagtgttatagatgtgtttgctactgatgctattattgtcataattaatattttattttttattttaattttttattttttgagacagaatctcactctgtcacccagctggggtgcagcagcatgatctggactcactgcaacctccgcctcccaggttcaagtgattctcctacgtcagcctcctgagtagctgggattacaggcgcgtgccaccacacccagctactttttgtagagacagagtttcaccatgtcggacaggctagtctcaaactcctgacctcaggtgatctgcctgccttggcctcccaaagtgctgggattacaggcgtgagccaccgtgcctgactgaatatgattaattcagaagttatatccatcttcccagaaaccctatgagataaataatgttatccccgttttgtagaggaaaaaactgtggttcagagagatttagtaacttgcctacagttacacagagacatagcagacgtgagattcacagcatctaggcagagtctacacattttaaccatgaagttattccatttattagatacccagctgtgccagtttttctgctaagaactctttgtaaaaatgatttcattcaccctcccagcaactctgtagagtcaaaataattgcaccattttgctggtcagaaaattgaggcgttgagaggttaagtgaatatccaaagtcatatagccaggtaggtcagagaaggagacttcagagtttgtctgtctgccctaaagcctatgtccaactccagactaactcttgaaatagccagagagtgtttctcttttccactatttctgtttggtgccattgaatcacagcaggaaacaaaagtgaatgcacatgtccttgtgccattttcatgagtcatgaaacaacaattttcagttattatcaccctagaaatgttccatggcataaagctcatacccccaatggagggtcattctgtattttaggctgtattttcatttttaacagatcaccctccattgacagtagccaaatcgttttttttttagcatagaatgtgtttggcacttaataaagttgtcatagcaatgttggagacagaggagcttgagttcaaatgtctattggttgcaattactacatgggtctttttaggcatctctcaatacctctgagtctcggtttcctcttctgaaaaatggacgtaattataacacctatagttttgttaaggaaaagaatgacataacatctatagagtgtttagcacaatgcacagcagttagtggacaatcaaggatgtcagttaacgccacctcttcttccccttcctcattgcctatctcaattgtgactgatgcaaaggcagccaacccatcatcagcaaaaatggtcctgaaccaaatcctgatgctaaattacagtggtgccatttgcaaaatgatcaaacctcctagttctcagtttccccactgtaaaataatgagggaatttgatgagctcccagggagctttcagctccgatttttaggatttaaatcccaggttgttattgttttaaaactggtacattttaaaagaaatcagggcttggggaagagaaaggaattcctttcacccaaagggtcaaagggggtcactgaggggacaaaagagcaggaaaaggaggcgatggggcggaaggctgacgtgcgggcagcaccaaagatctgaagtactcaacagggaggtctgatggatgcattcaaacacccttgagtcagcaccggttaggatcaagcttgccatcctgcctcagaccaaggcttaccacctcctttggaaacccgggaggcctaccccacagagaggcagggctggaatgaaaagaaacagaacggcctctgacgccagaagggaggaattctagcccgcagcccaggtctgcttcctgactctcaggaaggggtcaggctcagggaaccgacttggtgcttgcttgaatgtgaggaatcgagaccaaactttgatgtgtgcctttgaaaggcagccagagtccaaggcaggtgaatctgggtagccaagaacaaggacttcattgtgatatttaaagtgaccagaaattcatctgcacatacatgtgccttgatgtacatctgtgcagttatgactgaggcggactgggagagggtagaggcctctaggctgggtatcagggccttttcttagctcctggctctcagttgtttcttggagtccatgttgggttggaaaagacatttaatattcatgagctgtgatctctacttgaagggagtgccctgagggaaattgaaatattaagcaagtgagggatatagacctaattgtagcctccttttctttttggacagaaaagtaatgtgcctaaaataaaatgatggatgggcagtaaggattgtgtgaaaacctcactgctagagcctgcaggaaaaaatcggctgcttgccccaacatgtgcagtcggacccaggcagaagattctgcaaattggctgctggatgatgtcattcattcatttagttcatattttttgatgcctgctgtatgccaggcactgtgcttgtttcaaagaaaacagcagtgaaaaaggaaggccagggaggttaggaaaatgatacaaataattatttaagtgtcattgtggaaaatggcactaaatggaaatacttggaagtatataaccaaagggcctcctttacattgagggggtcaaggagatctccttgaagatttgacatttaagctgagacttgagggttgagtaggatgtggactcattagggagatatggaacaggtaactgagcaaggattgcaagaagttaagactattcaattcccaaggcagagaagaacttttgaagagggaaaagcaagtcagcattgctggactgtagtgaacaaaggagggatgaggctgaagtctagcagtctctgatttctcaggcccttgaggactgtggtgaagctgctatttacggcatgaaggaaggagaagttgactcaagcatataccttctacactctctaccaagccctgccctgggcataatagccatgtgcatgcttgcacagaccaggtgtcagtaaaccaccacccatggccaacccagcctgctgcctgttttcatagacaaagttttactgaaacacaactatgctcctttgtttacatatttgccactacaaaggtggagttgagtcattccaacagaaatcttgtatggaccacaaagccaaaatatttaccatctggtcctttactgaaaagttgttgactgctggcagaggtggatgagtacacagttggcctgtcatatcctcagatcctacatcctcagattcaaccaatctcagatacaaaatatttgaaactaactggctaaataaataacactacgacaatttaaaaacagcacaaatagaaaaaacaataaagtatttccaatgtattaagttttatgagtaatctagagctgatttaaagtacatggtagggtgtgcataggtcatatgcaaatactaagggactttatataagggtcttgaatatcttcagatttttgtatccaagggggtccagagaccaatgcttcgaagatacctagagatgactgtgtaagcgggtaaaagtatagccagttgggcagaataagccagatgagagagacagcgcgaggagttagacaatcatttcatccatctccctcctgagcctataccagcatagctataatttcactgactcctcatgtattttacttccacatctgtgtcccttacccttaagggaagaagccttgccatctaccctcgtgtcccaacatccagctcgagccaatcattgagacactgaagcaaatgacactctgaggctaaaaagggtggccagaggaacccaaacagatgaccttccaaacggtttaggcagcatccaggatcctcccctgaccagtagaagggactgtattgatatttatggagaacctgctgcagtagctcatttcaaacccacagcacccctggctaccaggtattgttaacaccacattccaggtgacacaacagagcccccaaatgtttaagtgacttttgagaatgtggcctccattcaataaatatttactgagctgggaaaccacccaccagacaagcaaatcttcctgagtgctgcatcttatgccaggccaactgcctcacaccccacttaaccatcctcttgattttcccaaggctacgggaaggtaggggccattatcccccactttacacgaggagaagttcaggctcaagaagatgaaatggcttattcaaagcgggtgcttattaagtgacagagttgagatttgaaccaagatctgcccaacttcaaaactaaagtcaccagatgacctcctccaaaatatgaaacctttagaacaagaaggagccagtgagaaatatacagtcatccctcagtatccttgggcgatttctgccaggacctctgtgaacaccaaaatctgtggctgctcaattccctgatataaaatggagtagtatttgcatgtaacctatgcacaccttcctatatacttcaaatcatctctagattacttctaatacctaatacaatgtaaatgctacataaatagttgttatactgtaatgtttagggaataagaacaagaaaaaatgtctatacatgtttagtacagatagaattttattttgcatctcttgaattcacagatggagaacccatgaatatggagggccaactgcatagactgcatatatttccaccctttttccatctcaccatctcagacaaaagtcataatagtatacataactcaaattattaatttaattaaattaattggataaaattcactcaagctttttctctattaattccactggttaatcacattaatgctatgaggtagttttaacattatacaggcattataagtaaggaaatggaggcacagagatgttacgttcccagtaagggattctagccctggaagtctctggctcttaagccctcaggcttaactactaatttatgctacatctccatcattaaggttatctaataaagtgtgtactctcaagagctgaacagcctagcagcaaacagataatgagaaggggaaacaatgcaggaagctaaagaaatcttcacataacaaaaggatcccagggtctttttaagaaacactgtctgaagtgtttgtttacagatcattaaatacttaacagaggaagaaactaaaaaccactgactttctctaagccaatactgattaagtaccaaagagatgttaacataaagcaaataagaaattataataattattaaaggactgagtttttttcattttatcttactggacagaaagataaaatagcccaggtccagtgcctgtcactctgccctcatgcacacggttgcttttctctctcctccaggcagcagccatggtggtcctgcaatcagcctaaaatgcatgtgaccaggctcacactgattattgtctatattaagcacctgctgcatacaaagttctgtgcaatgcagggttaagcagcagaaacctttgttagagggctgcagaagacagtggtcattaaagatatgaagggattggcattagaggtcccctgggagcagtggaaagcctctggtgcaggggttggtgagcctgggaaagatttctggacagtgggactcagataagaccaggtttgacactctgccactataaagatccagacagagggtttttctctatacagtgagtgcaccagtcctaaaggaaactactccagggaagtcacagggggtgagtgggcagttctcatcccatagcaagcagtagtttctgggcagaggcataacatgataggagcagtattttaaaaaagatcaacctccctgaatgggatgctcttcaagggccaacaaaatactcttggcaaactgacccaaagagaaatcagggtgattttagctttcaacagcagtcagaaacccagcccaaattatccgtaagtttaaatttaactatcagccgccattggcaggactctgaaaggtcctggctggagttggttcctcagtttaggagtccaaaaccacatgtatagcttgagttcagcctcattaccaaggaagggtctccacaagagtctgaaatcccttttccatttgtcccgtgtgcattttgccaagagaacttctaaagggacagggagggaggaaaagctgattgaccagccccgaagcacaaggaccacttgtctgcctcagggttcatcccccaaatacctttttccacctgagaagtaggagtgatattcctgacttcatatgattgttatgatatattgttttattaatttataaacttattcattcatcacataggcttttatttattgagcacctcttatgtgccaggttcatgctagacaccaaggatgcctgtgtttgtgacagttcctgtcttccagaaagtgatcaacaaatattgattattatggctaacaaaaataataatctagttcttactcacaagtagagagtgacctgtccccggaagagattgagcagaaatttgagaatcattctttagggaagtcatgcatgagattctattaaatagcatgttcaaacagacatatttcaatatttttctcttttgtcttatctggctctttcttgaaattcagaactcctggtacctgtgaagtgttagcctcttctgtttttcttaacttttctgaccatccctccacagaccttctttcacctactctttaagtatcagcagtctccaatgttccataataggcacacttctcattctccattctctccttgtatgactccaaaatctctatctttagtctgggcctttttttttttttttttttttttgacccatgaacttgtatatctaattgctctactttgacgccccaagggaactcacattcgacacatcttacacaaagcttgccatctttctttccagacctgctgcaagtgtttttcctaatctcaactggtggcgccagtagccaaccagacatttaaacagaagcttgggaaacatccataactcttccctctctgccatttcccacatccaaataattgccattcttcccattttactttgaaaacgttatcttgtctgcgtccaaatcagtctctctcgccccatgatcattactctacctgaggccctcttcagctcctgattaggcttttataagagaaagcttgtaaaatgaacatgttgcttgttcatttttttgcttgccccaatctacctgcccataggtgagagcaagtttcctaaagtgcagacaccttttgttgctctccaattgagagtgtcagatggctccatgttgcccttgagataaatttaaattccttactgtgtcatttaagaccttgcgtgatctgagcccaggatttgcttttcttttctttttcttttttctttctttttctttttcttttctttctttctttttttttttttttttttgacagattctcactttgttgccaggccagagtgcagtggcactgtctgggctcactgcaacctccacctcctgggttcaagtgattctcctgcctcagcctcccaagtagctgggactacaggcacataccaccacacccagctaatttttgtatttttgtagacatggggtctcaccatgttggctaggatggtctcgatctcttgaccttgtgtcctgcccacctcggccaggatttgcattttatactccaataccatcttgtgctttatacctcctactatattgctggcctcatctcatttgctcacagtgtccccctgctggaatgtgctcctcaccacccgttcctcctctgagagatacagcccaggtgttgcctcctaagggaaaccttcttaaatctgggttagattggattgggggtccctcctctgtgctcccacagtatcttgtacctcatgagggtcagaatcctgtgccgtcatcatttacatatctcccctctcactaggacctgagttcttggagcactgagacctgctttaattcatctgatttcccaagagttagtccagggactgacaaataatttgcagttcagtaaatatagaataaatgagtaaaagaaggatgtatttcttaagagacagttttatttttcaggcaagaaagtgtagttgagctttgctggtctttagagtcagacaatcctgtttgaataggagactttcccccttagctgtcatctcgggcaggttatcttgggtcaggtggcttggggtggtggtttcatgctcagacccctgaactgggctgcttgtatccaaatcctagttcccccacaaaaggggtgggggcttctttaaaatgttaatgttactatatcgatacaccaagaggtagaaagtatgctatcttagccagcagtacttttttgaggcttctttcactaagtagagacgggctcaaatgctgcctttccttctctatctctatactgacagaggtcattactctttggtaaggtccaaaggctttagaattttagaagaatgggtgggtggaaccagtgattttggtggtatttggatcaccccataagactctcggatggccccaaattgagctgctttttaataccaaatctcagtctgcggcttgcttccatttggggagagagcctaattaactcgtagctggaaagaactgcaggtctgccaccccccaggcagagaattcaaaaggaagtggatagctgtgtaaataacactgctttaaggggcatttaagccaatgctctttgttaaggaaattgatggctttgtaagtactgcgtctgaagggagtacttgagctgaaggtccccatctcgcctcgtaaatttcctaatggactgtgggcctgcaggctgggcccagcgtgttcaatcacttgccaacaaaaactcggatttcactctaaaaaaattaaaaacgtttaaccaaaacataagttattgagcctgtgcagtttaactgtggcacaaggtagcagagacagattacttcctttaaggaaagggaaactcctcatcttttactttaaaaaatttgttttttaaatgctggatgtggtgctacgtgctttctcaacagcttctcatttttttgtcctcataacagttgggaaggtagtcattattttgccaatttgccaaagaggaaacggactcagggctaaagtgtgctggtcattgacaccagctaattagtgaagagccaggttgtgatcacagctccatcaggcccctgagcccccaagtagtgccaaatcatagggcatccgagagagaatcagatcagcccatctcatcagattctcctgaatatccacatccattcaaaatagattaactggacagcatgggaatgacttaccctcttgaaacctcaatttcattgtctgtaaaatggggataataataggaccaaacacggggctcttctagatttgaatgccttatgtacttgaaacatttagcacaatgcccagcatggagaaagtcatccagttattcatttcacaaatacgctaagtacaattttaactggggaagcggatgatggtataggaagacctagtgagggtccattagcccttctgggggtgggtttccaggcaggtttttgagaggttaaactgtgaataaaggacaaatggggactagtcacagaaaaggcagctctggggatttgaagaaagcttctgcaaacgtggggaggtgagagggaacatggtccactcagggcaacgacaatttgtgtctggagcttagactagagtgcgttcgagaagagagaagcctgcagaggcaggcaaggaccagagtacaccttgtcaatcatcatcaagctcctgttgggaaaagttgaatgaataactcagtatcttctagggcaaccactttcaattttagaccaactgtactttgttagaagagttttccattgtgtcctccctgagccttcttttcttcaggttaagcatcttcatacctacatgattattgctcagtggttggtgcctatccagggtcctattctttgaccatatcctaccacatcagtggcccagaattggcctcttcagccatgactggtccagctaggactggagacaacttctctggcctctagcttggaatctatagccaatgactcaatctgcagtctcatgcttttgtttgggcaaacacatccttcatttggcggaatctgacttcagagtgactgcttcttggaacttttcgtgaacatgaatagttatgatgactcttatcatccctgatcaaaaagggcagtggttttgattgatattttcaaatgttcccagttaactcttaagatttaggaccaggccaggcgcgatggcttacacctataatcccagcactctgggaggctgaaatgggcggatcacgaggtcaggagtttaagacaagcctgacaaacatggtgaaaccctgcctctactaaaaatacaaaaattagccgagtgtagtggtccgtgcctgtaatcccagctacttgggaggctgaggcaagagaatcgcttgaacccgagaggcagaggttgcagtgagccaagattgcgccaccgcactcaagcccaggtgacagagcgcactcaagcccaggtgtcaaaaaaagaaaaagagaaaagatttaggaccaatttatttctgtctccctccctccctccctccctccctcccttccttccttccttgctccctccctccctccctgcctccctttcttccttctctcactgctttccctcttcttactgagagatgagaaagacatatacacaccttgttaaagaagaaaattacagctaagcaatacaaatcagaacatatagatttaagttattatagtatttttattctaagggctgaagagtaacccattcattacataagaaaaagaaaacttacccaagagcaatcttgtgcactgtctctcttctgttctgtagaggactgcagtgtgtctcaccagcttggagatagaagacactgtggcttgaatggctcatctttttagacttatcgaaaccatatagcaggaggatggtctttgaggtgaaccaaaccagtcagagttcagggtgggagggatccattttaacactctggtttctgcatgggagccctgccaagaacatagcatgctgcggtcaccttagtcacaaccagctatgccagattggggtaactggcttggttttcatgtggtgcctgactcatcctcgagtccttggcccactggtagacatagcatccacttgtccaagcttctttctttgctggactcttatgcatgccctatcagaatgacgggctgcttgttttactggattgcagaatagatatgcatatacatatatatatatatatatatatatatatatatatatatagcatatatatatagcatatatgtagcatatatatagcatatatatatagcatatatgtagcatatatatatagcatatatatatagcatatatgtagcatatatatatagcatatatatagcatataaatagcatatatatagcatatatatggcatatatatggcatatatatagcatatatatggcatatatatggcatatatatggcatatatatagcatatgtatatatagctatatatatatagcatatatatagcatatatatatatagactttcatttgcatgcattgttttacttaatgcttacaaacatgcatttctcacagagcaatttttatttgacattgaatattcccaatatttgtataataagccttaatcagccagtcagaacccttgacctctaacatttatgcagcattcagtgagttacttaatctttctaagtttcagttgccactttatacagagaagcacaggaattagaatcatatagaatgtctagagaaccttgcagtgttaaaacgttcattcgttcagcaaatatttctgattatcttctatgtactagtatctgactgcaacaatgcacacaacagcctatgtttctgctctcaaggagttgccattctgttttagagagaatacaattatcaagcaaacatttgaagaagtgagatcatgctatgaagggaataaaatagactagtggtatagacactctagtgaaggtgaaaactatttgttgatagtgtgtttagaaaagtcctcactgagaaggtaatggttgagctaagacctaaacaaaaaattagaaaagccatttgataattggggagatgaggtctggattgtatctgcaaaagtaaaatgtgaaaacaacacagcttatagtttttatgtttgagtagtttttagttttcacagcattattttactttatctttacacccacttttgaaaatgggtaggaaaataatgctgtcattttttttaataagcaaaaagaatcagatgcagaatgatgatgtatgttactggtaccatgaaagtaagttagcaacagagttgaggcacacactttaccttctggccccttattccatctgcttttcgttatagttctatgcatgtttttcagaatgggttcatcatctacacgcttctcgatcttcattttgctgatcatgtttctccatctttttttttttttcatgtttcccctcttaactgaataactgatttagtgatcaaagggcaaaatgtcaagaaccaaatatatcttagagtgacacagctaaaagggatcacaaagctacttgatttaactcttattctatacaaggggaaactgcagcccagagagggaaagtgacttgtccaaagtcatagggttgatcagggcatctattctaatctccagttcccttgactccctgaccattactgtagcaggctgcagagtttgagaaagtgtctcatattttctctcttttctttctctctctctctttctttcttccttcctttctctctctcttttttttaatatggagatacaatcacactaaaactgctgaaactccctttgtagtttgccatcttttattaccctctttctttgccactttttgcacactctctgcatatccatgttttggatttttttttccatttattagcttatattatccaggccaaatttcatttcattatttcctgcccatacttttatagacctttgggtcctaggtattgctcttccttctgtttgtggttagaatgccagcctatctcttggctgctatataattcatgtgacactggattttaccgcctctttcatatcttgagatatcattgaaacccaaaagagaactggctgaaagtcatttagggctttgaacattctgctctgttggctgcattgtcatttataaggattactatctttgcttacaatctttttaagccattcaaattactatactaaatttaaggtgatgtaaatgcatcttcaagttccaattcataagactgtcaaatctctttattaaattttactctaatatgtgctacctttcctatccagatattccatttcttttcaaattcagttaggatagaaaataaaacaatatataagacagatggtgaggcatgatgtctcataggaaaaaaaatatattgtgggacaatttgtgtagaattggattttccccctaatatgtgcttggatttatgctctgacctctttataattaatattttcataaaaatttttacataatactatctgctaaagcagattgaaatcaggtttgggacatcttcagaatcattgataacagagattctaaaactccaaaataactttgttaattcatcatttactgagtatctgctatgagattgacactatcctaagtattcgggatattaattaaagtaagacaagggccagaaatatctgaaaattcaagagctgtacaaaatcattcatttattcacttattcatgtatttttaaacatgacataatatagccaggtagttttcttgaccctaatggaaaagatgcactttgaaacatgcttctattaaacttgtgttggttgtatgggagcagggaacaataataaataaatattttattttttattttatttattttaaataaaataaatatttaaaatagtgaatactacagtaaaggaaataaaacaatatggtatgctactttgcagtggggatggaggattagaatgtgaattaactgcttgttacttgaatatttgaaatgactgctaaataatgaagaggtcatgagaaaagccaagaaagagatattccagaaaatgtgaacatcaagttcaggttcttggatgcttacttaaggaatagatacttgttgtgtcgatagatgtctgtctggatgaatgaatgaatgcatgaatgaatggaaggtagtgagcaaggaggacagtaacagaagatggagggataaagcaggggcttgtaggcctggatacagactttgaactcttccacatgagatgttaagccattgaggagttttagatgaggggcatggcatggcgtagtttacgtttttagaagagcactatagctgttctgaaggagggatagttgggaaacaaatggttgagaaaagagaagcagataggctggttaagtgagaattgcagcagtgatgttggcttgaactagggtggtaatgatagaacaaattagatctattttaaatatcccagggaaaaggagcctataaggtatactgatggactttgtgtggtgttaaagggtgagctgaaaaaaagtaggacagatgactgggaaggttttggtttggtcattgttaagtgatggtgttgtcatttactaaggtggagaaaaagggaatgtggggagaaatcagtatttttgttttagatatgttttttgatgtcttttgatgattttgtgatgcctttaaataggcagatatttagtagagatataattttaggcagttgggactcagagaagaggtcatatctaaggctataaatgtttcagtgattggcacatagaggttttaaaatttttatttagaaactgagacaggatgagaaactgtagataaaaaagaaaaaggggtccccatctaaccctgaagtctggcagcattccatgtagagttagggaaggagaagccctcaaatgagtctgtgggggaggatcccagacaactaggatgacatgatgtcatggaagtcaagagagggaggactgcaagaagacaggagggggctacttctttatatgcttcaaggcagtctagcaagatggggattttgacatcatgctcagctttagcaactttgaggttgatgacgacgttaatgagattgattttggtggagtggtgagtatagaagctagactggagagaaccgataggtgaagtgcaggagacaaagtgaataacactagtttagataacgcaataaattttactgtgaatcatagaaagagagatgtgggataggagaaatagtatttaggagacgtataacagaatgaaaggaggtttgcgtttttattaatttaaaaactttgaatttttcaagaatttttacatttttaaatctttagatgggctatattctattttgctgatttgggagactaatgatgtaggaaatagagggaaatggtttgtaccaaacaagtagtgatgcagaaaagtgagagatgtcatggagctgaagttgctagaactgaatcttaatggaagactcataggcaggaccagcctttcaggctaaggaagtaagggcagatgctctgagatgtgagttctgggaaagaactggatgcatttgacggtggagatgtggttggaactaagaataaataggaaagttggagctagattacaaaaagacttgaaagctagttggggaagttaaaattttgtaggagtctatgaagtatttcaaacaggctgggcacggtggctcatgcctgtaatcccagcattttgggaggtcaaggcaggcggatcacctgaggtcgggagttcgagaccagcctgaccaatgtggagaaaccccgtctctattcaaaatacaaaaaattcgccggcttggtggcgcattcctgtaatcccagctactcaggaggctgaggcaggagaatcacttgaacccacggaggttgcagtgagccaagattgcaccattgcacttcagcctgggcaacaagagcaaaactctgtctcaaaataaataaataaataaataaagtatttcaaacatgaaaatattcatattttagataaatcattcatagattcataagctgctttgtgagaagggattgaggtgaggaagatgcaaagccagttttgagtgtgtaagggctaagtagatagaatatgaggctgtgctataggtgccttccttgatgggcctgagtgtagagttagtgtgataatgtgattacttccagggatgctcttcttttccagtgccttcagtttgttggaggatgcttgattctcacagtgaaacacagggaggaatttctggcccatgtgggtatgtggccaacctttgaaggaactggaaaccaacttaagctcctcagattcaggtctccttcagtagacctaatcagcatctgaagcttgttagcagattcatggttccttaggagccctcactaccctgtcttttgtactctgggcaggctgatctggttgaggaggttaagaagaaaccctggtttgaatagaattaaatgaggtcagcaatgtgggtttgacacgaagcctttgaaagataggctatataaagtcaagatatttctgtcccagaggaaacatatgccaatatatagccacctcccagccccacccaagcttcccctttgtaaaccttcagcaggtaagcactcctgctccccctgttccaagaaactaacgtttaagtacaaagatcacgctttgttgtgtgtgggggtgtttctttttgttgctgtttggaagaattgtgatgtggcataaagactgttgttattgaacccatctctaaataaacagctaaacttaaaatatgctactttttttctggcctttaaagatctttttgaaaagtaatcgttggactaaaagagaatatcataatgccaatcactgttttattagctagaaatagaaatagatgctaatttctcaaaagctgtcctatctttatttgcaagaaatttagaaagacaggtgaatccactcatcgtttggaaggaggttcatttcagaagagtgcacattcaaaatctttgctttctccttgagctctaaattagtgactaagaactctcatctcctcatctacaggtagttttgtgtatgtttggttttctttttggctcatcaatgggctggaagattagtaacctcaatagcttcccagactagttatatttagccaataccagtgaatgttacaaaaagtgaaatcagagatttccaaaagtaatattgagacttacttaagggtaatcaactattttgctcccagaattatatattgaaaagtgggccgggcatggtggctcacacctgtaatcccagcactttgggaggctgaacggggggtggatcacctgaggttaagagttcgagaccagcctgaccaacatggtgaaaccccgtttctactaaaaatacaaaaattagccggatgtggtggcgggtgcctgtaatcccagctactcaggaggctgaggcaggagaattgctagaacccaagaggaagaggttgcagtgagccaagatcgcaccattgcattccagcctgggcaacagagcgagactcggtctcaaaaaaaaaaaaaaaaagaaaagaaaagaaaaatttcaaagtctcctcatttctgaaggataatttcgatttatttaacatagtattgcaatcttttttaaatctagcttcagatcagtttcttactgtattagttccaggatttactgcattcccttactcaagtattggtcaaagtttatcctttactcagacacctctctttacatgctcaaactatttataccctctaagatgtttctcccaaatcattttgtcaaggaagccttctctcattttcccaagaagtattgataggaggagggcctgtcctgattcattaacgtatttccagcaccagcacaacaagaagcagatgttagtatattgattaaatgaatgtatagacttctccagttctcatctactgattagaagatattttagctggggattgcaatagccctcactcctaaaatctccagaaagctttggtagctcttatctgttgctcattcattgctgaaataatcaaaaatgaattactgggttcttagtgttagctgggcatctcagaaatgtttgagaagcaatcccttggggtttaattttgaaaactgcaatcccaaggtttgaggaaattttatagtgaagctgataaatcttttagaaaaagtgtgacataccctataagaaggtgcctctgttttgatgaaatctggtttgtagtactatcatggtatggtcagtaatagcattacaaataagtacacaagcacctagttagtttagtctatgtataatctggtaataaatgaactcaaagataaatccgttgttacctttcatttgttgtttatctagtcatatattcctcaatcactggtttggtgtcccctttactctgagcactgttatgggttggaaatactaccgtgaaggactccacaattctgttcgcagagatcttgtctgcctgataaggaaacagacccacagacagacagtgaggaaactgtgatggaagaaatctaggaactgtgataacacaggaatgacactcagctagggtggggtcaggaaaaagggatgaggaatagagaagacttgcaaaggagatgctctagatgaaccttgaagaaccagtgggagttagcaaagtgaaaaatggaaagcacatttcaggcagagaaaaacaacctttgtaagggtgtggagaaatgaaacggaattgttcgtgtggaatgtgcatgaagaggacagtttgtggatggtcttgtatgccaagctaaggaaaatgatgttttttaaaattatttttatgtgtttattttttttttgagacagagtcttgctctgtcacccaggctggagtgcagtggcgtgatctcagctcactgcaacctccacctcccatgttcaactgattctcctgcctcagcctcctgtgtagctgggattacaggcatacaccaccatgcctggctaatttttgtattttttgtagacacagggtttcaccatgttagccaggctggtcttgaactcctgacctcggatgatctgcctgcctcaacctcccaaagtgctgggattacaggcatgagccaccatgtctggcagaaaatgaccttctataagtagtggggatctatcaaaggaggggcatggtaagatttgtatgtcaggtagaagacttatagccaaaataccttaaattatcccactatcctagagaatacacattatctcaggccatgtttgaagaacacattgacttcagttagcttttacagtaaccgataacttatgactatctgttcaacgttttgaaactgatgagagtcaatgtgaaggcaagtttccttgtgaaaattatccctaatatcttgtactgagaagacacgaataatttaatttcttcctcccttctccagctctgacctctttaacctctttaggtatttctgtcacttattcacctgagtgattctagtgacatcataaattcccaaagtttctaattcagctaagttaattattgtccaccaattgtgttgaaatcattccaatgtaagtcaatatattcttttctttaggttgttacttttttcttttgtttgtttacttgcttccttggcatttatattgaaaatagctcatgcatcctctttaatcatgtctatccttcaagataccttagggtctagggctgggtagagaaaagtagaatctctaattaagaagacttcttctccaactccaacctcattatcatcattgttaagaatagaccctgtgtctttaagaccagtattattttcccatctcagtctgttatgctatttgatcatcctcagaaccttgttgagaaagtctaaaatgtaattttgttttcattttatatatggggaaactgaggcatagggaggtgaaataccatgtccaagattaaccaataatcagagatagatcaagagcttgaatccaggatttctgacttcaaggataagaactcttaacaatagctctaacctgagcctttgcttcaaggtaaactaatatcattttcctaagatttggttttccaagctttcaaatgggaataacgatctctgtgcatcttaagtagtgtcctgcagacatgcctcaggaactcagggacatggcatttcaccttgatgctccagataaatgaaaataagtcagctggtggcagtatcaactatgtctgtccacttacaccaagtccatctgcctcgggctcttgaagctgaactcatttcttccaaaaggaaaagaaagtttctggcatatgaaatctcaactggagaagacagactttgctaatggcacctacccacgtcaagtctcctagctggatagaacagatttctaaatgtgtcaccacatgaaagggaatgaatctgaagtgaggaattccctgatatgaggggaagatggcgtgggatggagaaatcagaatgcccagtgcaatcccactatcagctagtcaccacctggcttacagctccatttccttctccctaagacatagtctaaagaaaatagtcaaagggtacagagtttaaactgtatttggttgagagtatatacatcggggatgccagattttggtcattcgttcattcaacaaatatttattgaaagtgtattatgttttcaggatgtgtatgtgtataaaagtgtgtatgtgtgcacatgaatgtgtatgtctgtgtataattttcttagtatccctcacagtgaaatttactgtattattatcaatgctacctagctactacacggaagttatttgaccttggtattgacttcagactcttttcactacaacctgctcagcatctagcagaaagtatttaaggagcaccaagtaaattgatgtaatgaaaacaagaccagtttgttttagtgttttgttgttgctgtctttgttttttgcggccgcacatttgtattccattcctcactctgttctcttctgtgcttggggcagagggagtagagagggagagagaattccccagacacgggctggcagatgtagctgaagggcccccgggacactaatagcaacagaaactgaatagctgtgtccaaggatgttattttaaaaagagactcacaatagctttgtcagcagaatcttggagaagaaactgcatcttctgtctctctttctctctctctcccttgctttctttttaactccatcttatttttctgtcttttaactcttcctctacgtatctatatatcatctattacttatcgacctgcctgtatacctgtttacctacctgtgtctatttctacctttcctccattctcaggttctgctgattcctagcagacaaatttattgtggtctttaacataatcaggaagaaattagcctttagaagaactaaaatctaaccccaatttctgtcattccgagaggttttttgctaaggaaattaagtcactttagagactagatcttacccttacagagaacataatcttaccctatttttctttacattggaggagaagaaagtgataccaagaattaggcacccctatgatcttatttccaagaggttgttttcgtcattctgtagctgtggcatgtagggagaagatttctctgctaggtgtaaaaaggccagtcttctacttcttgctctgctaccacctgtctctgtgacctggaagcagatggcttcttcctcaagctcacagttttccattagataaaatggatgaaggggccagcattatacccacaatcatctgaaatcactgcaacaacgctgggtaaatatcattacctccatttttttttttttttcagatgaggaaaatgaagttcagagaggttaggttattttatttatgtcctctttgtagtgcttataggaagcagaattcagatttgtacctacttctgcctgatgtcaaaacccttgctcttttcagttctctgtattgggtttctgaagagtaaagtctggatttatggctggtcactcttggattgggcctaggttatacgatatgtagagtggccacattcacatgaggttggagctactgagaagtactgagcctgtattctttctatattgaactgccatgaatgctactggtcacttataatgaattgatttattctgtttcttttgctcattctttctttcttttctctttctgtttttcttttgttttgttttgttttgtttttttgtttttttcagacagggtcttgctctgtcacccaggctggagtgcagtggtgtgatcactactcactgcagctctgacctactgggctcaataaatcctcccacctcagcctcatgagtagctgggactacagatgtgcaccactgtgcccagctaacttttgtatgttttggagagacagggtctcatcatgttgctcaggctcatctgattgctcaagcaatctgcctgccttggctctccccaaagtgctgggattacaggcatgagccactgtgcccggccctatttgggctcttttgatagtatttcactgggtaaactgttggcagaaataaacaagggattttgcagcttggaagaagttcagcattctggtgcccctgaatccaatgactcttcttttcagatacttagcatcatagaaatctgtcttgtttctccttggcaggggctctttctagctaggggaaagttgcttgaatgtgtttcaagtgagcactgatttcacaagctgatttaattcctccacttagaagcaaatcaacccattaaaagaagagtattttttttttctctcgatgattattctaggatgtacaaagcacatttatgttcatttcctattagagttctatggttatcctgagaggttttcctggttgggactataatttctacattacagactggggacagggggaagaggccaagaagtaagtgaagccagttgtgcaaagatacatagctaatgtaagggacagaaaccaaacccttgtctttggccctaaattcagtgccctctccagagctccactctattattttgtggaagaatgttctaaatcaagcagaagccttagggtgaccatatatcctgatttgcctgagaaattcagattttcccaggatatgttccttttgtctggacataatttttaatagcaccactatcattttcaaagtgctctggtttggatgataaattatatagtaaccctaagacactggctagcaactatatttcaaggagctcagaatctttcaaaagtcctgcaacatgtagacttaatagcagcacagtgtgataagtgttaagatagaaatctttataaaataggcacccacacaggaggtggtatttagctttgcctagaaaagttgggaaaatagcacagaagagctgatgctagaattagtaaaaaggtggacaaggtgatctcttttggttggccacattgaggtttttccttgtattgttctgtgttgaaatatcaagaaacatgcataggtcacacctacttagaaggcatcctactgctagctttgtgcttctgttatccttgtccttgcagctaagtgagaatcattgcagccggctgcagctttaaatcattccaaacagaagcacttgctgtggtctagatgacatgggagcttgagaattcacttggtctttaactaaaactcctagggtatccgacaagcccttagaagcctatagcattagacaggaagggttcttggtgtctcaatagtgtaacctctttctctgctctgatggttgagcccagtgtggcaaggagacttattcaaattaacagagcaatttggtttcagagctggaattgaagccaatgtcccttgtaaatcagttcatgttttaaagcaaaactgaaatcctctttggagttaaacaacccccagtttgcctctgtgaaattcttttgtgtcaaataatgcactcagaacttggaaagtgaatgcctgagttggagacccagatcaggtattaacacactgtgtgatcttgggcaagttattaaagatgtatggaatctcagtttcctcatctggaagaataatatcttccacatgaagtttttatgaggaatatttcgaataatgaaggtgaaagtgtttgtgaactttttattacagtatagacacacaacacaaggtctaccttctttatatattttaaatgtaaagtacaatattgttaactataagcacactattttacagcagattcctataactttttcatgttgcacaattgaaaccacatactcactgaaaagcaactctccatttcctcctcccccgagatcctggaaaccaccattttactttctacttctatgagcttccctactttacatgccatctataagtcgaatcatgcagtatttgtctttctgtgactggattatttcccttaacatggtggcctccacgtttcctataacatggttatctccttgaacatggttcatccatgttgttgcagatgacagaatttccttctttttttttcaagactgagtaatagtccatcgtgactaatgtgatgggcttgacagtaccaatggttttggtggtctgactctgcagctgctgatgattgctgaggccaaagaacaaatatttatttattctctccctttctatgtcaatcttttgcagatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtaagatcctaaccatgtgtggcatttcctgcagacattcaaagtctccgctatgccccacaaggctactcacctctaaggcagtgtcattggctatagccacttgagcatatctttattaaatgtactgttagggcttcatgaataccatttgtaaaagattagatctggaattgttagggcagggaacattgtatgatagggtaatgactgtcctcctatttccttgcctgtaataactaatatttggagaaagaactccattttgcatatatcatgtatttcaatgaggtaagaatgaatttatattggaagtcccactttttagggggcgccaagctgtgtactacttgaattaacagtaattatacagtaatttgctatgtggccttagactagttctcccacctctctgggccctatttttcgactcatccttaaaataaagagtagttgagcttgttgatctccaagggccttcccaattctaagaagctgtgactcatgcctcagtcccctaatgcactatttatgtgccacagttcttccccaagggactgacagcttagtccagggagtgagagttttggggccactagtgcttgtatgattctagagatggtcatgctgtcccgagagccccctttccaattatcctaccaaggaagcacctgccttccccgagactcaaatttcccagagacacgactcagtgcttctggctgcctggcctagtggcctttcagagaccagcctgcctcctggccttgcagatgagctgctattcccaggcattcctttccaatattgctttcttgatttaggtttagtcgggtagccctggcttctagatgaaagaaagatatgaccttcctctggggtcaagtgaagaatcactgggtgaggtacagaataggactacctcatttttagttgttgcctgtatttgattatttcttcattcactttttgtttatgtttacatcactaaagcctttattcatttgcatttatttttgaatgccctcaggagagtggaaacaaatggtaacatggcatttcctgatgcttaacaatgtatagtgccagcctgctgaatgaatgaatgaatgaatgagtgcacagatagatgaatggctagggttcatcctccccctgtgccacgtctgtacttggtggaatcatctgtgtggttgcatttatcatactgaactctgaagtatctatttgtctgtctggctcccccattaggctgctggttctttgagaacaagtttcagtttattcatctttgtcctctcatgttcaagcaaaggctagataggtgcccagcaaatgtgtgtttaattgactgtagatacacacacatacacatacatacatcccattgccacatgcaaatgaacgacactgacagaaaacactcacgcattgcctctctatcacatagaatgtcctgcttcagaaacaacagtgctggggccagcaagagaacaaggaatccaaattcaacactagcatccagttcttagaaatgttttaaaaacaaccttcaaacaagagaattattaacacactcagaacctcccatgaggaagagttgaggtagcagctgtgcttaaaaatcacccaaatgttattgcgactaatgtgagaaaaggagagaaagaattttccagtcttagcatttgaaaagaagcttcatggggcaattattccaatcttgtaagggggggctgtcaggaattactggtgattatctcttcctaaacaaaaatccaatttaaaaaatcattataaatactagctcttcgatctacaaagaggagatgaggaaacaaaatcatcctattgaattattcattgtaaccaattttattttaatgaaatcgactaggttccattactctgggcttggacataatctttgttacaaggagatttcagctgtaactaaatttgccataatgagatcagctcactggagaatacagggtcggggagggaatatgtgtgcaggctgggtgcagggccaggaagagggcagcagaacaaaagtctcctgaattcctcatctgaaagcaagtacctagaagtcattcacaaacacacacacacacacaccctaccaccaccacacacagaggcacaggcacacgcatacacaagtacgtgggcacacagacacacacacacacacacacacacacacacacacacacacacggagtctgcataattagaggtaaaggctattcctgaagtgtaaacgtaccttccttccaacaacagagaatgaggaggaagtataattgtgctcttcattaccttgtacagtgattagaagagattggtagttaattttcaccctgtcagggcttccagtgaagatgttgatagcttgagaggaggagctgggaggctcttagaagttgggcttaggaagaagatgggaattgtatcatgtgcttctcactttccccccagatgctcatactctccctcttctctctctctctctcacacacacacacacacacatacatacacaaatttacacaccaaaaggccctgtaggagcatgggagtaccaaagcagatagaagagaatagcaggaaagaaatagtagttatcaaggtccaccaggcactggacacatgtatgcacattacagccaatccccttgtcattcttcaaggtaggaattgttgtctaccttggagaaactgaggaacacagtggcttcactataagttacatggtccataagggaagaatctaggattagaagaatctcatggaagatgaatgacagtgggtccttgggaacatgaggtcacattcaaaagttggaagtggctggattcctggaaaacttcactacaaaacaggcagaaagactcctagatggatagatctcagcattgagtgtcactctgcagacctcatgaggtacttcagttctccttgaacaaacttatagtcactgcccataccttcaaattcaggctgttcccattccctgacaaggtggccctgttccatgatgccctggagttccctaggacactccattaacttagggaatgatgaaataacctagtcattcccatttcctctttacaattcagtttggtcccactttctgtctttccctgatgcaataaaaatgataaatgcgaaggtgtttattggagttatgtgcctagttctgtgctagagcctgtggaagaaaccaaagaactgaaatacccagcctctgacctagtcactgtacaagagttaggagtgagaattctatcaaaggcacattcttatcacaataagtctgcaggatctctatgactactgcaaagaaacaacatgcattgtgctatatggcttgagaatattgattaaaacttcagttttgatgttgtaaaagcctgccatatctaatggtttccagtgtttctcgttcattcttttcaaacatgattcccaaatttggttagggcaaagctaaccctgaacattgagtctcatatccaaatcttatcagaagtatcaaaacttcctggttgtgcaaattgggttgaacatcctataataagagacattctttggatattttggccatgcaccttcctggcccagctggaatcaagaagttcctgagacagaaaaaaatggaaattaaccgaaaaaatcaagttatctctcttctgggaacctcagaacctggtttggtttaagtgcttgcaaatatcttgtattgttcttatttggtctccatgtttcacatttctctaatgctttacacaaaaggatgccaaaatgagatgttgatattccttccttttaccccggcctccagcatttctaccaaagtctgtttcctcctatccaaacaggcacctccctcctttgcagtggcctgaggaggaaatggaaatactaagactatctggaatttacagtgctctcctaagggattacagaccttcagtcaaccaaccaatttatttccttaatcctttgagggtaaaacttagactaagcatttcaaggggagtagtttgagggccaaagtaaagaaaacttttcaaagaatgagaactatccacagtgagatggagtgccttgtgatataagaagttccccaacataaggcattcaggctggacagctgactgaacagaagattcctgcactagaaggcaggtgagacctaggtatgcctcttttctttgtaattgattctctgactttatgtcccattaacccacgattgggtatattagtccttggccacttcattttgagttgctattatcattccttggcccatccataatacttcatgcctctactagaatacaaaccaggccgggcacggtggctcacgcttgtaattccagcgctttgggaggctgaggcgggcggatcacctgaggtcaggagtttgaggccagcctgaccaacatggtgaaaccccgtctctactaaaaatacaaaattgagtcggttgtggtggcaggcacctgtaatcccagctacttgggaagctgaggcaggagaatcgcttgaacccggttcaagcggttgcagtgagccgagacggtgccattacattccagccttggtgatgagagggaaaatccatctcaagaaaaataaaaataaaataaaatacaaaccatactataccttgtaatataacaatttatacattaatttatttattcacttgattgaacagaaatatatttgagtcctgcactgaggaatgtgagagagagagagagagcatggccgttaatgaggtgaagtagaaatcatgcagatctggctctgctctcttaaattccattctgacatggaaaccttgagtaagttactcttctgggaatcttagtgtcctgtagaaaatgagaatgataacatctacctggtagaaattaagatgaatgatatctacctggtagaaatgaaggatgcagagaaaacactctgtgctgggtttgttaacttgatgggtagttcaaatgttaattctctgtcttgttcatgtcaggtttccttctttgcactccccccaaagctggctctagggacccacacagaacagaagctcagtcaacattttgttgaattaaacacagttgcgtcagcaaacgtttgctgcatcctcagaactgcagcaggcactttgagaagcttcagagaagtactggttctttttctgccttcataaagcttaccatgtcatcagaagggtgttttcaactagaaatagtagccaaagacccaagagtgagagtgtaagatctagagggagtttccccgaggaagaaaccacactgctatcagcttactcagccagtagtgatgagagccagtgtgtaagatagaaaagtcctttgcccactttcagaagatcctggacaaattataaaaatagcatttatcaacttcttccaggctttccaccaaatttcacgaatcctactaaagctactacaaaaataggaatcactgttttcattttacagattaggacacaaaggctcagagagcagagtaacttgcttcagggctcatctctataaggggcagaaccaagatgcaggccactgtgttcataatagaaatacagctacaggaccaggcagctcaagcctgctccaatgactgacacatgagaacaagctagaagagctagtgtcttttgcatcttttaatatgtggtacgtatttaaggaacaccgggaaagtgggcattccctctctctaatacccaaaatactgccctacaatttttgcctgctgctaagatctccatcttttggcccccattctttcacccattgccctttccagagagttttctaaaatgtgtgtatggaaataagagagacacataagtgttgtaaattgccaacccttgcatgtaaaaattatttcttaaattttggaatgtctgcttaattatagtagggatatggggagaaaaaaataataaatgcacaaataggaagaagaaactttgctcaatttacagttttgtcacaagctatgtgctatacataggaaaccttaaaatgtcagtgaaagggaattgtaagatgtgcatattttctttctttttttctttttttttttggcaaagtctcactccgtcctccaggctgaagtgcggtggcacaatctcggctcactgcagcctccacctcccaggttcaagtggtcctcctgcctcagcctcccaagtagctgggattacaagcctatgccactatgcccagctaatttttgtatttttagtagagatggggtttcaccatgttggtcaggctggtctcaaacttctaaccttaagtgatccatcttcctcagcctcccaaagtgctgggattacaggtgtgacccactgcgcccagccagatgtgcatattttctgatggctgccaagtctgaggcaggaggggagaagccattcatctgtgtcttcttcatccttgtctccacagcaagggactagatacccactagggtattgtatggatacaaggataagaaatctttccacgtacacttatgatgcagtgtaggaagtgctcagagaggcggactgagaggaggtcagggagaagtgattgctgagtttcaactaagaggataagctggaggacaggagagggaggacgggagagggaggaaagaatcacataatgggggctgcgaggggtatatccaaaaaaaggtaaataatagatgaaggggaagtcaagagagatgagctaggaaacatggttaggaaaatcctgccaatgcttggaacttgacattatcctgagggcaatggggagtttttctgagtttttcagcagggggctaacatgtttggatcattgaaagaagaacattgacaagtgttgaacacttcttacatgccaggccctgtattattttgcatagatttcagaacaaccctgctgagaattcttaatattcctctctcaaaatgaagaaactgagtctcagggagatgaatcaccccacccatggtactctttcttctgttttcttttcttataccaggatactggtattgcattaaaacagcctcacttggaaattctgcattgataagcaattctgcaatgctaattagagtgtgctatttgcaaagggcaggaagaaatcctgtgctctatacccaatgccgaagtcacttctaaggggctctctgccccttccttgcctgctctgcctgctatggccttcaccaaagcattcatctcctctcattagtgaaatgagagagcctttgccaatggtggtggaaggaggaaaggcgaagggaacatgctgaaatttcagagacaattccaagcagttttcccaaatacccaaaggatctgctttctcctggtggtttctgaataatttttcaagagcacgtgtgcaagtcatctaaggagacagaacagaaagtaccatggtctagttcagcctgtcccatggtgtggggcaccaaaaaaatccctccaggaaagtaaaaatcagagcctgcctcagaaaggagcccactgagttggtcactataaccacccccaaaactttcatggaaaccttggactgtgggagactttaaatctactgaatcttatggggccccagcaaagagatctactagattctgctcctggctctctcttctattcatcctttggtcatttaccctttcaatatctgttcaaatctacaaaagtctagacactctggccctaggatttggactgaaaaactctgagtgactggagctttataaaaaatgagatctaggatcagttcaacctgattttcagttctagagtccaccacttactagctgtgagactttaagcaagtcagttctctttgcccccaccccagtttttcatctgtaatataggagtaataacatctccatggcaggtatttgtcaaggatgagacagttgatctagaaatacagttttccttctggtagcaaccgacaaagttttaaagaaacacttctgtctgcctgtgaagttttggcaactgaggaacaaatcgaattaggaacaacatgtggactttttttttttttttttttttctaacagaatagtatttggggcatagaaatttaaccagagagagactttgagagtctcttggtcttacttcacttaattaagacttggttttgattaaacaacttccctgaacctctcaatcccatccgttataaaatgattctggtatttggattcaaaatcaacagaatcttgtgaatcttctgggtccaaagcatcattttcaacatgaggttgaacaaagcaaccactgctctcaggcagtaagttatgtgccatggaggaaggaagacaccaaaatagcttctttcgataagaaaagacaaagcttgcaaagtgctgtgatatgtggacaaatggaattaaccttagaggttaacctttgaggaggaagggcgaacctgaataaagtgacaggttatgtagaaagtgatttttctttccacttgggcatttgggggaagctttaaaaaacattgtagtgtagccatattgtttcacagaggaagcataagctttaaagccagaaagacctgacttgggtactgtttgttaccagctgtctgatgcctggcgaatgatttcagttttctgagcctcaattgtcctcatcttcacatgatcctgctgtcattctgtgagatggtatgaggatccaatgagctaacatatataaagtgtataatacgtggctacgtcttgcgaggcatctaattcttgtcagttcacatccctactaaactacattatccctgagcaaattgaatctggagaaggaacaaaaatgtgtaagagaggaaagcaaggaagggatgggtttggcatttgtaggcatacaacaaacacatattgattgatcagggaaggtgccacgtggaacggtgagatcctgctttgaatagcgagtcttcatttttcagttgacacttgactcttgacttgaagcccaagaataagcaaggctttgtggtttggggctgcatctactggttctccatgtagactagataaaaccctgccaaccccttccatggcccatctaggaagattccttggcctctgtcttcctttttcttccaaacctggcctacccctatctcattaccttcattctccacatcctctttagcttcaggaccagaaacctttcttttatccctgtcatttgttctggctcccttaaaacccttctttgttcttgtctttcattttcttttcttttctttctttctttttttttttttttttgttattgttttgttttaagtggggtcaccagcattcagccagcatggcctttgctgtgtaatttagtttcatgttctgtacccaagaaacatgtaaaaaatgtaaacagcgttcactctcctgggctgtaatgcacttaggaagcaatagccagttgagcttgctgagcctgctgctttggcggtattgaattttgtccctaaaaccacatactcatttctctaagtctgaaagtaaactttctcaagccagacccaaaggatggggttttgaggtgagttagagtttggctgtgcacaagattttgtttttatttttgtacacacaaatgtgttcatttgtttttgtttgtctttcaagtcccctcgtctctactctctattcctccccactctctattccttcccatccttactttgataaattagactgggtatgttacctgtagaatgagaccagaaagggccttctgcctcctcttaagaaactccaaccaggccaggcgtggtggctcacgcctgtaatcccagcactttgggaggccagggcaggcggatcacaaggtcaggagatggagaccatcctggctaacacggtgaaacctcatctctactaaaaacacaaaaaattagctgggcgtggtggtgggtacctgtagtcccagctactcgggaggctgaggcagaagaatggcgtgaacccgggaggcagagcttgcagtgagcggagattgggccactgcacaccagcctaggtgacagagtgagactccatctcaaaaaaaaaaaaaaaaaaagaaactccaaccatgattttcttaaaccctgattaattcttcagccagatccaagcaccagagcaccctgggtacatttgtacatgtttgttttccagggagaaatgggcccagagaggcccatgagagatgtccctgctgagaggttccctgtgccagggcagtccaaaaaagttgtccctggggctcctgcccaccccagaatccttttccaaacatgactcatatgtgcaggtggtgaaaggggacacttcggtgatgtctacatttctctccttcctggaagagaggcccctggggaagtcacaggtttgggagagatctggtctactggcaagatactgctttcagagatgcagatgccacctgggtaatgcccatgtctgcagtgcaactgactggtggcaaggggtccaggaagagaatatcaatttaaagcaacgggaaggaggagataaactgacatgcaccagggagctacggtcaggggtttatgtttcagagagagcaaaattgtatcagtgttcacaggccaggctccagactatctgtccagtagaaacttccatgatgatgaaaatgttctacatatgaatgtcctgttcagtagcctctagccacctatgatattaagccctaggaatgtggttcatgaaactgaggaactaattggtttaattttaattcgttaaatttaaatagcctatttgtgggcattgggttcccctactggacagagcaggtctagagtacttcacatgccagggctgctacttgcattgagatctcgagcaacttaattagcctctctgtgccttagtcctctcatctgtaaaattaaataattaaggggagatggtgagaattccatgggatagcacgcttaaagcacttaggacagtgcttggaatagagtaagtactacctaaattcattcagttctgtcattgcatcgaatcttttttttttttttttttttttttttttttgagatggagtctcactctttcgccaggctggagtatagtggtgcaatcttggctcactgcagcctccacctcccaggtttttcaagcgtcctgcctcaacctcccaagtagctgggactacaggcacacaccaccacatccaactaatttttgtatttttagtagagacagggtttcaccatgttggccaggatggtctcgatctcctgatctcgtgatccacctgcctcagcctcccaaagtgctgggattacaggtgtgagccaccacacccggtctctccagagatttttaaaatgacatttctctttcccagagtgagatatgacatactaatctttttgtaactcaatgtcttaaattttttaagtctgcataaattctcactggaggacttttgcttttggatcatattctccgtattcacaagaaatattggtctcagtgatttctcacctgtgaagctctctattttgttccccatggcctataaactccaaaagtcttagcagacaaggccatgcacaatctctacctttgctttacagactattgcctaaggggcacgttccaggcagtatggaccaacttgcaatttccagatatatcttggggtttccttttctcctgcctggaaacaccatcatttgctcctcaaccttcttagggcttaattatcctacagggtttagctcaagtggctcctcttccatatccctcccctgacaacctcagcccatgagcagcctccctcttccatgtacagaatacttctggaattatcagacaggcttgagcacaagctgactttcagtgtgcattgcttgtgtccacagcttttcataccaaatgaccggttagcagctaacgatttggccctcatcttatgcctttaggtatttcctgtgcccagcacaggacctgctgtgtggacaatactcagaaaatggactcattaaatgatgttgttgggaacaatagctgctgggtgttacctcttttatgattggattaaatttataaatcggtgtctacaagtgattcccttatgtttccggattacagcctcctgttaataccataggtgatcaaagcaggcagggccttctgaaatcccctgtttcatcccttcacattacaaaggagataagtgctactgtgtgaattgggggaggaagaggtcccgaaaacccatcctgaacccagacctcatgttctttctgctactctgtgcctccataatctatcctcacccccggaatgttcactgcacagtgagaagggttgtttggtaactgtttttgtgtgcttactcctgtgtgttccagcatcaagaacagggcctggcatatagaatttcatgataaatactgataaataaatgtttttttctctgctaacagctttgggcaaaaagtaggaaacagcttctggaggctgagcgccaggaaggaagctctaccctttgcttcttgtttttgcaggaaagattggggtctaagcaattttcctgtgattggcttcctacagagatggatggaaatctaagggtcttcctttctgacttgagaatgtggttcaccttcagagagatctcccaatacaaggcccagcacaggagggtgtgaaggagtaagaggaagaaagatgggaggaagaagaggtagaggtaaaaggaaagaaggaatatagaatgaagagacagagaaaaaggaaggactacacaataacaacaaataccagtaataaccataatgtaatagtaatcacagaaattgataatgatgagtagagtaaagagaatggcttggctgtcagagtgattacattatgtagagaactctacactgttttttgtacatttaaacctgtcaaccactgtatgaggtaactactgtaattaagactcacaaaggttaggtcacttacccaagttctacaggtagcccagtggtagaacagggaagtctagaatttgaaaccagaaccatgtccctctacagccaggaagaaagaagcagcaagtgatggaggaaaatgtcaattttgtatttttagtgagtagggtgtatctaaatatttgcatgtgcaagagctctttgaatcctcacaatgctacaacataggtaccatcatctcattctgcagtggaagatattagagtttatgaagggttcaaggccatgttgtcagtgaatggcagaagctgaaattccaactcacattcctttgatttaaaatgcatgtgtcttctggtgcttagtggaagattcagggaagtggcaggtgcaggggttgttgagaagttcacattgtggatcccagattctcaggcactgcatctcagaacagctgcttcaacaccctgcgtttgtgcagatgtctgttgccctggccaaggctgccactagggaaaagcatcactctggaaggtccttgttcctcagagaaccctgctgatagagtggtggacatataagtcaacagtgtccattgcacctgtggtggacaaagctccccggtttgtacatcacagtcactgtttctacctctgaagcctggaggggcaggccagggagaaataccacttttgtctttaaaaatgggagttcttgtttgagttggaaggtctgcaggatgctgttaaaaacataagtgactgctgtccacctgttcctttcatacatcactgcattgcatcctttggagactcttcctaggaaaaatcaagctcgaggcaacctagacaagagtactgcctcctcttcaaaagcaaaaggaagagagcgaatcatgtagtgattcccagcccttactcattgaggctataggaggggatgggaggaccctgaggtctgcagtgagaagcaggactcagagacaatgcactctgcatgatcatcttggcatctagtggggttccctgcaggtaatgtgacttgtacttcaatttcaacacaatctggaacacacagatcttaatttggaaagctgaataacaggagaaagggggaagaggggaggaaacaaaaacaacaacctggaaacttctagttttatgaacttgagaaagtcttgttctttcaagacagatgtttttaagtaaaaaatcattcctctgacctttcttgaataggccgatgcggtcaagactgccattaaccactgttcaactattcataaccaagggtttcggtgaccaggcaccgaacttggatgtgatcatcactttcctgattaacccatgaatgcccagggactttgatttaaaatcaaaggacaaagagaggtgtagaagcttcctaagacatccccctttagtcttaatagctctgagctgagtgatggagatgtccatattttagtgccttactccagggttgtctgtgtttctgaatttcactctagagccagcagagaaagcatttggattaaagctaagtagatttttgttttttatcttcagtgtctaaatctcagtcagtttcaggtttggggctatagagcagaaggcattacccagccctgttttaggattatggtgttttcgtattctggtccagaacttagaagtgtttcagtgctcaacatactgctctagaactgacaatgcctcgggccctgaaataaaattcatgatttttcaggattcttatctggagctggaaatgcctcagaattttctactgctggcaatagctctgtgctcctgtctagagttgagtgttcatcctgactgaagttaacagtgctctcttgatctgatccagagtctacactggttttatattctgatctagaattcatgacatttcattaatttctttcagtacaaatgcaaaaataaagtttaaactacagaaagttagcaatgtatttttttaaataacgtgctcagaactgtgtttgcaacaatattcagcatctcaaacttatccttcacgcctccgctgttgacatcatttgggaaactgggtttgtcatggcttagctgtggccgagtttttctcctctggccattttttttcctccagttcctgctctccagagcccatttgatattaagatcttgcctttcagacctggccttcagatatagattgcctcagcaactcccttctccaagcccctccctcagccttcagagagcttgaacacagaacctaccacatttctctatgagtgtttgcttgcttcgttcttcacctcccacccccatgggaggagaaggaatttttatctttgttgcttttgttcctttggggtccattttcttcatgtggaccatgggaatgaagaacctaacacataaataagtgctaaataaatgttgaatgaatgaatgacagaatgagagagacatagaaacatttgatcctaggctggacagaaaaaaaaaagatgctttcaaaagaaaacagatccctgggagcacccaaaccactgcctctcaccctgtaagaatacaaggaaggttttgcatcccactcttttaaccccgtcagcatcttactcttggaggtagcacatgtgctgtgaagtcacccacggaccatctggctggggatcccgtgttcctcctctgcagcaagagattacgtaaactggacagcagcctccagatgttagcagtttctgctcatttttttcctcccttttcaacaacaataataataattaaaacaaacacaggcctcatcccccacccgcacccctgaaattacaaacaggtgggcccagatgtcctcccccttcccatccaagggcctcctattcttgaggcccagccgccgaccctcagcagggcctgccctgggctgagccggacagtcatgccagctgccctgtggctcaggccacagtctcccgaaaggggaaatggccatgtcatgagaagtctctgtgccagactttccctctccccgcctcccaccccaaagccttggcctccaacttaaatggatgtattttggaggactaggtggcttaagagattagtaatgagatcccaagtctttcactgctgggtcaggagttcataggcgggcctgggcgactagtgaatggcataattagggagacagggagcaggcctgcggagggcccgtgtgaaatgagcccagccaggcctttaatggcagcagttgtcagcagcacaaaaggcggccgccacatccgacactaatcactctcccttgttagaggatttactagctggaggagctcaagccccctgcccatctcctcctcaaaacgggcatctgggaagggactcggcccaatgcctggctgtactgtctgcagaacggggagctgatgccaaccccatggggtagaggtgtgagaactaacatttcatgcaatataaatgagtgactagtgtcattatattaatcagtacttccactgctattgtgaattttctttctccatttgaaaaagggggtggggtgggtgatgaatctccccatcacagtgacataaggatggtgtccatggaggtggaagcatttggatatttatcatcctcaccgttattgtcatcattctcattaagatcagcatgtacactgtgtgggtctcagttttctcatctgcagaatggactgggaataggagatagaactgaagtaacacagacttcaacatccactccgaacaggtgtggccttggcaccttatttattacctctgagcccaggctgtttatctgtaggacaaacaagaaggaggatagtaatactggcttcccgggaatgtggggaatctatgtttggaacataggtgctggacagtaaatgatggcaaagaaaacatgttagctttaccactttcatgaatggtgtcttaggcctctaacataagcttttcccttagaagaaggttgagacatctatctgttgtcccccagaaatcctgaacctgtgtgtatgaaattgaggaatttaatgagtagtctctaagaatcaattctatgattctgaaccatatcatttctaagaaacttagtttccctatctgtaaaaatgttagtatgctgtagggcaatacgtcttatatgatttctatattccctttccattgaaagcctggcttttcctccatgatcatttggtctggccaggggtttgcaccctaaatcccaggatttcagacttgtggggaggtgccagcctgaagggtatgagacccctaaggagtgtgaaatgcctaatgtgttagggacagatccctggagcaacgaggtgctaatcagcccagagctgagccccaaggctggagggcatccaatgccaagttatcttatcagaaagtgtctcctgggtagaggctctgagatctgctgctatttctagaactctgggagggaagaagaagccatctctctgtttcacactctggccctgcacacaggaaatgcttctttccttgattgtctgtctatgccgaataataaatgctcatattgaaagaaacgcaaaccacccctccctttcccctctatctctttaaggcaggcatcaaaggggaaagctgctctggaggcctggggaaagtgataattgtttctaatggttggtaaaagaaagcctggctcccccctctcttttttctgccattgctattaagtgtgtaaaaaggaagtgtgtgtgtatgtgtatgtgtgtgtgtgcctgtgtgttgtgttgtgttgtgtatctgttaaccctcggcttcccttaaagttttctgtgttcattggtcagtttggaattagaggcataagagggaagcagggatagaagtaggaatgaagagaagatctcaggtaggagaggtctatagtgctccgcaggtagtgggagaggccctgaacctgaagttggaagatttgagttgtgtttgttcattatatgcattaactgagatgagacatgtaaagtggtattgttgttatacatttttttttttttttgagacggagtctcactctttcacccaggccggactgcagtagtgctatctcggctcactgcaggctccacctcctggattcactccattttcctgcctcagcctcccgagtagctgggactacaggcgcccaccaccgcacccagctaattttttgtatttttagtagagacagggtttcaccgtgttagccaagatggtctcgatctcctgacctcgtgatccgcccgcctcagcctcccaaagtgctgggattacaggcgtgagccaccgcgcctggccatacattcgcttagcatctaagctggaccttcctctgctcttaatactgaagatagaaaagacaagagctcattcttcccctcagtgagctaatgaccaagttcaagaattgcaaataggattcatcttctaggccagttctgagcaattagagtgactccccatagtgttttgttgagaaggatttagaggcctaccttcagggatgcactatgtaattaatggtgcctgtcctgtgcaatggatgagagaatggtagcactgatgtcacgtgggaatgagtcctggttctcctggtccctttcctgcactacatggttattattatctctaaacattggtctaggccctatagactttgatttctagatctaatgcgtcaccaatcttataaagccttgggaaagccatattagtttaacataggggacatttggtgagccctgcccagtaacctgcattagacactgatgaaaaggaaagagaagtcaggcataggcactgtctttgaagctcatacatggagattcagatggacaaacaagaaaccataatgcaagtgtattacctcaagggtatggaccaagagttattgggaggtcaagccatggagtaagaagagaacagactttgcgtcagacgagcatgagtttgactgctaagccgtggcaggctgatcaatgcctacccaaacctcagagtccttatatctcaattggggataaagatgcttatttcacaagattattaggaaggtaaaatgagataatacacaggcagcacccatactgggcagaccatctttaagagttggtgctggccaggcgcggtgactcacgcctgtaatcctagcactttggtaggccaaggcaggtggatcacctgacgcctggccaacatggtaaaaaccccatctctactaaaaatacaaaaattagctgggtgtggtggcaggagcctgtaatcccagctactcggggggtggaggcaggagaaccgcttgaacctggtaggcagaggttgcagtgagctgagatcgtgccatcgcattccagcctggggtacaataggaagacttagtctcaaaaaaaaaaaaaaaaaaaaaaagagctggtgccctctctcactctcccaggaaagcactgaggagggagaacatcatctgataaaaacagcaaagcctggtttatggaggaggttttatttcacctgggccattctgtgtccaggttccctgaggccctttacagctgtagtcttataggctgtctcccagcaggctttccctcctgtagtcctcaggacccttaagaatcttggaggtttatatcaggaaaccaacttctgtccttcttgcacccttgcaattcttgggaaataacctggcattggaactgcaagcctgaggttaaaatgtggcctaaggagaaatattgagaaacactggctggctgtgtgtgtgtgtgtgtgtgtctgtgtttgtgtgtgttgcacacttgtacatttatgggtactgttagtgtcagtatccatccccgcactcctcctccccattccttttcctattttcttctataaggctcattcgcaggtccctttgggtggaaaaaggaaattggagaggttggactagaggcttgatgagcacttcctccctcccatgattgacaaaagggcatgtaaatctgtaaaatcgaaattcaatggaaacctcatggcatgtcccctgtgtgggaaaataccagagcccccgctccccctcttctccctccgtctccctgcctttgtgtacatcgtgtgtgggtggaagataaactggatttaaaaaaaccctttgaaagcaagacatcgttaactcctctaattgaaagcagtcttctgcaaaggagggggatttggaggcgggtgctggatgtagcggctggcagtgcactgagtggacaagagtctctgggtcctggagccacagagtcctctgtttctgcagacctggaacgcctagtcaccaccagacatcctggcccgtcacagaggagcttactgtatatgttcaagccggtctcttctccctccaccgggctatgtttctccatccatcaaatgtgagaattggagtaagaatttctgaggaccctcccagctcagatatccagtgatcccaaagctctggacaaaggatttccccagctattttgcagcttccaattgcagacacaaaaagaaagaaagagagagagagagagaaaaaaaacacattgctagaaaggctgcagtaaacttttatgttactgttctgattgtctttgcccaaaaaggtgtcttggaaattagccttcagcttcagagaaagggacccataagtctcagaagtcaacaggatgttcacctgctgcacagtgtggctttgtttgtttctttgtttgttttacacttaattttagagtcaacattcttttctgcagcattcacctgagaagctggaaatcaaaagctggcagaatgtcaggactgaaaagccctttggagatgaattcatcttactctgtctttccataaataggaagagtgaaggtcagaaaaagtgagcaattgagtcagttctaggaggcaggtcccttgcctggcaattgcaggctctttctactgtatcactccactccggggcagacctgaaaaggcctgttttggtctgttgaagcagcttctatttcaggagccccagggaaagacaacaagaagtcccaagtccatcttccatgtggctgggattaagaccccgctagcacaaatatatctattctcttatttaaaaatctcatcacagccctgagagacatgtgggcaggctctcttgaagttaacatctatggttaagaatgtgggctaaacttgtgcctggatttcaattttggttctaccgctaactagttgtatgaccctaggtaaattactgggcctcgattttgttatctgtaaaatgcatatcattgtaatacccacctcacagagtcatggtgagcactgcatgatttagtacatacagagtccttaaaacagtgcccagcatagaataggcacccgatacatgttgctgctgctgctactgctgctgttgcctgctgggcccctattatttcctgtgtgctgggaaatctgctgggatttatttgaggataaataaaacatgcttctcaccttggaaatcttcagagtttaaagagatgaggctggactctatacaactataatctaacttgacaagtgctgtaactgaggtataaataaggaactatacggacacataagaaagagcaattaattctgcctggggagtgagtaaaggctttcagaggagggatgatatttgagagtggctttgaaatgcgtgtagtatttcacaaaatgggcaatgcagcggtggtgggcgtgggggttctgggctccagcatcatggagggggagtccacaacatgtgagagaaagagttgtccagcatgaaggaagcaccactgtatagatgccagggaagggagcacagagagcagtgaaattggtggaagctgctgaaaccagctcctgaaaacctttgtaagctgtgtcaagggaaggttccatcctgtggatcatgggcagcatggtgggtggataagtagcagggtggtatggttagtttttctcctttggaaagttaattatggggagcatttttatgaatgaatgtggtgggaccagaagcaaaaagactggtcgttggtgccctttctccaccagaggaagtggaggtttcagttgagtccaagtagcaattgtgttgctttgtaattaagtacgcagaacatggaattctagagatcagtcaactcctagttgtgatatacaactggatttaggaccttgaaaggatttttcaaagcctctgagcctcattttctcaccagagaaaatgcagtggctctaaactcccagactatcagggttaaatgatattgtgactatgaaacccttggtggatattatgactgtgggtgtccttaagctcctggggcccttaaaggtcattccgtgcaaccattcagtacaactgcagagggggaatcggagagtcagagaaatgtccagttaattggtgacagagctggaattaagccaggtcttctactgtccatggacggtatttgaaggaaacacagaatatctctgcagataatggatagtctaagggattctgctaaaatgagtgccccccgcccccaaggccaagtggacaaggggtcacttgcctttcaattcctccaggtgctaggatgaggatgagaagcagtcatctgcccagcttccataaaagacacagggctgggtatcttggagaagagaatggtgttgggcactagaattgccgtctgtcatttctgccatgatttcttgggggaagagatataaatgtcactggagatggttctacacagcaaaaaataggatcaataaggtacagaacataagtgagaaaagtgcactatttctgggagacagaaaaatttgctttttcataaacgtgttgctccttattggctgtatattgccgtgcaagatacctcccttcccttgaccactgcaaaggggaatgatctcagcagataacctattctagtcccatctaactttaaaataagaaagcttataggcattgctacttagaagaaacagtaggagaaagtggatccaggagtctctctctctctctgactgttggagaggactgtccaatggtacataggctttctataaatggaaatgagctgtatgtccatgaagtaatcaagaggcttatgtcatccatcctccaacctgagaggacctaagtgagggtgcttgtcagcccaaccacacctgctctttgcctaggactactatatcaatttatttttcccttcacttgattattttatgtaaaaaatatttaatgtatttatacattaataaatgtaattatttattgttgtcccaggacaacaaagctgtgacctgaagccaccccagggaccaactattttcttggaataagggctggggaagctgcttatagggtcctgctagattgcccaggatgggaaaagaagtaagaaggttttctgccaatgtagacaccattaaatctgtaccaggggttcaaagagtcaaatacattcaggccagtggatcaacattgaatgtcaacattttagtcattcaaagtaataattctttattttttattgtgggaagagcacaccgtgagatctaccctcttaacaaatttttaagtgtatggtacagtattgttcactataggaataatgttttactgcagagtcctagaacttattcatcttgcttaactgaaaccttatgcctattgattagtcactaatcacttttcccttccccatcccctagcaaccaccattcattttgtctttggttctatgaatttgattattttagatacttcatattaagtgagctaatgcagtatttgttttccatgtctggcttatttaacttagcataatgttctcaaagttcattcctcttattgcagattgcagaatttccttttttaaggtcaagtaatattccattgtgtgtatatatcacatattctttatccattcttctgttgatggacatgtaggttgttacatcttggctatcatgaataatactgcaataaacatgggactgggcaggacagaaaaacaggtttgagctccatggaatctctccttatctccttttccatttccctagggaaacccaaagcctagtggttgcctgtgtttctagagcactcttgatgtgttccacaagacagggagcaatgtgaaaggagggaccaggtcttgttcacaccagcatgacagagaggggaaaaagggttactgtgttacttcctgacatctctagggctggaaggctgggaagaaccttggcatcactggaaggatggaaaacagtatggctctgcacggggtataagaaatgtgcagattgggaagggggaaaaggttaagattgggaatgtcaccggagccagtgtcactgaagaaactggaggaggggagatgatgagcgaagaagagcttaggggtgatggtagggagagctaaagaggcccctagaatgcgtgatataactctcctgcatgtctcctcccaaaacattcagtaaagtcaacattgctcagcaatgctttatggagttggatttgcctttttggaaggtgaaaaaaaaaaacacaggcggatgaaaacagagcatccccataaaatcagtcaccttggggatcacacttgtgtccttagtggccaactttgtatcatgggcaaggctcttttgtttgcagttctctgaagcctggcatgccatatgccctcagtaaatggctgctgaatgagcagattcactcaatgtctatgaaagcaggaggcttgtaagggtttgcctctctcttcctctccagcctccctccagttccccaggaacatagattattttgcagatcaactagggctttgggcaaagtttcagctggatttgttcattcttctctgatttgctttgactgtccttggtcaggattgcagccaacttgaaacaaacacaaaacaaaataggaaaacagaagaataaaataacaccagtatattcctttaaaaccctgtctagtgctaatagaactgacaagaggaaatagtatttaagcaataagagggctttgttcatgtcagagaatcctgtagctatgaatgcttcagatgcagagataagacccccaatccagccttcagagatgtgcttcaccaagctctgctgggagacaggcagctaagaacacaaggggaaagaattccaaaatgatacatgtcgaattgctggcctggatttcaaattccatagatagtttatgcaaagtcttgcgctgttgtaaagtgtaacacaatccactggcagatctgcctaaacccggtcccagttgtttttgagaaaaataaataaacttaaaaacgtcttccagcccatttaagtggctatgttctacccttagcctcctcagtgtgaggcttctagagatttgaataactgaagccatcacctaatttgtcagcaatgggataggagattcatggcatgtttcttctcaagaagttaccagtgatattcagagaattaatattgtgctttcagaacctatcaattcctagggccagggtgaggggaactttggcagctaacacatttcaatactttttgatgcttttaaagcaatgaaactcttttcttaaaagaaatattataaggcagctttatatatacaacaggtgagtgcagatgctctgtttgaaatagtagagtggaaactaagtagatcttctctacatcatgatcccctggccaacttcttcatggaatccaaggaatccatggaagacatgtgaaaacctattgtctaacccaacattcggatgtgcaaggtaaactaagggccaaaagacaagacaacttgttcaaaattgcacaccacattttggttatctgtattatccatattgtatttgcaactttactataaatatgaaattacttcaacaaaagttttatttaaaaataaaagtattaatgcttgcaactgcagattataatgcaaccatgtgctttgattagtgtctcattattataaagagaattgagacctggcattttccaagacctcctcgaagccagaaccattgcaagaagtaatggaaagagagacatttgaatttgcacagatttatagatgggattcccaggatggaatatagcatagaatatagatgggattctcagcaagatggtgccaagagtaagaaggatgggctgtcatagaaaattcagacctggtcccgttcattggagcccactgtactgaacacattgttaggaaaactgatgttgatggttttatatctattttcaatggctttctaagctaacagtttggattttttttaatttataaaattacatatgatgatgtaaaccaaaaccacctatgtataacaggtgtatgcactacctgaaattgacaactatacaagtttttcatatttgcttcatgtctctttctgtaagaaaaataacacaccacaaataagattgaggtccttttttttcctgactcccggtgtcatttcctttccttgatacacagaggcaactaccaccctgaatttgatgtatagttctctactctatttttaattcacatgaatcgctgggcaatatatagttttgctttgtgttatttttataaatgacgtcatgatgtacttatccatttgcaccttatttcttttttcctctcaatgttatgttttgcgatctctccatgttgatgtctatgagcttaccattagggcttcctttttatttggctagagaccatactgagccaagtgttaaactatttttatatcatccttgtatatgaatccagtttatttctcttactgttcctttgccataatagaattctgtcatgtgaatatttcatattttatacatttctccaccaacaggagaacatatagactatttccaatcttttcctactatatttattgtagaaatggatattcttaatccttgtatatacttttccattttacttttgtttttgcttgttttaggtgtttatgtttgtttgatcttgttgaggatatatcactttttttcaatagcatatgagatcctcagggctctccaggtcagccgtacttttcggatgagtagaatgcactgacaagacatgaaatgacaggcccaaattcacagggaagttttgtgagagaagccacattagagaccagaggagaagtactaatttgggatgaccttctaccaaagacctcaccgatttcaaggacagctcagctgttcctatcctctttccctcattgcactgttttctgtttatatttatatatacatttgtaattacttgactaatatctgcacacattgcctgctctaagctcttcagcatctgtcttttttatcattttgtcccagagtgtttgacaagcaatagttactcaataaatatcatttgaatgaatgaatgaaccagtaaacgaagtgacatttgaatatgcaagaaacccctaagtttgaagaatcctgcttgtctataaatgtttcctgtttcttttaatactgtttggtatttactatcattgagaatgaatttgtgtgtgtgtgtgtgtgcgtgtgtgtgtaggggtgtgtgtgtgtgtataaagtgatggaactgattttctttgttgatggaaaagcaaatactaatgttttcagtcttttctctgttgtaatatcacttggagcacaatttacagatttgttctaaaatcttctacttgacactcaagattctatgagatctaattgttcaacccacttttctgccactgtccctcagcctcagtagtaaccatttgatcacaacttaaggcgtttgatcaaacctaagcattctgggtttctgctttcctctgagccttgcttctgttccctctgcctgcaatgcccttcctcttatcactgccctactcttccaggcccaaatcaaataacaactcctccaagatttgtctccgtgagaatatctctgtcatctctaccatcaaaatatgttatctattatatccttaaaagtgttgaggattacctcttctacattagaatgtgagctcctggaccagattctggtcttttcatccctgttttttcctgtggtgccaagagcaaaataggtgaacagtaaaggtttgtaaaattgaatttagttgaacttctgacactctctaaaacatgattattttttctttatatttttccaggtgtgtcgaaccaaggtgatagatctcagtgaaggcatttcccagcatgcctggtacccttgcaccatcagctacccatattcccagctggctcagaccactttttggctccgggtaagctgaagctctgagagctttggaatctccagcagcgagccacagaaaacactgactcccatgaccctttctgaagatgggttgtctacctgctgagggtgttaattgtaagaacagggaacaaaacacttagcagtgtgatgcttcctgaaatggaatcctaattgctcatggaatgcccccactgagctcttgttttagcaaagagtttggatacatcttgtctgcctggaacctcctattcattgttcaagatcttttaaaattatcttttcctccttgagccttttactgatcaccagaaaaagaagtgaccattatctcccttcttgtcctgcatgtttggtcgcttgttggatggtacttgtcacatggtattacagaactgtctatggtctttctttctggctaaggattgtggatattactgcattttggcttgtgtgtcactgacctactttgaattcccaaaaatgcaagggccatatcttatttagctttctctcctcaaagccgagtgcagaggttgacatggagaagtgaaagataacagtatgcacctttttttgtgtgtgtgggttttagtgtggaccgggacctttgctacacactttactctcattatcttactagaacctcacaacaatcctatgatgtacctgttgatttttttatttttttttaatccaccatttggaaataatggaacttagacccagagtggcccagccattcactcaatgtcacacagctaagtatgagcagagaaagattgaaattgggtttctgatctcagagcctgtgctcttcactgttaggtttcattgcctcctccttcccatcttggacccctgatgagtagtagcccagttcttaaaaaggaagtttctcctcaaatgcaccccaatgtggctgcctccccaccacatgactgagtgcacatgtgaccctcctacgtcttcacaatttcaggcgtatttttctcaaccaatggttgccgcagctgtcattgtccacctggtgacggatgggacatattatggggaccaaaagcaggagaccatcagcgtgcagctgcttgataccaaagatcagagccacgatctaggtaagcatgctctcttggtcttggcttgctttcagtacctgattccacctctgccccataactagttgtgaggatcagcttagaatgagctcttccttcctttttcccctttcttgcttcttttctatttggcattctggttgccctcaaatcaagatgtggttatgtatccagagaaatcaagatctggcagatacagggataaggggccaatggccaagcactcccttctgccagccacctttaactcagacatcctgtattattccccacagaccccaagaaggagagagactgagtaagagccatttccccgttgtacatgtcaccatctgagacccaaagagaggcactgagagaccccaagtcacatggcaggtcaggaattactagttagattttcagcgtcatagcctattgctttttaccctataaccgggagtgttcatgaccctccaccccaagtggggactgtatcaccagtacaacctctggagaagtttccaatgagaataggaataggaatattgtaggagtagggaggcagttgaggagtcaggttctaccatgggaggacctccctgagtgcagggccaagggggaggacaagggctggacttggccacttgtaccacccctttgaatacccacatgcaccgtggtccagaggagagagcctgaatccagagctgacagctgaggtttggatcctgtccccaccactcactcaccttgagaaggtgagcaatcttcctgtcctcacagcacatcacttagaggctcacttgcttcacatacacagcaaggacaatgatatccaccttagagtcagagtgcactattatttgacactgttgtaaccatgcctagcacaagatcgggccctaagaattcctattgtcgctaagaatttcctatgacaccttcacacttccagtctaccctggagagctctgggcagcctggatactccaagtatttggaatttttggccactactgaagcctggacttcaaagttgtgcccacaccattctgcagagaacgcctttcaaagacctgtatgaagcaagccaggcaaggggtcatttcagggtcagataaaagccaagggagcagggaagattttcttgttttgtttttatgcttgtttatttagttccttttaaaggcaaggggaacctatgaataaggaagagaaagaaaacccctctggacttagcaggattcctgggaaatttccctaagtgagaaacaaatattttcatagttgtcgttgcacagcccagggctctgaggagaggttttttcagcagagtggggaaaagtctggttccacaggagctctttggatcctggtactgatgcctgaggcttttctgtttttcccctccacccccaccatcaccatcttcctcagtctatgacatcccagcattctccgaggcagcttcacctctggaactgagaagggcacctgcttcaggcttccacatgggagatttctccttacatagcaagcccgccaggacatggttaggattataccattttttggatgtgaaaactgagttttaggggctttctggagtcccattattaggaaggggctacaccagcatttaaactcaggtccacccaacaccaaagccaacttctgttttgctaattccatcttgccacagccttcctttccttctgtcccttgtgtatcttttctccctggccctctcccttccttcttggagaatgggaacctgctggctgcattaaaaaaaaaaaaaaaaaaaaaacagggctcttgagtgaggcaagcttgaattctccctagagttttagccatgcctgggctgtgcttctctggaaaaccacccctgcccacgattctcaacctcttctgcagactaagcaagaagtccttccctctcagggctgctcccaggttcacagattacttatgagagtgggctttttaccctgggaagcgcctgttgctatgaattatttccatcacttttccaactgaccaggcaggcagcctgaaactcagcaactcagaccaacaagccctacagcaatgtgggagggaggtgagggcctgggatgcttggctgaggggtggccatttgggggagggagagggactttgggcagtaggtgaaggggaagcttagggggcagggaggcagggggattggaaagatttggaaccaagaaaaaaaggcagacaaagaaactttcaatcagactcaaaatcctcaccggccgcccaatggtgcttttgtgcagtgacatgaaagggtctgggggcttcgggaagggcccgttggggagggcgtgactggccttgagtaatgagcctggcccctcggcccctctgtctcccctgacaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagaggtaagggatccgcggcagactcgccctaggccacttgtagccgagtggagacagtgtgattttgaagctgggtagccatttgtgtggatgtaaaaagtctgtgcatttctcccttctccatccatcctctggcctctggccggctctgccttgtggcccatgagtctctgaattcctggggcaattaagggaaacggttgtgtggtgaaaaaagaacctcattcacctggcttgcagcggcagaattgacaatagcttgcaggttgaccctggaaacatcggtttccttctctgagcttcagtgtcctcatctgaacaaaaagaggattagctctcttttatctctgaaatactggaatattctgcttcccgtggcacaagcaggaggcataaccttcctaaccaagggggatagagtgagactggtatttgcatcatcctagttcaccgtgtgtttcagggataggtgaaatctctatgtcttccacaagcctagctcctgtgacctcatgagtggtctaagagcctgtctttcaactgcatgacatcactccctcagtgcttttgaggtgccatctgttaatgcacctagtttggagctacaagcgagtggagtttcctgaaaagaatacgagctttgggaatactcttacttgggtttgaacctccacattaccacttcttgaatgggtgttcttgggcaagtcacttcagttttctgggtcatagttttctattttggaataagcagatgaaatctactccacagggtggttgtgagggttacatgttgcactatagataaaagtattcctgcagactgttaggcactatgcaaacataacatattaaagaagaatatttataaccatcttttgatgatgatggtgctgcttctgtgcacagaattttttgtaaagttcttaaagttagagctggaaaaagcttcagagattatctcatgcatctgacatgtccaaacttctgtgttaccatgtagaatcacagggcccagaaagggaagaacttgcgcagagttgcacagcgtctctcagatttgtttcatgaggtccagaagaagagagagttgtgatttttgtaggctacccaagagtgaggctctctgaaagtcgattcagccttgccctgtatacctgggggcaagaaaaaaaaaagagaagagggggacactagcctttcccacgcccctgttaccacagaggacacaaaaggtggttgcaaaatccacattgtttagtacccactgtctctagcttctgttgtgcaaagtctgtcgtaatctttcagaggcaagagcttcttaaatataattcattgtcttatttcactctaagaggatgttttccacaagcccttgttctccagaccctataaaaataagttaattctcagagcctagggaaaccatgtcaatggaaatccactagaccttttccacaacactttcccatttttaaccagccttcctgaccatccataagttgactgaggcccagactgacttgtttgaattctcgacgaatggtgtctgtgccctaagtaaatagtaggaaatatttaaccactgaaacatatcgattgatacgtatttgttagttctttggttgtaggaggaacattgaatgagggcaaaatgctgccctatatctgactaattatttgaccttggattagtcattccccttctctgggcctcagtttccccatctttaaaatgatgatggtggattgtgtggattctctgaggttcttttcagttctaaatctgtgtttctcaacagttaggaaacatgagagaggacaggaagggacaaacccttgttgagcccttaatagaaaggaacattatcttattttattattgcacctcttgaatagataggaacagtatcttattttattattgcacctcttctgcgaggtatggctcagagaaacagagtgagtgagtcatgaccattcaggcagtaagaggcaaaatcctgctttgtctgtccctgaaagccgtgctctgcctaccacagcaaggcacgagtagcagagaaggaattttcataactggacccatgtgatgatttattcagaggaactctgagtaaggggatggagctgcagctctgaggtctttggctgccttatccctgagcttggatcaggctatgacaggctgaatcttgagggctgaggctgcagggcaggagcacctcctcctgagtgccccagtggggaaaggacagcagctgttcatggggagctaaagaggcatttaccaaaacaagcaggactctgcaaacatgcaaatgcattaaaacaaacaaacaagggaggaaaggaaagaaaaataagcaacaactgtaaagaaccatgggatgttttccttcattctcaaaacaccaaaataaatagcatcactttttataacacaaatttcaactggttgtaggagaaacatcccactttactctcagctgtttcccaggtagtgaaaagtactgtttctcccctccccttctctcctccctccacaacctttcctctttttcctgcatctctccctctctctcctctcccttttctcccacctctccatctcctctctctctctctcccccgccccccaccttctcttacctcctttctcttcctcattttctgtctctcctgagagcagtgtgatgcctactgtgctgccttgggaggagtcctgtagcaaaaccagtttgggcaatgtgttccactctagcttcaggggtctccagtctctttgcagtacttggtataaattcagagacccaagaaaacaggatcaggtttcaaaggagaggtccagttgtgcaattctagccaaatctcagccccacaccaagttgtggaaaggagaaaaggtggggagggaaggatagtgatggggtgtggggtggttaataggcttctttaatgagaaaaactacagtggtgatattgaggctccagtatctgtcacacacacatacatgcacatacatcatgttcatccacgttgtggttcttaacagaaattgaacagtttattataaaattgaatggaccatgtatttagaaaagtaacttccttccctcctccctccatttattcttctttcctttcatgcttcctttcttcctctcactctttttcacattcgctttcttcctttatctcaaactcttccccatttctacaagctggtccattcagagagagacagttctgattgagagctaagttttaaaaggccaactttggggggcaacaagttcttcacatggctagattaactctttcagccagggagaacttagactgttgtttgttggttgggggtgggggtgcccaaagactggagccaagtatttctagagtctgtgccctgatgagaccccatgtgtagaatatctcattaggtaatgacacagggattcataggtaggatttggaacacagaatgaagctgctcttggccagagaccacagattgctcagatcgctgccataacctcattcaacttccccaacccacaaaggaattagtgcctctcagcacattgattgggaatcactagtctggggaatataactacaaatggaactgctgtgcctaagcatgtgtgtgtctttgactatgccaaatactgcctgactcttctccaaaatattgtccaattcacagccccatcagtgatctaccagagttccagttgctccgtatccttggcagtgcttgagattaccaagacaactttttcctatttttctcatttcaaagggctctgaaattatagacctctgttgttttgttctcataaaatcatgaggcctaaaagcggggaaggctctgaaagatttcctggttctgtgccctcatttgaggatgggaaatctaagttctaagcaagacaagtgactcgcctaaaatcacctaacaagttgggggcaaaaccagcactggaatctagttctcaggaatccagttatctttcctctccatcagaggtttcaaggctggtgttccatagaccatattagtccataaacaatctctctttggcctttattagttatctcctttaattagttgccaacatttaaatatcaggagagttcatattaaaaaacagaattcttcttggaactctttaaagaaatgagaagctttgaaaacatcaggccctccatcctactaggcaaccttggactagagcaaagcgctctgctctttggccaggcacataccctctcctcgacacaccccactcagctcgcttgaaccctgcaggctactgagcttgcatcacctaatcttcaaaacttgcctccataccacaccacaatacactggcgcctagaaatccagggtaaagaaccttttaggatcattcccccaggtgcctcatttctgggtagaaaaatgaggtcctagcatagtagctctttcactgtttcacttcctaagtgaacttgcagaattgatgccaagaacagttttccctccattttctagtgtggagcacttgtcttttttgttgtccccatctgagcaacccagaatgatttataaacagcctttctgtttttatctctgcttccctgtggcataattgcagctaagtggcagggcacagcagttacaccgtgagtcaaggaacagaaccaggagagggacccttgtcagccctttaacttctggctttatccgggttccagcactctccagctatcctctgttatgtgtgactggaatccattcttattgacaatggagacagcagtggggggattggctattggatcagataaggttttacctctacatggaatttgagtccaaaggtaaatatattaaacatatagataagaagaaaagaaaaacgttatttaagtatctgatcagctctgcaccccagggacctccacttttgcccaggtttgagaatttgatctatagaattacctgcattctttcccgctcatccatccaatcagccacctttctcccttcaaagaagtgtcttcatttttttccttcttttgttatttttattgactgcccatcactgttattaaatccttccctctttttttgaatgaagcagcagagccttttattttgttttccttgttttgttttttgtttttgtgtttcagaaatgacagggctgtatcacagagttatttgagacggtcagttagggtaatgtttatcatttttggacagtgtgttcacacaaccttgtccaactaacaggatagcaaagaaaaaagagcagggacttaggggacagactggcagatctctattagaattctttccaagctgagtgcccttgggcaagcaatttaaaactcttagtcctagtttcctgttcttgaaaatgggactaatatcactacctcaaggagttgctgtgtggaatgcaaataaggtgatgtaggtgaaacagagtggccaatgcctgacacatattacctcccttatcccttttcttcctgttttcaagcctgcaggccaggtgcagacagatgtgctgaaaaagcaagatgcctcaatccctgaagtgtattctggaaggcagtagtcctaagaaatgtcccatgaaaaaaaaatgttatcagagtttaaaaaacaatgtgtaccttagccccttctggaaattttcaatgggttatccaaattattgagaagtcctgcaactaagaaaactaactggtttcattaactcaatgctacccctactgatctgaccacgaaatcttttgatcaggtgattcatgggaccaaggaccattttttcttttatagcaaaaagagacagagtagagagactcatcttctcaaggagcttcatagttccagaagcatttctctcgctctttctctctctcttgccctctctttttttatttttatttttttgttttatttatttatttatttatttattttgatacacagtctcactctgtttcccaggctggagtacagtggtgtaatcttgtctcactgcaacctctgccctccagattcaagtgattcttgtgcttcagcctcccaagtagctgggattataggtgtgcaccaccgctcccagctaatttttttatttttactagagacagggatgcaccatggtggccaggctggtcttgaactcctgacctcaagtgatctatctgcctcagctcccaaagtgctgagattacaggtgtgagccaccacacccgacctcaaagcatttctcatatattggccttactagtctacaaacacaccaagctccatcctgtgctggaattttatacctgctcttccctctgcctgattatacctctgccccaaacctgtgtatggcttatcccttcattttacccaggtagtagtttagatgtcccttcctcatggatccttctatacaaagtgccttgcccctttccaccaactgtcactataatttcaccttggtttaacggcctaactgcatgcatcattatctgaaatgatctcatgtattacttttctttggcacacaccctccctcctgaaatacacaggataacaggcatcttgtttatcccctccgtccactatattcccaatgtatagaacaatgtctggtgctcagtaaagcccccagtgaaggtctgttgaatagacgaatcagtggatgatgtctcaccctgttgacaatcctaagaaacaaattattttattacttccactttacagataaagaaactgaacctcaggatgttatataagtttccaaagtcagacaactgataaatggcagagcaggggctggagcccagatttccctgattggtaaaccttgtgctccttctaccccagaaaacgaagcatttcagatcttcattttcctgtgaagaagaacttaatgtgcacaaaataattggggagggcactatttatactttaatggctctgcaacttaaagaagaaagtcatctttccctctgggtcttcataagagcccaggtaccttctgagcgtgcagagtaagaatgcccaaactgttaggcacaggtcagaacagcttgggagctagtagcttacagagtaaatatatttaaattggaaccatgtggttccttcccctggtgcttacacaatgtgaacagatgcattgtttagtgtcaaagcccttgtgttgactccacagttacagtctctttgaggtctccacatggtacaatgctgaggctgtcaggagtaagaaaaagggcagagaattggagttgtctcaacaagtgttccttaatgccagttgccctgcatttcagaaggagagtattggagaactgcaaagctcccatcagtgagggtctgagacctaaattaaatgcttgtcctttctgggtctttaaaaaagtaaattggtttgtgatatgctttggaagcttttagctccccccgcctccagactttatttctcactatacttttgagcagagggtagagaataggaatagatcccagtaaaaccctcagttgggtatcgtgaaactgagagaaaacaaaaaacaaaaaacaaaaacaacgacaaaaaaaaagtgcaaaacttttctgacactggtttggccaaaatgtctccctgtctcctagataaaaataggaacataaaagccttgaggttctagatgtaaatcatcggtgcatacgataggccaggtgttgggggtagacacagtcagagaggcaaaagtcagagaaaactgccccctagaagcttttactgttaggcagaatcaacctctttaaagtgtttaagagctattgcaaggcatcatcaccattggtttcctgccatttaggaaacatctgcaaggaatttttattggcactgcaaagtacaccaagatgaaataggcattttctctgccctcaaggacgttctagtccagaaacatgggacaaggttaacaacaaggcctttggagtcacccctctggatgggcacttaaacaagtaacctaatcttgccagtccccaatttacccaactgtaaaatgagtaacgcttagctcatagggttgttgtaaggatggagtgagctcatgtatataagcaatcagcaaatagtaactaatgttattgagtgcttgcctaactataatacaaggggaatgatcatccaagaatgaggatttcatgctgtttctgtttgcatccttaaagattagcctgcaatctgttatgttccactggcactgaggaactgagtttttaatacatcaaacatgaggcaacagcattatagaaagaagggtagaatacccatgagggtgcttgccgagggacacaagagaaagcttcctatggaaatttgcatgatgcttagacctaaagaacgggtggaattcagactggcagaaaggtagaattcagagttgcagcaagatgcaagacatagtctctgtacaactccactaatgatgtgtaagttatcttacagtttataaaagacttctacctccatcacctcagttgagtctcgtggctatatgaggttggccaaatttaagagtataccgaagctcagagatgtgatgtactttgccaactaggtaatagagcataggtatatttacaacatcagctaccacttatttttatttatttatttatttatttatttatttatttagagatggagtttcactcttgttgcccaggctggagtgcaatggcgcaatctcagctcactgcaacctccacctcccaggttcaagctattctcctgcctcaacctcctgagtagctgggattacaggcgcctgccaccacgcccagctaattttttgtattttcttttttagcagaggtggggttttaccatgttggtcagcctggtctcaaactcctgacctcgtgatctgcccatctcaggctccgaaagtgctgggattacaggcatgagccaccgcgcccagcccagctaccatttactgagtgcttagtatatgccaggagttctgctatgcgtttttttctaaactgatttaattctcaaaatgatccttgtaagtgggtactcacaaaatagaaaaaggcttttgctcaacctggtgcctggtagaaaaatgcaataaatattcactgtaatcatgatgatccctttctcacaaatggaaaaactgaggctattcaaggtttaaatcttgataacatacaaagctttcaagtggcaagatttgaactctggtttgtctgttgccataacttgtgctcttaatgagaaactttaatcgctgcctctagagtcatcttcaccctagccagcacccctttctgtcctcagtctcaagccccctgaaatcttggagaaagaggctcttagcctttatcttccaactgagcatagctgtcctgtgaggagactccttcttcccctcgtttctttcctccccagctgcgtgcacttcgcatgtgagaaaactgactgtccagagctggctgtggagaatgcttctctcaattgctccagcagcgaccgctaccacggtgcccagtgtactgtgagctgccggacaggctacgtgctccagatacggcgggatgatgagctgatcaagagccaggtatgtgcaggtgctgagctcagagcctctctgcagcccagggaaggcttactgggtgttaaccatgttctctgctaaatacccagcagcacttaaaatagtgctgccacatagtaggtgctcaataaatatttattgattaaatgaatgcatgaatgaatcaattaaccaagcaagcagtctggaatctctaagaaaaagggttcctgtgcagagtagtgttccacacaatacttaccaatgtttttgtgtaggttgcaaatctccaagaccatggggctgagtattttggaatgaatatcttacagtgagaacataattgaatgggctgctttatgacaaggtgagccctctgtcaatgagatgctcattcattcactaattcattgcaaagcatctgttcactggaaattggatgctatagtaagtactaaagaaaaagaagccattaagacaaatcgagtccttcttctgaaggagcttagtgcctagtggtggaggaagagtcagacaactcattaatgatgaccccactgtgtgataaatgctgtcaagggaattgtagggtgttgtggaggcacagagagattcaagggaggtgccttggaaaagtgacatggaaacagctaactagacagatcagcaaaggggtgtgtgttggggagaaggaagaaatatatgtagtaggcacaggcatggatagtatgtggaagcacattgatgagaaaaaaaaaaaaaaaaacatgccacagatttttttgtttgtttgttttctttttctgtactcacccaagcaatgaggctggaagggccagctgaatccactggtgcagggcctgttgatttagtcaggaagtgtggggttgatcttcaggacaacagggagctgttgcaggaaatgacatggtcagatcctggttgacaaagtctcttctagatactccatgtgggtgtagcttggagtctagcagtaagactggtagcagggagaccccctccctcagacagtcatcaaaggagtcatggaagataggacgtgtcctgcgtgagattggtggtagtgaatgatttggagtgatgtgacagaatgttgcttcagcaagatggtgctgtaatgtcccaggtggggcttgggggagtgggacaggttgtcctgggatttgaggatttctgtcactaaatgtagcattttccagggctggtcagtggactttgccttcaaactgcaagcacacagggcacattccttactgctgggaatgcctatttgtacagaacttctggacttgctcttcttagacacctacttccgtgtgtcagacttggcaggcctgaactcctgtagaaacaattagactgttttggcagtgagggacctcactcaagcacacatccctttgatgtgtgcttaagagggaaaatgtcctttgcttttaaaatcccagatcaacgtttggcatctccagtccctaggatttagcggcttcctccttgaatgaaagcctccaggctgcaatgattgtccatcccttgactccgtagcatggtcttgccctccacccagctccaccatcgtgtagtttggttcaaatctccatttactctttcatttttcctaggcttttttttgtctttgtacccttctctcttgactattgagccgccaaatctgagagtagggagtggatctttgagcagttcatgagttcaatccatccattttgccaaagggagaactcaagtaaggaaaagggacttgcctgtggtctcataacatggaggaaaaacatggaggtctcctatagccatggagagtgcctactgtgtgccaaacactacaacaagttcctagtaactcctctagagctaataaaagacatacaaatcaacacttgatgtcctaccattgaactgtatttcacagtctgttttgtgaaagaagtcatcatgccctgtgaggtctcaaaacctcaagattctcatcaataaaatggaaatcgtgatctgggaggcactatagacagcagttaagagcatagcctttggactcaagtccaacttatccttttcccagctggttaacttaaggctgatcatgtaatgtctctgagtctcagtctctgtgtctttgagatctgaaatatgtaattcatggagttattgggatcattaaaagtgagctaacgttaaacactaagcattggtctcctagtgcctgggcgagactctgagccgtcaccttgggaagaagggtatttctccacatctagagctcagtctgccactcctcactatgcacgactctgcctttcagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggtatcaagaacgccttccccagctcagccttcctttgtctatgggaaacctagaagctgcatccaggccctctttctgggtctcaaacaccaagggtgggatgggttttatctatgctcctgacttcttcctactaattgtatttatgtaaactgccctgctatgcagataagaaagaaaaaagagtgtatggataattatgacagtgaagccctttccaagaccttggaaatcttgcaaaaaagaaaagaaagagaggataaaagtgaagaagggagggaagaaggaagagagaaaaagaaaaaaaagttacatttgggactgatgaaactaattcactctgtatgattagggccagtaagccttatgaggtaagcgttactattattcccatttcacagatgaggaaaccaagcctcagagggtttaaagaacttgcccaaggctgcaccatcagtggtggggaccatattgaaacccaggtctgttgttctccaatgctggctgccactcattaagaggggccagctgggcagagaagagcagatatggacaggaagcatctggcatcctcctgagctaggcaccagggctattgaggggaaaaagacactggcataccagagaagaggtcacattttagaaaaaagtgagtagctggcctgggtgtcctagaatgctgggactagatgtggaatgtgttaataactccagactaggaaatcatacttctctcaatcaatcagaggcttttgggaaagggaggtgtataaattaacattgattattacagacctcattgtggctaataataatacttaatcaaaatgatgcagatccttccactgccaactgttgttggggaagtgtgacctggctggggagacaaggccttaggaggaccatcattttgacagttggtgatcccaactttgcttttcctttgaccatacagggaaatatctctctatttccatattgatcaactaggaccaattgccacttcatgcaacttggttgtcagcatcatctagtgttcagagtactgtgctgaggcttctgcttggatctactggcagcaaggactgggcaaaggtcctgctgcctttctcttgaacttgatattgccacctaatttgccctcccaccctcatctcaagccagggggtaaagaggtgatcaatttcaactttccttcttttacttgcttcccttttctcctttctaccttttgtttttcctttgatcataacatagtttaagcaaaaaggacaacagtttttttaaaaaaaacttttattttaagctcaggaggacatgtgcaggtttgttatataggtaaatttgtgtcatggaggttcattgtacagattattttatcacccagttatgaagcctgccttaataccctttagccatttttcctgatctcctacctcctcccatcctcttccctgtgataggccccagtgttagttgttctcctctatgtgtccatgtgttctcattatttagctctcatttataagtgagaagatgcagtatttgtttttttgttcctgcattagtttgctaaggatgatggcctccagttccatccatgttcctgcaaaggatatgatctcattcttttttatggccacatagtatttcatggtgtatatgtaccacattttctttattcagtctatcattgataggcatttaggttgattccatgtctttactattggaaatagtaaaagcactaattttaaacaggcaataaataataatgataataatgaccagcttgaaatcctttctgccctcagtttttgccccacctggccctctcctctatttgtacctcttgtccttcttaatctgtcttcttcctctgtacttccgttaaagtctaccccttaccaagtctacccccctgctccttgcaatccccccgtaccagcccttggctaatgcagccagttgattgagtgattgtccttattccagtccagctagtgcatttttgtttcctccaaacaatatagtggccaatattctttcacattctaacatgctagagatggacaagaactcagagacagctttggtttagggacaaacaagttaggtgatttgttcaaggtcacagataaattcatactttatgcattcaacaaatggataccgaggacctactattcgctcagcagtaggctaggctctgggagtaacgaatatacaagatacagcccttgccttaggatctagaaagtgccaacaccatgaggcaagtgcttagaataccagattgaaggtctagtatttctctccttgagttctgttctatgttaattttaatctttacagcactcccaaagagacttgatctcctgggtaatcttttaaatgaagtaataaaaataagtacctctcctttgacactgctacaagttgacaattgttttaatgctcattagagattggaatttccttacccacatttgtagacaggctgggcaggatgtatttttctgcattaaaagatgaacaagtgaacttacagggtcccaaaacttgacggacccaaaacttgatggaatctaatctctaatatcaacacctctatgaagagacgttaccctctaccaggaacttcaggctcagacatgccttcacttcgtgtcttgagtcatgttcccccaggaaatacggtgggggaatgaggacaggagacatggaactgacaaaagtcaacaggctctcttctaaagcaagttgccactgtgggcaactagagctcagtccctctgggaaactctgggagacggtggagaacatgcctccgagttattgcaactctggaaactggcacatgaatccaacaactccaccattagtttagtggtgcttccaggggcattaactccttggtactttaaactcaccctgcatatggacagagtaagcatcaatgaccagtataataagcatccatgagcagtataatagccctcaggcagagagttggcagtgcagtaagcatctttcacagtatacaggccagtgccaagaagacaaacgaagggcacatcatgtatcataccctactttcttcaaagccacattgtagatgcagggtagtggctacagctggtgcacagaaatactgcccagttgaaaactctcttggagtttgttgcaggggtggggggacatatccatggtcctgaatcaccagtgcctgctttagctgtggtgcactgctaacttctattcaccctcttccagaaagcacatttctggtttgcattttctctcttgattaacattttggaaactttatgttctcttgtcacagaaaaccacgactttcacttcataatttaccatatacatagctaatacaatgtactttttaagagtcccaacaccttttccacagatatgttatctctcttaggcaatttggagagggtgtgcttcctgtactttatatacagctccccttcccactaaccttgtgcattagctgggcaccccaaagcaatgactgccccgattacaagggcaatgcaaaaagaagtttgtagacactgactggtattctggacgcttctatgcttctatggaaaccaaatgaatcacctttctgcacactttactctttttacttgatgttaaaatatatatagttgtcagtctcacagtttgtcaatgtggaatcccctatggggtttacagacaccaatctgccttgtgctaaccagatgaatcatactgacaaagaagaaaaatgaaaaaaatgagaaggaataagataagtggaggagcgtacataaaattgcaaagtactttctcccctttcttccttttcctgctttttcttatagtacttggcaccttctggcacactaaataatatactttttaggataatttattgtactcctccctgtcccactagattataagcatcaagagaacagagctatttctatcttgttttgttttattttgttcactgctttgccttcaacatataaaagtatctggtgcagaataagcactaaatagatatttgttgaatgaatgaagacttctgtgaagattctttcagagctactaatgaagatgaaaagaagaaggaaagtgggaggaagcagggaagtgaagaaaggaaaggagggaagaaggaaagaagttaagaagcaaacgaagacattgacaacacttttataggcacttttcataaatgttgttttatttcatcttctcagcaccctgaaaggcagaagcaattgtttgctttccacagatagaaaaattgagatttgatggctccggaatgaataataagggccctgctgatcatacgtagtagccaacttcccattaaaaacaaccatctctgtagttagacagaatttgttttgaacctcagttttgtcttttgccaactatgataacttggtcaagtcacctctttctgagtcttcatttccaaataaagactgtcatactaaatgcactgtttatagtgagaataaatgagattgcatatcagaagcactcggtacatagtaactgcccagtagatgtcagttttctccctaccactccacctctccaacctgcaagtccccgagcccccgacatgtttccagccctgattgtcaacaccattcagtaataaccaggaaaaggagagtttggtggagaaacacaagtttcaggtcctcctctagttgtcttgggaaggttttaggcgggctgtgcctcgataatatatgagctggcagtgaaaagcctaactcccgtgttttacttttatttgcaacgttccccatcagaccagcttcccaatggcagtcagcactctgtcagagctggcatgggctacgggggaagtgctgctctttcacctgctttggcaaagcttcactgagcaccaggacctgaacagaaaatcaaatctcctaacacaatgctgtcacttccaggcattggtggtgggagctgggggaggtggtaggcaggacagatacaggggtgctgggcccagggggagagtggcagcttgaggtcatgcactcactgatatcagaatttgctgtagtttctggtgggagtttttgctgccaagtattagaaggcaagtgcctccatctctgtgctcagatgcccatttgtaaagtaagaaaaatggattcaaggattgtgagtgtgtcttttctatgcagcagaagaggctcaggatcagaagtcagaagccttggattttaattcactgtagacatgggggtaattcactccccccatttagatctcctcttctttgtggcagctctcttgatttccctaggctcctcagttggaagtagaaggggttggaattccacataagggatctcctggttcttcaagtcagctaaaatccaagtagctatacattagcttggctatcagagactcctccctcctctaaccctgcttgcctatgtcttccaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaagtaagtggggttggaaatgcaaacttatggtctctgggaggacaagagttaggttcaaatgcctgactggacggaagcactcatttcttcactggaggtaatgactgccattcatcccattctgttctgtgagaagctagaaggatttgttaataatattagctttgggtcaaacagaacaaactttaagtttcagcttggctgcctaatggcaatgtgatctcagacaaatgactttacttctctgcacttcattttttttttaagccacaagaggggtatgataataacagttaccacgtaaggttgttatgaagaacaaatgaagatgtgcatgtaaagtgctcacaaaatgctttgcacgtagtagttgttcagtaaatggtgggtaatcataacatgatggttccaacacacatcagaacactctgcaaaaaaggggagagaacctggggctgaagggcatgagttttgtctcaatctacatgtagctggaagcatgacatttctgcctgctcttgctaaaggagttctgtggatgaattatccttaattcctgcacgggtcccaccagaacccaataggtcaggtggggaatcaaaactaggaaataggaaatgggggcccagctggtggtgttcatgcagggcatggatctagccatttggtccttgagatgtctcctgtttgatcctttccttgaagacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccaggtaagcctcctggaacttgagattgataccatggtccctttcctttctgcttaccaaaaactagcctgtacttcaggaaccactttctgcacttttgtaatctctgatcctcattttcctacccgcaatactgtttttgatttgctcagagattcttagctttgaatttttttttaagcattggaacttttatgaaggaaatcatacatggaatcccaatgtatgaagttgataaaagttaagttcctcaaacaggaaatgaccagggctcttttcccagtttgctacctccattaccacccatgttggtccttgaagtatttaaaatcacaagactgcaactatatttagacatcaattggctcctgaagcataaggaaaaaggggaccatatttagatgagaagtacagttttgagaacaccatggaagaaaggaagagcagaaggagcaaggtttgaattttatctcaatccacatgtaactgagaacaagtccaacactcctgcctgcctctgctgaaggaattttcttcaaatcctacacatgcccaaaaggatggtacgggaatcaagaataggaaaaaggaacaaaaggctgaaaaaaccttaagtccacaaggagctccatctccatcaaagcaaccatgcagagttgataacccaagtcctgtgtttcacaggtgtgcaaggatcatcagccaggtggggatagatttcagtgcaggcgtcgtcttcaatcagtctttattggtctttattgttagcctccagataccaggcactgccaaatcaccattctgaatccctctcactccctccatatccaagcaattactgagtcatacccattctcccacaacagcatctcctgaagctgttctcttttgtccccaatgccactaccctcactcaggccaacatcaactctttgatgagccaccatgcagcttcgtgatcattttcctgttttaattcctgtgcctctttccagtacattcttcacatttcagccagagtgatttgagcaattatgtcaatctctctgaaccaggagcccccgtcccttaggataaagtcccaactccttagggtgacatttaagacccttcccccatgccaataagatggattttccccccacacctctgcattctctaccttaaaaagagttatccttgtacctttttcagctgtctgacacctcatcttccttcgcaatttagcccaggcaccctttcctgcaggagcccttcctcaatatcccttccactgccgggctccgtgcccctcctcaggttcccccttcacaacattggccacactgcgttgtcactgcctgctttcattccacatccccacactaggctgtgaaacagtccttcactgcatctgcacccttccctgtgcctctcagcacttaggacagtgccaggcacctagtaggtactcaggaaatgtcacaggaattaagggcaggaggaaggactgcaatgaacatcaaaggcaggttcctccttttacagatgagaaaaccaagactcaaagaggttactcaaccccccatggtgacacagctggcatcggctgagtcacagtcagaatccaggttcccctgtctccagctgtaaatgggctgagtccagtaggcaccacctgagaatcctgttctcatacactctcggcgtctgtttgcattcatgggagtcattcccatccttgactgccagggaggcagaagccagtaccggaacaaacaaaggctagagattaccacggcctcttgcaggctgatcagcttccccctcactcccttacataaaactgttgctaacagttacccaaactgctgagccaaataatattctggctgcggtcatgttatcaaactgaaactcagcctgcctggggccttccaagtaactttcatggccagtttgtatttaaaggagaggaaagtgtaaatgtatcagacgactcaagcagctctgtttggcaactaacggagaggctagtcgcaaaggagcagggtattgcttgtctgctcaaagaatgagggtgtgcgtgccaaatggactcctaatacaattgacgtttctactttgtactgaaaatgaatttcctctaccctcagatcagggcctgagagccaaatctagtattcacctcagattccctcttgctgcctataaacatagcagaaatgcatggcccagagcatcttgaatcagcttgtatggagcagggattctttgctttccaaacaagtttcagatcctggcgggaaaggataggggctgttgtaggggagagtcacacactctcttccactgccactaaaagcaaataaaaacctgactttattcattccttgggagccagtatgacactggatctgtagtttgagttcaaatcccagctttattacctagtcactagaggccaagttacttaactcgttaagcttcacttttcttgtgtataaaatgaggagaaagaatactacatacctaatagtttgtttgtgaaggttaaatgaggtaatgaaaatagagcatgtctatgggtacccactggccttgtgcagtgcacaacctgtgcaatcatatgtggtagccctggggaatacacaaatgaactagcctgctttaaggtcactccagtggcgagaatcccttatgctctatgtgagctcctggagggtctagaaacacaacagattgcaacctagccctctgctggctagctctaaaaactgagaagttttctgttttctgcatatggctagccagttttcccagcaccatttattaaatagggaatcttttccccatttcttgtttttgtcagatttgtcaaagatcagatggttgtacatgtgtggtgttatatctgaggactctgttctgttccattggtctatatatctgttttggtaccagtaccatgctgttttggtttctgtagccttgtagtgtagttttaagtcaggtagtggaatgcctccagctgtgttctttttgcttaggattgtcttggctatatgggctctttttggcttaaaacctagatgacagtttgataggtgcagcaaaccaccatggcacctgtatacccatgtaacaaacctgcacgttctgcacatgtatcccagaacttaaagtaaacaaagcaaaataaaaacaaaacctgagaaggaggcacccatcctgcatgaggccaggatgtggagtagagagaccagcatgagctttagtcaaacctggtcccttgctcaaataaacctgtagaataaatagtcctctagttcctgtagaccagcactttccagtagaactttctgccatgataaaaatattcatatctgtgccaggcaaatgatgaccactagctgaatgtagctatggagcacttgaaacatggttgcagcaaatgagcaacaaaatgttaacttttatttaatttgaagtaattcaaagttgaaggcaaatagccatacttatacagtggctaccatatcagatagtccagctctagcacttacggtattctcgtctctttaaaccatgacagagaaccttaataataacagctttctttgtctttgtttttgagtgtcaaatgtgtgccaagctgctgctgcagacttgctctcttttgacagctcacaacatacagctggaaaagaaacaaaatccccattttacagatgcagaaagaaggcccggggagggtaagttcttgcccatggtgacaagagagcaggtgatgttctttctgatctctagctctgctctttccactgctcccaaacatcttcaggccagaccagtagtgaagggcagagattttatccccagggggtgagaagctactcatctcaggatttaatccagctcagatggccctgagctagttgatgagataacataggcctgtgggggctttataggtgagtcagggagtggccagtcttgggatggggacggggtctttggaagatgcatcagcaggggaggacaaaagctagaggtgctttgtgggcaaagtgatgcacctaatgatggatttcagcaactcagcaggagcaagagagaaagggagcggtggaatcttcaacacacccagctcattgcacagatcacagaaggtggctgtgaaagcctttctgccataaggggtgtagagctgcactctccatttgtgagccctgccatggacaaggtacagctcacatatgtgcagtgcctcagctaggttttcatttccgggttgttaaatgtttggccaagcacccaggatgtcctagaggaattcagaagagtcacagacccatgtgatgttagagctaggcaggacctcagagacccccactgtagcttgcttgttttactgatgggagccctaaaccccagaaagggaaagagacttatcctgagtcatacaagcagagccagttcttaaactacgtcactttgcaattcacactttccactcatcctcccttgtggggcaacatgtcacccctgtaccaaccttggaagacacaaaatgcatgtgagggcattgactgggaacagagacaaatgattcacagcagttgaaataatgagcacttactacatgccagccactgagatgagcacgttagattgattgcttcatttaagccccatggcatctggcattattgccccattttacagatggggaagctggtgtaaactggtttgccctgttttatacaaccagacatggtggaactgacactcttgtttttaagtcagcatgcctccaaagcttagccatctagctcctgcactcactgcctggttttgtcttgctcggatgccactacatttctttccgctattattttgtttattttcatgtcttctaaggagaagaagtctactgcttctccctcttccttcctcttctcttctttcccttcatcccactggggtacaacagcttacagtcaagagacatggttctgacattggcaacctttgtgacttgggcacattgcctcccctttctggctgctgtcagttccaaaatgtactgttggttgggttgattctaaacttctcttagagacagtacagcaaagtgagtaagaacctcatctgacgattacagagctcagtatgtgttaggctttaaatgctttatataattggactcacatgatcctcatgatcactctctcaggtagtagactccatgcccatttagcagtcagggaacttgaggcatagagaagttaaagagcatccccaaatctacccagctgggaagttgccaagcttgcatttgaattcaggcagtttgacttacacccaggctcttaaccatgacactagcatcatttgaaaactcactttttcactttctaacagagtcagtttccaagtctgcaaaaataatataatttctactctactgtattgttcaagtgatttttaaagcactgggcatgttataggtgtttgataatattattatatgccttcagctctccgtggatctgtgtagctaaagcagcaggggagttagagctcaatatgcgcttgtaaaaacagatgcacaggcacagagaggcaaactgttttgctgagagattttcagccctcttataagagatttcaccttagcatgaagaattgtacaactggagtcaaacatacccagtcagttccctgacaacacctagaaaaagtaccctctggtcttcccaggttggagcttcagtgatgccagatcttctctggtcaaaccagactcagtcagcaataattgactatgaatttctgcaccaggtggtaggcaatttctgaatgcactagcatctagtcttaaagaaggatttaaaaatccaaagaggctccagaaagtctgcatgcagagggcacagcaagggcaaagatgtggaggtgggaaagcaagaaaagtttgcaggagaaacaaagtgattcatttgtctagcaggaaggatacatacatagcaagagatggagctagaaatgtcatctggattccattgtagaagccctgaagtgccaacctaccagtatgccttgttctgaaggctaaagtgtcttagcaaaaggatgctatatatttttaaaagcaaattttgcaacacaaagtgccagatgaactgggcaggagagagataaaccaatgataacaaaaccagtgctttatgctcccacctttcattcatggtggggcctccccagtgtgaaactccatgagcagactccggctacttctaatacattctctgttacaaaccaagctctccagccagccctggcccaagtagtgctgaggtctgcagccctttaggggttggaatccaaatgcatcacaggcccaggccaaggctccaggaaattggggtcaatttcctactccccagagggcccaggagaatcatggggcctagagcctggggctctgagaaggagagtctgggctctttgaagccacatgaagctgcgtaagtttgccacgagcccctacagaacctctgggagtgaactctgcaagccgccttgcagctgcatgctcaggatgggccacccttctcccaaggccagagaggtttccattgcaattgtaccctccttttgccggcaaaggagaggcctggaaaggggcccctttctcttctgaatcttgtctatctgcagctgttttctcacataggggagcctcagcctacatcagttcttttaaggagtttattcattttctcatacattcattcataatttattccctcattcattcttttcttcatttactcacttgtgcatttatttcctcatctgtgtgttcatttattttcttatttcttaaagaaatacattctatcactctccaccaattcaccccatcttttcgtaaacaaacaattcttgaatgagcaaaaatatctattaagtgatgaatgaatgcactgagtggcctggaccttttaggcattgtggaaaaccctgaggatacaaggttgaatagggcaccagcctgggccttgaggagctcattgtctggttgcaaaacagatgataaacaaataggtaatgtcctgtcagagacattcaggtagtgccccatgcagaattgagatggcaggagagcaggatgggttgtgccagataaggtatttgcaaggtagacaagggtgggtaggaaacaatagcagacagaaggagcagtgagcatgaaagcacaacatacgatgccttcacaaatgcaggcaatttaaactgaagttcaaggttggtggtggtgctctggagagcaagaaactggagaattaggcagaattaaggctgggagggctctggagccagcacaggagtttgcatggaagctgaaggtcacaggaagccattgcataaatttttgcattggtggagcacagccagctcctctggcctcatgtcaagtttctcatcttattataagcctgaaaggggtagagaatatatagcttgttcttagatccttcacaatatgggccccctgcacagaaaccacctgtgattctccatttctgttcggtaaagtctaaactacttaagttggcatttaaggctccacgctttatctgtgttaccagctcatcttcccctgcttcatgccttgagtcatagaattagaaccacaacaggctctccagcacacacgatatttttcatcatttgcacacgcccttccatcttccaggaatatcttctgttccttttctgcctgcaattccatgcatccttgaaaacccttttccatatatcatctcctctaagaggccttccctgattgtcccctcataaccagttactcttccttgtgtactcacagcactggtgtgatatttgccctgcctcactgaacacagtcacactgacatggctggtggatcacatgactgccattcccactagatcgcagaggcaggcactggctctcttcacttctgcaccccacagagctgggcacagattggacactaacgaatcttacttgaattagctttctgaaattcggaggttggaaggggacgtcaagaagggattatgtcttcaagctgcatttgcctaatgctttgcagaagattgagaaactataattccctattttaaagaattgggaggaaagcacagatatataagtatccccatatcaccctcttcatgccattattgttggaatggaatgaaatggaatagaatggaatggaatgaaagaaagagaagatgagaaaaggaaaagaaatgtcttggaaaaaaagcttctcagctagacccagattattatttatgacagagccctgacataggatactttctcactatttaagaggaagtaaactttagtgttcctcattaacccatgctgctactctctgtgtcattcaaggagctgatgggctcctaccctctcaatttaaaaaaaaaactcccacacacaaatcaaaactataattggctctgattgaaatttctgaaagactactaagctcggacttgggagtttggcattctggaaagccttgaacaagtttcttcctggtctgagtcctcagtttccccatatgtaaaatggagacactaacaatacccctctttcagggtggttgagtttcaaccattgttaagaaattgttttggaacacttcagagctctggagagatgaaaaattcttttctgttgtattcagaatagcttattcaattggggctggtgtctctcttggtcctaactctgtttctctgttgttcagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccataggtatgatgggcccgagaggggagcagtaggaggggcaattccttccagcaatgcagggctaatgcctgggtgggtcattgaacaccctggccacatgagttcctgcgtaggcactacagaaagagagatgaattagtgtagaccatgtcctcccagaaagagggtcagggacagggatatggtgacacaatggtgggtgagtgtgcacagttacaacagaatacagaaaagctgtcaggtgcctggtggggacacagaagactcccacaggaagggatgcttacttggggatttgaaaaagcttgtcggggaagaaatgctattgcaggcagaagaaactctgtggctgaggagcaggagttatgaaagcacacatcacatttagggaagcaatagcagtctggtgcagcttcttttattattaatcttgaaatttgcatcatactaaacattcatgagtacctgatatagttcaggcccttcatcaagcacttgaaaggcattatatcttatcctcacaataacctttaacagatgagggaatcaaaacttgaggggataatggaacatgctcccaaatcctgagacccatcctattccaaagtctgacttctttccatggcatctcagctgcatccaagatgagcataaactgcattttcaaaatactctttgcatggtgacaggccagctcgagaaatacacacagtgagaagagacaagctgggattgtatgccagggatttgcctcgttgaaaccaggtgtctggacacatgcattaatcaccagcaccacagctttccggggtactcagagtgcatggagtgtgacctcatttaagggcagtgatgctgaccttttgggctgattccctaattgaccatgatgaaaagcctagggaactgaacatcctttctcctggccaatatgatttatagagcaatcaccaggggtgtctggtgtagaaggttatctgaatgtgcatagagccaacatgatcttcatccagcaaacagagagttatcactgcatgtccagaagcaaggcctgtgtggttggagagggaaggttcatggggactgtccatccttttttgaagatgaaaacacatgccctcagatagcagaagttcttcactgtaacttacagtgggaatcagcactcttgtgtttagcccaggacactggctcctgcatgggtcagaaaacaccaaaacacatgattgctctcgctgatggtttggaaggtactttaagatcttatacagccaccaattcatgagatgctgaccaggagtgttgcagagagatgggatcttataggacctgctaatataggcattctagaaggttgggcaacaagtattgccatggtgagcagcatgggctgcaccatcccaaggccaacactttctcctttccatcattcctgataggtgtgcgtggtcctgaacaagtatgtctgtgatggggtcccaacctccagctcaatcagaatatgcaagtgaatattcattcatactcttaactggcattgagtggctctgtgagaaaaagcctaattaagtgacctttagggaaaacctacagaaacaaatttgctgcatatctatacccactgacacattcaaatacattcacacgtgcatacataaacgcatgccacatgctgaaatgcttcataaacaaacagccccaaacacacacatcatatagtaagctcatgcctaacacctacacatcagccaaataccacacaaatgcatcactctcacaaacacatacacacacaggtagcacataaacctatacacagcactcacatgcaatacatacaaatctcatacttcaacaaacacaaacacattttatgtcccaaaacatatcaaacacacagaaagacgcacaaaaggcaaacaaacctcacagacgcatttacatattttattcagatgtctcaactgtacgcaaatgagtacgatacctggctgtcttctctccatcagaacagtggagaaagaggggaaggggtgggagggtggtatttctttacccactgagtgttttcatggtcaaagcagaaagggaaagaaatctatatgatattgcagcctgaattaactcctttcctgtaccccaagtccccacggctggcacccagatgtccatcttataaatgtgataatccagggcagatgatgagtgcatagggacactggaggagatcagagagaaaaagccacatagggagacaggaagactgagggtgagaatgagaaacaaggcaggagagcagtttttgctcatccactcctcagccccagctgtatcctcgctttcctccaaatgcgcctgacttccacctcccaggctgagcccttccctgaggagaatccactttgccaaggagagggatttgatcactggccttataagcaggggtgagatatgtgtcgggcttgggggctggagggcacattctggagtcacccagaccagctccccctgcgtgcctcccccaggccacctggggaggcttctgtggcagttatgagccctcagaaagttgctgctgctgccaccagggctgccaccctccccgcgcctcccgggaaggagacgcggaggcctggtgagatcaccactctgtaaggatgccaataatggctcatatatcacaacacagcagcctggtcctaaagccccagagctggggtaggggaggagagcctgggggagggagacgcggagaaagagaaattaagacatgaccgctgcataggacagcaagtgtctcctgttttgacaaccgtttttttttttttttcctctcttgggataagatagcctttgtctatttctcagaggctgcatttttttttttcaaaaggattttattatcacagccttgtctcatctttgctccctaaaaactcctttagaactggtctcatgataaagcacactccataagcagtttctctgactgcttagggatttttgctccttattctcatcactcatcatttttgtctgtgttatccccatttcttgtctctcctctggcctctcaccatctctcctgtttcgatggctgcctccttctctcctctctctgtgtggctgcactgttatcgattgtggggcctggaattagagatgtggctctctcctcaccagctttgtgccctgagctttgtgccttttggctctccaacctgtgaaacgggtgtcatgtacatatgtatatttggaagggggcctctgaaatagctaatacatacatatgtatatttggaaggggggactttaaaatagctaatagaataggatatttaaagaaaagagttgacttgctcctagtgtttggagggtggtttcgatactaagagaaatggcctctttcaggcctagtcagattctgacaggttgtttctttgcccacatgaataaatgcctctttggggtactgagtactttccatggactaggcttgatttttcagatgacctcaggatgtgtgaggtcagggtagagaatgaatgagctgaattacagtcaacttgccaacccacagcctggaagtcaactgtcttcacccaaaagttcctggaccaagggcttctatgtagtagccctatctctattagtcatttaccccttctttgactcattacctgattttttttattcctttatccatttaatccataactcactcattcacttatccatttatgtacttacttcttccttcatacgacacctaaatgcatattcatcagtcagtcatcatgccattcatttatccattaatccactcatttcctgatccattgatgtacttattcactcactgtctcttgcactcattttacaaatacttattgggtgcctataatctgccatgcacagtgccaagctctggacatagaatggggagcatgggtagtgctggccctatagagttacagtccagcagggaagagagctattgatatcacactcaccaagcaaacaggaaatgatcatgtgacaattctgtcatgggcacctaggaggggcttggcctgtcaggaaaccatgaaggtcttctctgagcaagtggcttgggattgaggtctgtaagatcattaaaaatgcacttgttggagtgggaagggtctttaaggcacagggaaaggcagggatgaaaccctggggcaagagaagctggtattgcatttatgtgctcatcattcactcggccagtgctcactgagctctacctgggtgtcacacgctgggttaaactccgagatgaatcaagcacatctgatgatggagtactctcactcagttgtggaattcagggcaaacttcttagaagaattgaactggcccttgaataatggatagaattcggttatgggaaggcagattgggggacatttcaggagatgggatgaacaagagaagaagcacagaggatgagaattgtgggactcagatggaaaaccaagtgtagttcagtccggttgaaccaaccaaagagtgaaggtggttagtgagagaggagattgaccagaccgcaggaggcactgagtgcccagcaaagggggctgtattttgttctggatgtggggagccttggaaaggtgtttgagcagaggaggagcttgatcaaactagggtcagagccaatgagtgtggcagcaggaaccagtcagatgggaggcatgtgaatggagtcagggagaacagaggtggccctgcctggcttgccttctccttcccactgccttcaggttgggtagctgagtccaccagggaccagggagtgggagggcccactctgcaggagggcagtttgcagatgttgagggtctcgggcctgagctgcgcctcatgctgtacttccctcagggtcggagtgtgccacctcgtgcctggaccacaacagcgagtccatcatcctgccaatgaacgtgaccgtgcgtgacatcccccactggctgaaccccacacgggtagaggtgagtgaccagggacatctacccacctgcagctaagggggagggaaatgatattgttgagcacttgctatgtcccggttctgagttcattctttcacacatattacctcatttaatcatcacacctgccctgtgggtgtgtgttgcagggaggtggggtagagtcgggaggagacttattcacaatcatttctctagtccttaattatttaatactttctctctgtcaggtcctatgtgaagggccttttatttactgtccactaaatgctgatgtcagcctaggaataaactgaggcaccaataacagaggtagggagcatagagccaggtttcagacctgagtctgtctggctggaaagtccatactcataaggatggtgttgtatggcttctctggtgccctcccatgtagccttccactttacatagcctaggtttctggtatccttctccaagctttacctgttttggggaaagcaattaataggtgtctagcaaactagtaacatcggttgtttgtggagaacctgccacgttcatgtgtccggtgcttagcacgaagactccattttagcctcagcacagttgtatgagagaagggtcattgtctgcattttccagttgtggacactgaaatctcggaagtgaggtgatgggccctgaaccaaggcttgaacccaaacctgagtctgagccctgtgtgcttcccacagtgccaggccggtgtgcccccagccagatgactacagaggccccctcctcagggcagtgtcagtttgacttcaaggttggctgttcccactcgcctttgtgtcacccaatcaactggggcccccagagctgatgtgggccctgcttttctcccccaggacatcgcaggtcccaggccttatgtgtcactctgggcactggctcttcaccctggagaaaccgaaagaaggaggccggggttgcggggtgggcgaggttcagctctgtgtctctccaaccagcctactgcctggggtgctgagaggccatggagcccagggagctactgtctgcctgcctgctgcagatcacactctggatagctgggcagaacctgatactgggtgtactgtttctcaaatgcgctgagggcacgattgccagggcttactcagcactccgagtgtatagacctggccagacctcctccactcctctgtgcgccccggcatgctcctccactcctttctgcttcctctttctcttttgctgtctctttttctgtcttcatcttactctcactaatttttttcctatctctgtttttccactctgtttctctctcctccctcttctgatatacctttcctcttgttctgtcttcctctctcccacactctcctttccatcatccactgtttctctctctctctctctgcctctgactctctgcatatctacaagacagccctatttcccaaacctcaagctctttcatctgtttcctccaccattcctgaaccagaattcctgcacagattcccccgagtgccccagtgcaccctgatatgctcatatacccaggcatgcagggagcccacatgtcagaatctcaaggcagctagagataatcaaggacaggttcctcattgtacagatagggaaactgaggcctatagaggaaggcggctggtccacacaggcagcacaactggaacgacaagctggacttgtgattggcagctcttccaatactaccagctctccttccttttcccacccgaactcccacatacccgaaagcaggtgagtttgactcacacacaaaacagacacaggagacctccctctcaccccagtatcagagatcttcttggcctggaccagcctcccacttaagacctttttcctaccccctgggcaaattcccacccttccctctgtgggccctgggcactaaagagttcagttatgattcactgtgaaataaatccagggatttgaaagcctgcaagctgccccccctccccaccattgcccacccgctgcctgcctgccccatcccccaacccagttccctggtctgcctgcctttattgatgctggcctaccgagagaaccataatgaggttcagacctccactggtctctggaggcctcattatccaggaggaaaaaaatgtggtagaaaaagggaggagggcgaagggcagagattgatgatttccaggaataaggcagaaaagctggcctctgctgcacccttgccccttgtgcggtgagagctacagaaatagagctgctggtgccagcatttccaggccagaggaggccctggatagctcctctgctttctgagggtctgcctgcgagcaccagtgcaatttagatagctgggggtgaggctctgctccagctgctgccacttttatccccggggtaagagagtgagaggcaagaactggcatttattgggcacttgctgtgatcaggcactgggtcaggcacttcctatcctttatttccacctccaccccctaccacacacgtacgaccacacacatatgtccctatcaggtgggtattagtctcttcctgcttccagtggaagtaatggaatctcagaggtggaagccacttgcctaagagaaggtgaagagagacccaggccagtctgatagtttacttcagctatccctgcagcctctatgaaatgtagagtaataaaggcaatacatttagtgatggcttaccagggatgtgctggcaaatagttaacaactggctctccacaaacattagactctgctttgtagcatttcccaatttctgtgatataaatattcctaccgtggcagatttcaaggtttccaggttgctgtcactgagcacaaagttgggaagatccaggcactgctggctcttgcgagcctatgcaagccagctgtggtccaccaccgacacttagccaagacagactctattttaagtcctttgcatatattgacatgaatgaagagaaagatgactgcttagatgagtggaatgtcaacactgagatcacaggtcatgatgtggacaccaggacagtgagctttgtgaaggcaggaccacggtcatattagttaccatagtacctcccttggtgcctagcacacagcaggtacttgctaaatatttatgattgctgagtcagatgacccaggttctagtgtaagctctggtgccttcctgctgtatgtcctggagcaaatcctgtcacttctctaggccacagtttacccagttgtgaagtgagagctaggcttcactcaggagtcacaaactgaaatgccacctgaaccaggcaggtggagaaatgagtgaagcaggccaaacatactcttttgtatattaaatactgaggcagccgggcgcggtggctcacgcctgtaatcccagcacattgtgaggccaaggcaggtgaatcacctgaggtcaggagttcgagaccagcctggccaacatggtgaaaccccgtctctactaaaaatacaaaaattaggcgagcatggtggcgcacacctgtaatcccagctactcgggaagctgagacaggagaatcgcttgaacccaggaggcggaggttgcagtgagctgagattgtgccactgcattccagcctaggcaacagagtgagactctgtctcgaataataataatgataattaaaaataaacactgaggcatattagtagtagtagtatttactgtaaatattttggaaagaaagacttgcagaaaaatataacacccatacacatactacccaacttaataaataaaaactttacagatactgttgaagttcttttctacttttctttttttcaattttttatttttatttttttttagtggagatgaggtctcactgtgttgcccaggctggttttgaactcctgtcctcaagtgatccttctgcctcagcctccttcttttttattgagctataacttacttctttaagtgtaaggcattataaattgttttgggtacactcatgaaaccactactcatattaggatgtggacctgtccaaatcttcagggagtcctccctccccaggccaggcaatttctccagcaccaaggtaaccactgttttgttctctattgctatggattggttttgcttatttgtaaatttatttgtagacttggtccctatcactacgaattggttttgcttatttgtaaacttcatataattagaaatcatgaggcattttcataagtgtgttttcaacttctataaagagaaacacaatgtaccttcttttttgtgtcctaaaccttctttttctcagtccccttccctgtacatgcacttttcaaagtgattagaggtacagagaactcttcctctaatctaataaacaaaatgatacaaactcaataataggtggaaatgcccctcaggttcaatgctagagagaaactgcagggaatggtggggactatggcaaactatggaaaacacagttgttgtttttctgcttccaaagggggacagcattagccaagtgcagcaatgtggaaatgtgggcctcctgtggccaaatttttcattttttcttgggtacaagaaatctggagttcttaaaatttgaaatctctttctttttttaaaaagtttggcaactaattttgactttttttaaacacttgtatgccaaacaaaacatttctgtggtttgtgtagcctagaagctgttggcttgcaacctttggatgagatagactattccagtctggagacctagaattctggggtggcagcctgtctcccatcagttcctaagaaatagatccaatttgctcacacattgtcccttgcccagggatgctgagagtgtttcacaatagaaagtgcatctccctatcctcagaaccttataatgcctttaggtgctgagaccttggcttttataatagcttctgaaaaaaaaatgggaggcggaaagagagggagggaatgacttaaggaaagaagaggtaaattgccatttattgactatctctaatatgtagacatggtttgctaggcaattctatatatgccatttcattttgtctccatcactccccagtgaggtaaggattatcacgttacagatgaagaagctgaggctcaaagaggttgtcattgcccaattcacataacgactgtggcagaattagctagctaattccactgcattccatcctgcaagggcaaccctcatacatgtcttttaaaaatatgcaacacatgcagacagagaatgcaaaattcagttgtgaaaagaaggtagttttgtggaaagccctgccgagtgtctaaaggtcagaggtcgaatggttctgagtgactgttaagtccagtctaactgacctagagatggagaactaagtgcactggaggggaagcccatagacaaagagatgcagccagaatctactgatttttttcattcatttatggacacgctcatacattcgttcatttgattgtccatttgttcatttacttattcaataaacatcgactatgcacctccaagcagatactcttcaaacactaggaatacgaagtgggaaatgcctaggcttttaaaaagcttaccctggaaagaagccagaaactcagtggctgataacaaaaagcaaataattaataataataataataataactgatatgattcactcatagcaggtcccagaaatcaaggaaaaaagctaagggaaaaagggcttatcttagaagacatccaggaggggtgtcagatctgagcctctggatgagggggctctcttagatgctttctcacatgtctttggctctgcttggggcctgtcttcttgggccttcatcttttagatgctctacccactccaacatttgtctcaaagggcctctccacctttctgaactttggtcttcccatcggtcaaaaaagtaagctattttatacttacagcttcaggggatggtatactttgaaggagattatggcgttcaaagcctagaccttaaaaccagataaatgtgggtttaattgctgactgtcactacctatgtgtacgatttggggcaggtcatttaacttctctgtgccccagttttctcttgtgtaaaccagagtcaaaaatagtacctatctcatagttacggtgagaattaaatgagatgaaagctctgagcccagggcttagagcataatatttattaaatagagaattttgtgccgatgaggatgaggatactgatggtgatgatgatattgacgttggtggaggtggtgatgttagtgatggtgttttcatgctggtgatgatggtggtggtagtggtggtgctatgatgatgatgataaaaagaagatggtgcagatgatggtggtagtgttggtggtggtgttgatgatgatgatggtggtgatgatgatggtggtgccaatggtgctgatgatgatgacagtgatgatgatggtaattgcaaccaggaagaaaagatagtctattcttcctaccaccaaggcaggaaatgaaagccttcttacaaaacctgatctgaaaaagctctggctgggctagatgtctcactggtatcaagaggaaaaaggctgacatctgaggggccccatctgagatctcccaacttctcctgtaaacagcctagccaatccttcagctcccactgcctgtcccctttcccagttctagcacacagaggggtcctgtagtgagacaggtggggcgtgcagccctgagtaatagtggaaaatccaaaagccttggaaagataaataggcttatgcagatagtataaaagtcctttttccaaactcacgtcaggtaaacctcaactgacagaaacttgtacaaccacaccaagacactcctacagatggattaaattagctctcaaataaacaggggaaggcatgggcatcgaatccctagtggattctaactctgctgttttccacttcttgaacctttaccaaatgccctccaacatctctggattttgactgggaacagactctcatactgagagaggaaaatctggttaagagaatgaaagcaggtgatcctcttcacccagccccatggctgggaggcagagggggaagaacgtagcttaattgaaagaaaggaatactgaaacaacccaaattccctcatttgtatttgtatcacattccttcatgtatttcttcactgtgctccacgcttcaccctggaaggatacagaagtgtctataactcaggatctgccctcaagaaacttaagaaattggtactaggtttaccattttcacagcatttatatgaatgcaccatctcaacaagtctatgatgttttcagtacctatcttgtggatgagagaaccaaatctcatagtggaaatgtacaaagcaattccaaatcagaattgcaaccacatctgtcccatatcatatcccatgacttttcccatataccactttatgcgtgtactggggatgggtagacaatttcaatagaagcagtaagatgcaagacagtagatttcacattgcaagactgattggaagatcatcaagttaagctctttctccaaggtctttgatttacttgaaggttgatagtggctacattcagcctatactaaactgatcctctaaactagacttgtttagaggacaagtctagtgcttgaccttagatgatcttctgatgctctagaagacaggaagacaagtaaagaaattattgtccactggtaaaatcatctctattttgagaagaatctgttcctttataaaataaatatttatttagcatcccctctgtcaggcattcctgaaggcatggcatatctaatgtgaacctgagattttatggagcagagaagaaaggcacccaatccagtcttggggtcacctgattccctctgtcacagcctcaccaagaggcctaattacaatttggctaccatataggtctgccctcagggagagaataggctgtttacatggattttccacattttggcccaggtgactcttcattttttaattaaaattaatcaactggcctctcagtcagttgaacaacctctgatcatgtggacttccatagttggttgttcacagttacctgtcactacacatctaagcatgtaccattttattttatttcattttattctttaaagaaataattgtaatctggcatgaaaactggggcatccatggagaatagaaaagggaacttccaggattttttttttttttttttgagacggagtctcgctctgtcgccaggctagagtgcagtggtatgatgtcagctcactgcaacatctgcctcccgggttcaagcgattctcctccctcagcctcccaagtagctgggactacaggcatatgccaccacacccagctaatttttgtatttttagtagagacggggtttcaccatgttggccaggatagtctcgatcttttgacctcatgatccacctgcctcggcctcccaaagtgctgagattacaggcgtgagccaccacgcctggccaagcttctagaatttttatggtaactgtattcctaatactatgttatctttctagtcttatttagctttcttatttcacccactttttaaaatatcatcatgttggattttatgttatgagctttattaaatcatttctgaaacaactggttattttcaaatcctggtttctccaccaaacagctatggagcatggggaatttactctcttatgacacaagattaatgcccacctcacatcatcatggcaagaaataaataagataatgcatacagtaattagcacaatgaatatactcaatatattttagttgtcattatcttcatcataattattatttttaaagaggaggctataaataagtgcctataagctctgcctaacggggctaggaaaagtgccaaagaagacataaattttgagcagacatttaaaagattctcaaagtgacaaaatggggaagggcattcagggaaggggaagagcaagaacgaattcactgtgggcaacctcagagaactgtgggcagaccagtatgacacggcagcaggtgacagcagaggggttctctgcctttccagggatttgaaccataggttggttcataatagcccatgtgctctcagactgtagtgtgcattggaatcatctgcaaggcttgctaaaatgcagagtctcagggcctggtctcagagagtccaattcattaaatccaaagcaggtctgaggaatctgccgttaattaaacacactcccacggcaatgctgatgaaagtggtcttcagctcatgctttgagaaatgctgctccacagttttctcccatccgcctgctgcagtcacacacatgtatgcacacatacacacacacacatgcaaacacacacatgcgcacacacacacacacccctcctccccccaccttatcccaactccacgaatgggtcgaatattagtcgagaattttctgaaaggcctttctgatcgtgtctctaccctccagttctgcttctcctcaacccttgttcctgccagggaaatacagaaccatgacacatgcggtgaacacaaatattattttaatcttgtggctcctgttattgcaagtacccgggcaagttctccatgtaaaagccagggtgaggtcaggaattggaaggtcccagaagaggtgaggtggttaaatgtaatgccaacacggaggtgggtccctcccaatcccaagcccatctgacctttctctccctcttcccacagagagttgtctgcactgctggtctcaagtggtatcctcaccctgctctgattcactgtgtcaaaggctgtgaggtgagtcacaaggaaggcactcctcagttccctggaaataatcctgctgttgttattgttattgttatattaatgttggctatcctttgccatacctactgagtgttgaaaatatccatttagcagacttcttggacagggattagcagccttattttacagatgatggaattgaggcacagagatataaagaaacatactaaaaagcatagggaatgggtaacagagttgggttccaagccaggcttttgtggctccagagcctgtggtctacaaaatatgggatctgtaagaaaggaagggcagggggctataatgatttaccatctagaatatgctaatgttggaaatttaccaacattgttacatttaacctttacagagtcaggtgaggtggttttatttttaatttccattttactgatgacctttacttgcagacctattccttctgccccacatcttagtcatttactcatgcctcaatcccagaaggaatatgaatgccttagacctaaccattgagctgaagtgaaagagcctttataacccttaaattctatgacttcacagttgagccattccttacagcttggaattatagagatctgtctctgtgtgtcagtgacaagcttgggaggactcaaggagcatggttcttgggagatcagctgtgtcctgaagggagggctgtccacggaactcaaagacatttctgcacatcactctgccccttgtggctcttcccagctggcagtgaaaaagcggccccaaatcccttccaggtggatggccaaatctctgtggttcatccagagcccactgaggcaaacgcaggtgaaaaggatcagaccatgccctagaaaaagtcgtatctgatgaaactcttagaatgccagaaccagaaagactcttttacctaatctcaactaatcttttatttttaaaatgggtaaacagagacccaggcagtggctggatctaaaatttgatggaatgccaaaactgggaaggctcttaatttgatctagctctattttcttggtgtatagagtagaaaacgagggccagagaggggatggaatgtccaagtttgcacagcatgataaccacaaagacaaaacgtaagcccagctcttctaacgtccaggctggtgcttttctcctgctgcctgcctatgatccattccctgatctgtgtcacaagacaatccctaggttacacatttttttctctgcattgttgagggatttcctgagggcacttgacattgtacttgactttaggaaccccattctctcaggcttcaattaggaatggcaaaatcaaagccaaggccctgtggctgttgcttacttctgtctttttggatcaatccagcattttgggaaaagaaagcttgagttacctgggcactcattctgctgagttggcggtctgggcaaccagtgtgacagcggaattcaatccctccttggactcagcagtgagacccaagagaccctcacctgtcagactctgagccctgccagtgatgtttatcacctttgcccttgcaggtgcccctcatctcctgtcctctttagctttgttctaatagtgccttgtctggagctgaaaattatgcttagaagacatacaaactctgggactatcaaccttgaatatccagaggtatccaagataaagaaagggtttggggacccctgagcccctgttttctgcaccatgctgggtccaaagtgatcattcactcacttgttcaccaaagcttcactgagaacctcttatatgccagatactgttccagttctgggaatacattggtgttagtccagtgaaaatagtaactatgctctccttgagtcatctatgatatcttcttgcctgtcatccatccatccatccatccatccatccatccatccatccatcgttttactaaataaacatttatggaatctatatttgataaagttttgcacaaatacgagacattttgctagcaatctaggatacagaaatggatgatgcgcacagtatagtgaaggagatagacaattaaagagagaattttaaaatcctgaagagctatcacaaaatcaaatacaagaggctatggcagcagacagcatcctgaggctattaggggtggcattttggagaggtaacatttgagctagatcttgaaggatggtttgtttgtctgaatgcgttactagtagaaggagcaacatgagataaaccagagacaggagaaatctctaagtaccagagcttttctcatattgttccctgtctctagaaattctctcttctccacccccacctaattaactcctactcatctttatgatctcagctgaagcgtcatttcttcagggacttcactgagctccctgtctagatcaaatctttctactttttaatagcatcacaaacctcttctccatagctcttatcagagttgaaattggttaattagatgtgtgattatgtgattaaagtctgtctcttcaccagagtataaggtctggaggggtaggaactatatctatattaattcactattgcatccttttccttagcataatgtgtaacacatcgtaggaattaaatacataggatggaataaggataaatgaatggatggatggatggatggacggatggatggataggtggatgaaaggatatggttgcaggaaagaacatatagggtagagtaactagtgatgggactggagaattttttcagggccaaataaagaagtatcaccttcatttaatttttctcttttcccctagctacttctttatcaagccagttccttttattctaaggaagggacaattagtctccatcattattctgttcatttattacataaaaaagaacataacccacaggcagatctcctgaggcaggaaggaaaagaaagggtttattgtttgttgtttgtttataccccactgctctaatgtggatgtgatgtgttcattctggtggtcacacagcagagtcacacctgaacccacagccatatgcatgcacacccacacaactgagctcaggtcttccttgctctcagagctctgtctagctgtgatcttttagactctagtagtagagtgatgaaatgaaatctggcatcatgagttcagggtgaaaagtttctgtgagtaagaatttggaacagagaggcaaaagccaggaatgccacatgggatggagcttggttctttctggagcagtgaggatgggaaggggagaccactggatcacagatggcatgcttggatgcaaaggtcttaaacaaatgttgtctctttcccatgaatgagtcactgatctttagagaccccaaccagcactttaatcagagtggtttcactttcatctgctttctatattgaaatgtcacacaatatggcatttgatggtgaggagaggggtaggttcactgttttgagaaatcaatggactaatctggcctctttatttcattagtgggagtcctgaggcctagaggagataaggtcacttaaccaaaaccatgaagtaaccatcccattggctgaggttgggaggactagaacccaggttttctcaatccctgccaactgcccttgccactatgccggtacaattacattccacttcagaaacattattaagagccaaagttgtgtgcagccttaaatgaggtgattgggagtcaaagacaaactagacattgcccatgtccatgaagagctcacagtcttgcaccagctacagaaacataaacagaccacagaatacaatgtgctagcggttgggatgaggaaatacaagtgactggggaatccaagagactcctggactttcccctaataaggctctgggttcagataaataatggcttgactctattatcttttcttcatcttgggagtgtcctggggtggagaaacacacagaagaaaagaaataaatcagtatatgccagaacagccaagagagatgaagtaaaaaaccatagagccaacttagatttaaatcacttactctgactgtgccaatgtgattttgggcaagtccctgtctttgagtctccgcatcttcatctgtagagtgagaaaaccaatacctacctcacttattgtttggagagcaaaagaagaaaacaaacatgtaaaatgtgtgacatcaagtacatctgccctccttgtgagagggagcccactatcacacacagaccatggtgccaaattcctatgagttcttacattttatcttaatgcttcttgggcagtttacattcagcttcctaacatatttgcatatattttattacaaattacgtttttaattacatactgctgaaaaaagtgggagaaggaggcttacatttcctggtcatttctttgagtaaaatgagccctctttcaggaagatgtaagccatctattttgtggttttgcatacccaagcacacaagagtatgtctctcagcataaccatactctagttggaaaaaactgggtaagagtctttatgaatggtagaaagaaagataagagtctttatgaatggtagaggtgataactcattcaagggggtgttggggatgtgaagcctggccagctaatcgtggaaggctgtgaaaagatgacagacacccgaaggactgcagacgtcagctcccactcactccaggatgctaacaaggcctcatttcctccttctgtctccctttccagcccttcatgggagacaattattgtgatgccatcaacaaccgagccttttgcaactatgacggtggggattgctgcacctccacagtgaagaccaaaaaggtaggccagtgtgcactcctcggcagctgcctcctgcccacttctccagcttgtggggccaggatcactccttcatggctggacaacccttgtcctaactctgccagcactgtccacacgctttatttctttttttaatttttattcttttggtcagtagttgaactaatatcataggctgggccctggttgatttttgcagatgtggttctcaaagcttagaattgggtacggaagcaggtaataaaactgcaataagtactttcggaaaggaaggacaaagtgcttggggggctaggcaaggggtcagagaaggcactctagagcaagaggcatctgcactgaaacttgagggataagaggaaggggtgaggaggtggtcaaaagaacggtgtctggagcaggagactggcatgtaaaatcccagtgagaacacacatttttagggggtagggctgaagtctaggaaacagaaaatagtacatccctaatgaggtcatttacagtctttgagcattttattatctatcttatttgtcacacctgtagaattagagaaagatggtcatggtcatggtattttttctttatatcaggacacacccaggagtgattcaagtgtttatagtaaaccaaagaaaaacattcgatagatgcacattaacccctcacagaaaagtggccacctccatttttctccgactgccgctgagaccagagtgaggagccccagccaagggttgggagggaggtggtaaccctgctagcctgggctgagaagcgttcttgtgatgaatgagttaatggaaaactatttctatttttatattcatctgcagtcagagctgaaagatcatttcatctgtgtcattttaaagaagggggaactgagtttctgagacaggaaaagcaaagaatcatagtcaatcatgcctaaagagccctctatgactatcttggcccaaacgcttcattttattaataggggcactgaggcccataaaagaggaatgatttgtcccaggtgacaaagtgaatgatagaaagagtgaggttcctggattccaatcccagtccctttattttgcaacatccttaggagagttggtttcttcaagaaagaatctctgacccaaaatacaggaacaaatgggacaagacccaaggaacacattctaatcagatggctgttagttactgaatcttttggttgaggaataaaatttctgggattgtccaggatcagtcagtcccaggtgggcaacagttttcagcatgcctacccttctttggtttcggtttggttttgatttttgattgataggacactgaagacgtacaatttttgcttaagtagagaaaaataaaattcattttctgttaaggaattttatcatttttttctaattatgaaataatgcatattggaaaattcagaaagaagaaaacaaaagaattcacttattatcttaaaaaccaaagaaaaccactgctttttattttggtgtattttattctgtgaattttgttaagtaagtgtgagggtatttttgtcgtctgtgtatatatcactgcctttctagcttgcaatcttgttttgcttagttttgtttacttagcacaggaaatcttagacacaagaattacttgcgctgagcacagtggctcacggttgtaactccagcactttgggaggccaagatgggtgaatcacttgggaccaggagttggagaccagccagagcaacacaggcagacccttgtctctacacgtaattaataataataataataataataataataataaagtagccaggtatggaggcacaggtctgtagtcccagctacttgggaagctgaagcagaaggaccacttgagctcagagaggtcaaggctgcaatgagccatgatcataccactgtactccagcctaggcgatagggtgagaccctgtctcaaaatttaaaaaagttctgatagtagtataaacttctcagctgtattttttgctgcattgttgtttattatatggctgtgatgtatgctaatttatgtaaccatttacttcaacttttatttttaacttttggattatttcttttttcttataattttaactaaaatgatgctcatgagcgtctttgcacataaaatacttttatagctctaattatttctttatagttgattcttacaattggaatgccaagggagggatgtaagcatatttaaggctcctgatacctgtttccaaatgaatatagtgaacaatattatctattttcttccattggagtcagccacctttgaacgtgaatggacgatgaagtttgtatttgaaatagaagtttttacagaattatggctccatctgacaccaacggttggagaaagagcagctctgtttaaaataatgttcctatctattgtaacttaggtactaaaatataaaatatgaagctgattttttgacagagaactttccaaaatggattcctctctctacagagtgcattgtgggaatatgaagtcatgagaccagcctcgccaagatggtgaaaccccgtctctactaaaaatacaaaaattagccgggtgtggtggtgggcacctgtaatcccagctgcttgggaggctgaggcaggagaatcacttgaacctgggaggcagaggttgcggtgagccgatatcgtgccactgtactccagcctgggtgacaaaacgagactccatctcaaaataaataaataaataaataaataaataaataaataaataaataaataataatttggaatccacacctgaacctcaatctcatgacttcatagtcccacaatgcactctgtagagagagaatccatttggaaagttctctgacctcatgatccacccacctcagcctcccaaagtgctgggattacaggcatgagccaccgcacctgaccagattccaaattattatagtaactttaccgtatacatatatttgaacaccaagccaccattttggctctctgttcccatactcagttccagtgcagcaatttcagactcccaggccccaagataagcacagactcttcactaaggaaccccagaaccagttctttgctagctctgaatgcatttcatactgttgtttcctccttgtctacccacattataaatgtagttaggctttttgtgttaagaaatcctcttcttccactttaaattcttgtttcttcttgttggctgagggtgcagaatgcagatggccaagctgccttcatccaatgcggtgaatctccattgaggatctctgtgtgctcagcaccagaccaggctgtggacagtatttctgcccttgtgaaacgtgtagtctattagaggagcctgttattaagcagggagccacacaactattgcatttaattacttttgtggaagaggcaatgatgagaaagtgtgagattttatggagaacagcatgaaggtccgagaaagcttctctgaggaagggacatttacatggagatctgaagagggaacagagtcttcctggtggaggtgaataatggttgggggtagaaggggaaaggtctcttaaaactgtacatgaagtatggattagagagactaagggcctcctttatggcagataggactttgccatcattatttcagttgtggacaggtgtttggggcttttcagatgcaagattcctagaagtcttacttctggaaaagtgtctcagattaaagtcacacttcctacaatttagatttcccagtttgacttttaagggaactccaacttcttgaaacttttctcctctttcttggacacccccaactactccctgcagtagactggcttaaaggtggtgctagatggagaaaataaataagaacacaagacttccctaagtgaactattgcatatttcagacactctgcgagacacttggcctctgttatcctctttaatcctcttgtcaacacagagaggtcactattcttattcccatcacacagatgaaccagtctgggcttagagtacatatgggacttgcccaagttcacttggcaaatgagtggggaagcccaagtttgaacccagttctatctgactcaaaagttctgctttttctcctgcatggtgctgagtttcagaagaagaaagcatgcagggtgcctgtgtccttggcacaccttggcatgaccctccctgttctggttggaaacatttcaccatgagcccagactgccagggaactttggcaaagaggagagcagcttttcccagtagcagcaaagatggggtcgggggaagataagtctcccagccttcccatcatccctgacatccctggcagcccagagaggagtttcccgtgggcatccacagaacagaagaaagttctggtttttgtttccatcttccaccgcaggaagcctctcagagaaggagagaggttactttcctttcatgcctctgcccttacctgctggacctgtttaggtcccacttgtcccctcagccccagtcccatatcaagagacaatcccttcccttacacacccaggctagcgctcagagaaactcacccctgggtgagtttcaagcaccttcctaaatcacaggaattcagttaactgagcacttaatatgtgcttcgctgtggcctggatctctgtgcatgtcatctcacttaaactccagaataattcagccaagtagagcactgaggttgagggaaatggaataatttgtacaaggtgatagagctatgtttgggatttaggatttcctaactgaacaaatggtaatagctaagagttattgctttgctttacatgtcgtttcatttcatcagcacaataaccctgttgtagatgttgttcttttttctttttcttttgagatgaagcctcactctgtcacctactctggagtggctcacttcagcctcaacctcctaataagctcaaatgatctttccacctcagccttccaaatagctgggactacagacacacaccatcacaccatgctaattttcatattttttgtagagaaagcagtctccctgtattgcccagactggtcttgaactcctgggctccagtgatcctccagcctcagcttcccaaagtgctgggatcacagatgtgagccgccatggacggccctaggcgttatctttttaatcctcattttatagatgatgaaactggggcttagaagggttaaattcacacagttagcaagtggtaaagctaagatgcaaaccaagagaattcaagctgcacagcacctgcctctaaccccttggaacatccttttgcagcaggcttgtgtcttgcccaagcgtcttgtcctgccccttgtgggtgatattcttgcttcatagacctccaggaatggagttcttggtatgaactccaggcccagagttaagcactcagcatcttctcccagacttccttcttgccagttttccacctaaacttcttcccggttcccagggctagggcctccgtgatgccttggcccagcatgatgactgtctgctcccttcattctccctcccttatttgtctgtacagacaccagctgttccccacatccgccttatggggtgacctgggcccggctggcagacaagagcaagacggtgcaggaaactctgtctgacaggggtgtccaatttcccacccagacacctgcctgcagtgtgaggcagacaggaaggggcaggactcagcctctcaggatgtcagtttattattttcctgttggagccttgaggagcctcaaatacaaagcagatttccagaatggttgctccagtggtttcccttcatgacaaaaaaaattcaatttataattggaatcattctaagtaagcacgtgttagggtgtgagggagaaaagggaaacaaccttaacatattcaacataccaaagctttctaaggtgtggtggcctggaacactagttgtggtcatgtttcagatggctgctaagagagtgattcttatagatgtctggggagttggggtatagtcctggttctgtgacttattaactctgtgaccttgggtaggccagactcactttgggtttttatgttttgatatttgaattagattcctgtctaataactcaacataacaaggctttctaaaaatgtgcctaaggactcttcacatggcttcctggatgagttggtcattgagcaggaagttgaaggctagttaagactgagacctacagagaataagaagaggttaatcccagaaacacatctcagcacaggatggtgcacccaattcatgcaactatgtgtagggctggctgcaatatttgctaaatgacagatttactaaatcttaaaccctacctaaatgagaacatggtttcttaagaaaagacattatacccaacatgtagcacattggtcattggtctaagaaggctagtgattctataagatatggaaaaataatcaacatcattacatggagagcaaccttcttagcagagtgggtgataacctacattgacaaagggctggatgttgggtagctgacttggggatgtacatcagtgtctcttcttgacctagcagccagaataatcctttttttttttttttttttggaaacagagtctcactcttgtcacccaggctggagtgcagtggcataatcttggctcactgcaacctccgcctcccaggttcaagcaattctcctgcctcagcctccagagtagctgggattacaggcacacaccaccacacctggctaatttttgtatttttagtagagacggggtttcaccatattgctcaggctggtcttgaactcctgacctcgcagaatagtccttttaaatccagtcagatcatatcacacctcaatgcaaagacatacagttccttcccattttacttggaatgaaaaaccaaagttttcccaatgcctacaaagctcttgggaaaatgtgggtgctttgcccacccacattgcttctctgactttgccccctttccactgtctatgccttttcttattcacctctggcattctggaccccttgctatccttagttcagctcaggcatccttctactttacagcctttgtcactgtgtcactggcaatttctttggctaagaaccctcttctattcatcctcatgactcactccttcacctctttcaagtctttgcccaagtgccatgttctcaatgactccaaccctgaccacccaacccacatcacccctggcactcccacactcatttgctttgccttctgtttttttttttctttctttcttccctaatacttatcaccctggcacacactataaaatatatttattatttatgatcagatgacccctactcctcttgatgctagaatgcagaattaatgaggataagaatgtgcttcttgtttgtttattgatatattcaaatttccagtgtacctcattgtttcctgtccaatagtaggtactcaacacccacaaataaatactttttgcatgagtgaatttagggtattacctgctgtgtgacagatactgtactaggccatgagcaagaacttggtcccagctgaatgaattcatgtcttatggatgagtagccagacatttagagtatagcaagtactcatggagacacagcaagtcaggaggtcagcgaagtttcccagagaaggcaacaccaaaggcaataaatgaaaggtccagaaggtatttcccagatgaaaggagtaaggaaggaccagagataggggtgggagggaaaagggtatctttggcgagaggaacagtctgtgcaaaggcccagacaccagggaaagtgttaaggaaattataattccctgagtatgcccagagcatggtgcaaggggaaaagggataaaagataagcctagatggataagcaaggcttttatcacccaagccagggagattgaactttatccagaggccagtggggggtattcaggaggatttgaagcactgagccagtgtagggaatcccagaaggccttttggaagagagagtagatatgcttaacttggaggattagtaagagacaacaagcagatggctaagcacactagactaactcttccatgttcaaaaattactggcttctggaatgttattaaaccctctgcctccccctgccccccgctttggaatgtagccctgactttttccttatggatgaagtaggcactcattttagcttggtcctatgatggaatccagcccttctatcccaaaaacttatcagcatcattatcaatgttattaccaccaccatcatcatcattacctcactgtcaaaaccatcaccaccatcaccactagcatcatcatttattgagcccatattttatgccatgcattattctaatgctttacttgcatttcatactttacccaacatacttctgtgtggtaggactgttagtacctcctttttacagatagagaaactgaagcccagaaaagggaagtaacttgccggatagcatacacgaaagtcagcaacagggcaaagactcaaacgtgtctttttctcctctaggccagtgctttcctctaatttacccatattttttccactttatcctccatttatccacatgaccactttatcttcatttaaacaagcttcgtatacattaactgttccacgttttatgccaggtactgtatccatcctacctttaagaaacttacaggggaatcctcgtccttggcatcatgcctttatctacttggtactcatgaaatctttccatcagcactgtcaagaccctaagactcaaccaggtgaagtgacctgccagtgatgtggccccccacagccagcaggagacacagtcaaagctctctgaccatcagcacaacatgactgttgtccctctccaaccggcacccccaccatgctctgctagttacctccctgtggagtctgagtcagaatccagcccctgcatgtctctcagctctggacaggatctgcagccagggccttgtggtatagttgcctgagctgcattcctgagccactcacactcacagatggaggtgttagcctcagcagctcacccagagggagaacccatgtgccggagcaccatctctagccccgagtaaaaacaggagagaatcctggcccttaatcatggacctggcttgctaacacaatcccagagtgggtggccaagccatttatgggacagcctagccacatggtgctgagaatccccaaatgtaaactggccaccatggtgttcatgctgtgggtggtaggttttcttgggaggccgcctgggggagaaggtggggagctgcttggggagtcagggaatctggcagttgggctcagagctctgattttatcaagatgtgattcttctctccatgcctcagtttcttcgtctgtgaagagaggaccctgactcctgctctgccgtcctcctggggcatggtgctgaggagtgccaggccacctgacagcccactgattcatctctttgcatcttagtttcttttaagatgtaaaatggggatagtaagaatagttacctcttagcattgctgggcagagtgagtaagataatgatgcacattgagtttagctcagtgccaggcacataataaggataaaggttattggtgattaaaaagacaaagcagcagtcagccttttcaggttgtgaagaaaataccttttttttcccccttctttttactctcacttgctgaaaagctctcaagtgtttgaagtggggtttggaatcctgcatcaccaactcactgactggtactgaggcctgagacaggttagttttgctttaaacattctgaagcctctattttctcatctgcaagatggggagctaataatgatagtctcccaaggtggtgcagagtcagagagctagcatatagaaatcatctggcatgtggaaggccctttggaatcactagtgtgtgtacaatggtattcaccgcttgagcctgcatgaacaggtgtccccaagtcctttccaggttagacctagcaatacctgaaaatctccacccttttcttctcagctttatatctgtgataagtgaggaagcttgtaacagaggaggctctgaacaggcagttcacaaagaggcaagaggagggaagaaaacaccatgtgtctcctctacattgggcactctgagagctggactggacctgacatgacttcactgactcctcactagagcccttcgaggtcttgataaagacccttgtcttacagatggggaggctgaagtccacaagatgccagggacttgctgaaagtcatacagtttctgtataaagtctacaacatattacttacaagcatgtagtggagacaaggaggctctggataggcctcctgagaccaaccctcctaggctttgtcatattctgattgagtttcctccagtgtttatttcggaagtgctgaaactgcccagactggcctggggaaggaagaaaaaggtgacaccaccccagcatagccagagtgccaagaccggcctgagaagctaactggtggcaaggccttaccagccaacaattttggagaagctgattgaactggggaggacaggaaggggagcattcaagacagggtctgtgaagaaattctatgtttcaagttcctttctggccaggtctttgccttctacctttctcagactgagaaggattttcagccagatgagaagttagaagctatgaaaatcaactcttattataggcagggaaacaagctcagagaagggaagtaacttgtccaaagtcacccagcaactgactgtaaaagtggaggctccctgacttgtattctgcctgcatattcatgcattcatttgttcattcattcatgggtcattgaatgcataaagactgagttcaataacagtcatggtccctgcccagagtgagctgacatcgaagtaaagaagtaattcagtatcagaagggtgcaaaaataagatgctgtgatatggtatgaaggtgatggtgctattaggttggtgcaaaagtaattgccgtttttaccattactttcaatggcaaaaaccacaattatttttgcaccaacctaatatctttggtcagactactgagggaggtagtgatacttgcgaaaagacctggacaatgaaaaagagctggccagggaagagcagtcagagtggagggccattagtggctaaggacacaaaagtaggaaaacagagtatctggggaaccaataaataaagaagccactgagagtgaggaggagaaggaaaccatgtaagatctgagacttatgtagaaatcagatcatgcaaggccttgaacttgtggtaaggactttggattttattctaagacatataattttttgaatgtttgccttgagtgaggtgcagcagaaagcacaaaagataaagcagacagacatgaaaccatccctcatgggtgtttgagctcaatgggaaagtgttacagacagaatattagagaagacattagaggtaactggatcgtgctaatgatagaatgagagcaagggtaggagacggggatggataaagcatgggggagttaaggacaaggagattgttcaagtgtggaaggtgggcggtgggggacaataggcaggaaagatcgtgaaatacgagtgagggagaaatctgattcagcatatatgtatttggcactgagcatctcaagggtgttaggccatgtgctgaggcttttgcatgtttcttcttgcttgatcctcagaaaaaatgcaacatgaaatatggtattttaaaaatcctcctttcatagatgtagaacctaagatcatgacagtggagggattttcccaaaatcattcaacgagtatgaagcaaacaaggatcccaacccaaaccttttggctttcatgatagtactttccacactctaccccagtggttggattttgacttggctttgccctcagtttccctgtttggactggggggttttctctctatgccacttccagttctaatattctgtgcttctcttcaaggtaaaatgaataggggcaaatattctagattctagatggaatatcctagatgtattccacaaagtcacagaggatggaaagtaaatgtcctaaacagagaacagcaagtagctgtgagcaagaagagaggtgctgcttggaaaaggggacggtggaaatgcttaccacagcatcaagcacttatgaatttaaattgaaaagagaaacaaagacttgtggtagccataagtacaaagagtcagagagagatggatcaatgaatacaaatttattcattctgtggcttagggcctgtgaaaacaggaataaacaagattgacctggtccctgccttatgggccacagaattggtgggaggatagaccaaaaaaataaaggagagggagcgggagagagaaagagacagaataattgagcacttagcatatgtcaagcactgtgtgaggtgttttcatgagttatttcatgtattccttatcacaacctcaggaggtctacacttttatttttcccattaaatgaatgagttcattgagactcagagaaattgtcacatgttcaaggtcacatctcaagtagatgagagagctggggcatatacttaaatctttctgatgttccattctacattttaaattattgcaaactttcaggatggagagaggttgggagggagggaaagaggtcaaagaggcagagaaaaaagaagaggtagacattgagaatgagtccacaagtacatgagagagaaggatagaaacaaagattctctctgagactacgtgaccacttggagaccctgcccaggcaggaggcaaatgaggtcattaaatccatctgcgcagatgggaggctctctggggaaagttatatgcaaatgtcatgatgcaatgaggtgaaatctacttgcgttagttcaggtggggactcaagcaggaactgcactgtgctctttggaaagatagattatctcctggatggggaagacactcactctgttgggctcttcctatcagtttgcagaaaggaaagctggccaaggtcacagagcacatgaaggaacgaactggcaactgtattgaactcagttctctcacttgttcgtatgctaaaatctgcttcccaggtccttcaaatttggtgcaaaaccaccatgcgatctattccctactcaggattccaagcctcccagaaggtggtctagcttccctgagacatgctttttgttttcatcattgcctactaaagtcaaagtgaccagtatgtgcagagacttatgttttctcaaaagacacttccacatcctttctttcacttgatcacttatacatcagatattccattacacagttctattaatcaactttgctacagtgcacgacaattttccacccatgattttactcagctcctatagtttaaaatacaaagtgggtcttattatatcagctctacatagggacctgaggctctgagataagtaagtagcttgttttactttaaataccagacttgacacttattattacttttggcaaattcttattcctttctgagcttcagtttccccatcaataaaagggtgattgttgcagcatctgtcttatagagttgtcaaaagtgttttcttgtttggaaatcactgagtacattgccttaccccatagcaaatgcctgacccatagcaagtgcctctgcaaatgaaaactgctgtgattatgatcatggtgtgctcgataaaagttatcaccaggatagcaagaagcagagccataacttgaacttgaaccttctgctcctcaaatccagtgattgtatccctgcgctgcactgcctttctgatcattactgcttcagaccaaatcacctgattcacttcttctttctgcaggtcaccccattccctatgtcctgtgatctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggctttgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagcctcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattatgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattcttctggcctattgtaaaaaagaaaaaaaaaaagaaaaagaagaaagacacaaagaaaataatctaaacaccaaaaactaaacacaattccaatcctttttctgtacctcacgcgcataaatttgctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgcttca

SEQ ID NO: 75 - DNA, 27902 bp, Homo sapiens
ctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggtaacagcccgagcccagctgcccagggccgcccacactggagggctggggtgagggaagtggaagcctctgtccatggggcctctgcgccgaattccgaccctgagtgggaggctgcacggtccccgctgtgacctggggcctaattccttgggctgcagccaccgccggcggcgaagaggagcccggggcccggccggctgccacccacccacgccaccgggtctcgggtccccacactgccgcgggcagtgcggaagcctaggaggcagccgggcgcccaggccgcgctgcgcggagcagccggagcagccacctccccagttaaggccaggcccacccggcctgggccttttcctgtgcctacacagtccggatagtgaggtcaggaccccatggagagcagtccgcgccgggagacgctgggtcgttgatgggtttacgccttcaaagctgcagaatgcccggggaatgtttgcatgttaaattaacgtgaagccttctcatctctaacgagaatgttttgccttttgtgtcaccttttccctaggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggtatggagtgagatcacagtgtcattgttatgaatgagccatgaagtagtggatgaaggaaccgtggaaactttcacttgtaatctacctaactgcagaggtggatgcaaacttgataaaacgtacattttcataagactgtgtgagtctattaaagagaagcgttctgtgttttattttacccttttcaagctaacctttagggcatcttgaggtcttgaatttccccactttatttgccaacttttggccaaggggtggctgtttactgggggtagtgggaatagtacccagggggaagaaaataagcataacttaatgtcttgtgtggcacataagtacgttttaaagaatgactggagatggaaatgttgggaatggtaatgtggatggataaattattaataaatgggtaagacatcattgctgcatccatggtttggaaaattgaccaatggtttactaacaacaacaaaatgctatgaattgtatcatggaagcaaaccaatactgagacaccgtgtggactttttgctctgggtagcaggagaagtgtccttgtgattgttttctttctaaaagcccatatttttcctttaaatacttaataagcacttttacttgtatttattttcagtttcacggcataggttaacttatcagaagttgcccagttagaactgcgttgcttttttatacttttcagaacctaaaacgggaatttcaattttcaaaaaacagaatgagtataaaaaaaattgaactcatcattgctatccatacaaatttgaagagtaatcatatttggaggtacttttggaaaaatgtggagttcttgtcatgaaacttctgtaataaacaagtaactctcaattatatatgataactggggacttaatgtttcaaagataatttatattcacaggtaatcctaaaatcttattttagccaataatttcaatgcccctttgtagaaaacctttgtgctatttatcaaatagcaaagtgaattgatttgcatttgttctccttttatttcccttgcttaccaaatggtggaggtcctaatgaacaatgacaaaaaggtaggcaacaaaaaggagaacagaaaaaagacttagataatccttaaactgaataatcagtatggattataagaaatggtgtaaagcaaactgtcctgaatatccatgattttaggattcctaatatttgaatacttgatgagaagtcgatttttattttcctaacatgttttaaaatgaaacattcatatacatttcatttacagaaactaaagaaaaatcaatatgaaattaagtgtatttgtcaattatataaatatgtatcattaaaaagcccttttcctgctattaaaaaatgttcattttaagcaattgaatacatcacctatcttgagaaaaaaaattttaatgtccaagagttatttttcttatgctatatttaaatacttgccttaaaaaaaatctctcttcagtgccttccactagtactacttgtaaaagaagtaattactcaaaatgtgatttaaaaacctgtaacgtttaagaaaaactatttaattctaaatgaaacagagatgaaacatacagtttgacagctcagcaactcagaccatttatcttgttctgtaggcttcgataattcacaaatggcttctcagaaaaaaaaatgcagcaaatacagtgatctctaagcttttttgcttttcaaggttatgttgctttaaatgtttccaagatgctctgtctttcagctttgattttcttttctgaaaagttgagctattacagttcagagataatatatgcaaagtatccattactgtgctgaacacactgaaaatgttagctgtattaaaatttgaactgtcttaacacccttaaactactactttaaggtaaaaaagtaatcctaagatgatgatgtggccaggatgagctcctgggaaacctgagacattttcttgtcattttgctcaccaggtgcttttctacttttactattactgtgcagcttaacagtttttaatgtgttttgagtttagattctgagtcttatcaatttctagtgattagccttttatttataggttaaaatgttaaacgttctaatttaaaattttaataattttcaataggttgaaagacttgaagccaaagtagttgaacccttgaaaacttatgggaccattgtgaaaatgaaacgggtaagtaaatccattttctcacttaactgtgagttactctggcaaagactatgaggtttccaattgtttttttaaataagaaatacaaagtagtggccaagagtggtggctcatgcctgtaatcccaacactttgggaggtcgaggcgggcggatcacgaggtcaggagtttgagaccagcctggccaacatagtgaaaccccgtctctactaaaaataaaaaaaattagctgggcatggtggcatgcacctgtaatcccagctactcaggaggccgaggcaagaaaatcgcttgaacccaggaggcagaggttgcagtgagctgagatagcgccactgcactccagcacaggcgacagtgtgagactctgtctcaaaaaaaaaaaaagaaaagaaatacaaagtagtatatagtcattctttttactctgaaagatcacttagatctttaagaataatgaaatagttttaatgagcttattaagtatactgtagcaatatagacattattatggaaactttaaaataattatgaaaaatatatggacagaaattgctttactatatgaatataagtttttctttaaagcgatagcatttagacttttaaaatgtgtgagagagttctatttttaaaagttactttattgataatttacatcagcagtccccaaccattttggcaccagggaccggttttgtggaagacaatttttctttagttcacaatagggtttgcactcctatgagaatctgatgctgcctctgatctaacaagaggcagagctcaggccttaatgctagctcgcccaccactcacctgctgtgctggcccagttcctaataggcctgggggttgggagcccttgatttatgtgcgataaaattcttccattttaagtgatcattgagttttggacaaatgtttatacccatgtaaccactaccgcaatcaaaattacacatttatatgcatatatctattatggttaatagttttgcactgaaattgtgtcattattttgagagaatattaaacacattctcacatacatagacactaattatgtaatacttgtaattcctgtggtaatggtaccaggatcacacaagaagtattcttccattcttaaaacaattcttaaaagaattcttccattcttaaaactgaattttcttaagtcagacatttttactaacaaaaaaatgccaatttgcaggatgacctcaaagcaacactcacagcaaggaatcgagaagctaagcaattaactcagttagaaagaacacgtcagcgaaacccatctgatcgacatgttattgtatcctttgaatttgggtctttaaaaaaatgtttaaggtatggagtacaaaagtaaatgtatatagaaattgtgcatttttacttttaaacgagtagagaatttgaatataaagattgaaaagaaatgcatttaggaattctcactatagaaattttaaagaggttacgccacctaattcaaatccccttatattgttttacacagtagactttgcaaacgaacaaacaaaaaattcagatgtttttataaacagtaaattcaaatttctgaattttattttcacatggtgatgactaaatattaattctacaattaaagatctattgttaatcctaatatatcagtgtcctctatgccctgctttgagaaaaggaaagaaaattttcccatttaatttccttcatcttttagaaataaaacaactatgtgacatcatgacttccagccagttaacctcaggagtcttaagagtataattaagatccaagttggacacaaacctagaaaggactgtctactataacaaggttcttctgttaaacatgactttcttaaactacaatgtgccttgttcgtgagtaaacaaaagcatacaaaatagtgcctaattgccagcaactgagatgggtaggactgtgtagaaagcactaacatctggctgggcgtgttggctcgtgcctgtaattccagcactttgggaggccgaggcaggcagatcatgaggtcaggagttcgagaccagcctggccaacatagtgaaaccctgtctttactaaaaatacaaaaattagccaggcatggtagtacacacctgtagtcccagctacttgggaggctgaggcaagagaatcgcttgaacgtgggagatggaggttgtggtgagctgagatcacaccactgcactccagcctggaaaacaaagcgagactatctcaaaaaaaaaaaaagaaaaagagaaagaaagcactaacatccctactgcctctttttcccattccttcttctatatgtctccttcctgcttccttaaggttgttactgcccagctcagccagaaaccacatgaggagtggctctttgagagcatttgaggttccagaacacctccattcctgaggggagtctcttgagcagcgatttggggctgcgccagttgcttggtccttcttcctttggaccaaaggtacagaagcccaactttgtactaaacaaaaatgggcagccatagggctgggagtgcccactggagactgggacagaaatatctagatagtcatagtggcataagatccgcaaatggagattatagaatctgtgttttaagcaagtcagacaaaccagagaatgctggaaaatttatgactgataactagagatcaaggcagaggctatggggcagggtgggtgggggggttcaccagtgtttaagaattaagctagggatgaaaattttttgttttgttttgttctttgtggcctggagttggggaggtggtgatacatgaagacatctggaatcctgagtagttggcaagattgaatcaggagtactggtgtctacagtaaacacagaaatgaatctattcctaagacaaacatttttctgacttggatgctgtgctgtaaacactgctgtggaagggagataatcttagagcacagatgaagcaggtctttgggttcacatggtgaggaaataaatataacctaagagattactgccacaggtgagtcagtgtgctcactgggtaagatctgcaacttgtgtattttgacaacctgagaccaaaacatgaaggacaatctacatacaaatgtagtcaatataaatatacaaatattcgatcatagtattatggcatatttcccaggataaactcttaaaattcatctatgtagaagtatgtttaagtttgatatgtaagataaaatggagtccctctgatagagaggatagggaaaagaagaatcccatggctctgcctgctcaccccccaagtagggctccaggtgactcctgaacaagcttcctataatgcagtgtgagaaataccaatctggcttacccttttaaaaatcattttgaactcttaattaattccatttaatatactgatatctgtattcatggagttgtatcttagtattttaatccaaagcatttcctactcaagttggtatattatagaattttgaagaattttcagtgaaaagaagaaatattagaaatctatattctctttgctaaaaatggatgtgttactttaggtgagttgctatgctcaagtaaagggatttgagactttcagaaataaatagtagttgctggagggtgatagaagatgaagctacacatatcccggttatggcttctgtttccccatgcttccctgatttagccaactctacttactcttctaaattttaaaatgaaaatatcaataaatgaggagggtaaagacatgagtcaaaaggaagtagtcacaagtaaaaagctgcatcagtcatgtgtaataaacagtattaggaattagtctgcttgaatattctcattagcacaaggttaacatgtatcaaataactgttagagattttttcatagtagtaagtcttcaaaggagctctattttatctttgaatttcctgtgatgaagttgtggtttaaagaatctcaaacacagaaatacagagaaatgtttttgattcctggttatgattaagttgaaagtttgtatgattttttaaaattctacaccccatattgtaaatgtatatacaaacacagagaggtataaatgaatataattttaagtacttagtatcttgaaaatgtgtagttgaatgaactgaattacataagtaaccataattgatatatggttacaattaatatataacctaattgtaagtgtatataattctatgagtatataaatttattgaaaaagctgttatactctctttgaaatgtattttttcctttatgaaaaatttcagtcacaggtgggtaataaagtggtgtgtcaagaaatggatccttatagtaaacccttttacttgtttcaatttatacattttcttgaaaaagaaagcaaaagctaaatgtcacagtattacttatcacagaactttgacaacaaatgcaaactttttctatgattaattattaaatgatgatatatgtgacttttgagtaaatataatattagcacaagaaacaaaactttattaggaagaatttaatccgaaaactgggctgtgtctttttaaatttctgtgttaccttttaagaaaaactcttaaatgtttttgggcaacttttgttctagcagacgagatgcttaaagagagatacacagttagattagaaatattactatagctactgactatatatggctgttgaattcttgaaatacaactagagtaactttggagctagtttttaattttttatttaattttaattagttttaatgaaaatagccccatatggctagtggccaccatattgattggacagaacagatccagataatatgagtacatgtccaagcgtgttagacttgccatctaattttagttactagtgtatttattttttgtaataagcattaactaaatagaagcagtgtaacatggttgtcttgtaaagaagaatctacaagtagaagtcccatgctgaaatatttgtagtgtatattgtattccacctgatgaggatattatagaattaggaatatttaatgcatttggagaacaagtagaagtaagcaaggtagaaagaaagagtctttggttatatacctgctaactcaaaatacctcaatgttgtaatgatttcaaaaatcaaactctcagtggtagaaattgtcatagctgtctctctactgtgtgccactctccttagtcatttccaaagatgatttcatgtaatccatacaatagtcctatgagataagcataaagagtaagagataataggccaggtgcggtggcttacacctgtaatccctgcacttcgggaggctgaggctggtggatcacttgaggtcaggaattcaagaccagcctggccaatgtgacgaaaccccatctcttctaaaaatacaaaaaattagctgggtgtggtggcatgcacctgtaatcctagctactcaggaggctgaggcagaagaatcacttcaacccaggaggcggaggttgcagtgagccgagagcgtgccactgcactctagcctgggcaacaagagcaaaactctatctcaaaaaaaaataaataaaaaagagataatctgtaattgagagaattgaaataatttttactaagtcataagtccttttcaggggagaaatggctaatggagagagagacaaaagaaaaataatttttgataaatggcacaggtagtgaaatagagggaagcagtagaaaatatgggagatggttttacagtaggttatccaagggtgtctggaaaaaaaattattttatagacagaaagggaaggatttgggggtagtttttgttcttagggttttttttctagatcatgaatcatatcactaaataaagttctttattctgcatgtgcttacatagatcattttattatatatggtaaaatataatattaacaatttacactgttatgccaaaaagccagtactgcaatggtagaatttaccagtaggctcaattgaatgaattctcatttgattttttttatatccttggttggggaatacttttgtaggcagaaacggaattacagagagctgcaatggatgctagccgaacaagtcgtcatctggaggaaactattaacaactttgaaaggcagaaaatgaaggatataaaggtaataaagtaactgttagggttcaaaacatgtttttaacctttttttttactttaatgaaaaatttaaattactctaaattttttagcccataataccccttataaagaaaatatgataaataagggggcgggcacagtggcttatgcctgtaatcctagcactttgggaggccaaggcaggtggatcagttgaggccaggagtttgggatgagcctgggcaacatggaaaaaccccatctctacaaaaaactagccaggtgtggtggcacatgcttgtagacccagcttcttagggggctgaggcaggaggatcacctgagcctggggaggtcgaggcagcagtgagccatgaccgtgccactgcactccctgcagtccagcctgggcaacagagccagaccctgcccaccccaccccacaacaacaaaaagaaaacagaaaaagcaaaaaatattacaaataaaatgtattggttttttttttagtagaaacagtgatatataaaagaccaacatttccaaccagaagccagatattcagctttttatcacaaatactatttaatcaaggggaactaacatttattgtgtttttatatgccaggcactttacataaattcttgcagtcttcacagcaactccatgaggatgaggtggtgttatgaaattaagcagccaggcacagtggctcacacctgtaatcccagcactttgggaagctaaggcgggcagatcacttgaggtcaggagtttgagaccagcctggccaatgtggggaaactccatctctactaaaaatacaaaaattagccaggcgtgatggcacacacctgtaatcccagctacctgggaggctgaggcaggagaatcacttgaacccaggaggtggaggttgcagtgagccaagaagatcatgccactgcactccagcctgggtgacagagcgagactctgactcaaaaaaaaaaaaaaaagaaattaagcagagacataaaatattttacccaaagtacaatagccagaaataggagctataaaccaattttttaatctgtggtttctgttataatacagtcattaatttttatagcttaatattttgtagtaactacatatcatcaaataagtaaacagggtaatagtagccaaccacgtaaatttgcatctactatgatatggtatcttagtcaacaaaatcacaagaattgccttattctaacacatatgtagatttgaaactttcttggggatcatgaaattcagcaggtctttttgataaccatcttggaaacacttgaaggacctcttatgaccatcttacagactaaaactcatctaaggctctttttggctcactgaagattttcctgtaacaggctttaaatatgtttgtttttattttactactattgacaaatcttccttcataagctatattctttcaataaaataagcattatctgccacttaattatattatttatctctgaaatccatgaaacagtattcatttacatcttttattttctttaatttcctgtcatagtttcaaaggatttctgagctcaatttagtcacaggctctgtactcttctatgtaatagtagattgctacccacagaagaacatctcaggaggctgtcccgagacaaattcctttaccaagctaggagagtatggtcagggtataaagttttataattgctgacattccctcttaaactgagcaaggaaggagaattattaagataattaattagccttaacctgaaaaatgggaatggagacttgtgagctatgcctgattccactgttggataaaggcttctttagtgatgggaaactgattccttgctccatcattgttcctcagacctgcaaatttttcatttacacatggaaatttgtctctattctgatctttgggctcacttctatgttctgcctggatgctggttttaattccctgagcattacacagtaccaaaccccacagagaaagtgagtgcagcattcccagctacaattcctgctaccttggatttcctgaagcaacaggagatggagtaaggtgctgtatggtggagggtgcacagagaagaaaagagcttctgagcttttctctattgtgccccctaaagaggaaagtctcttgattttaggaagtctcttggtcacagaagaaaaattttttaaaagacaggaagaaacttacactttaaaaacattgggctataattcactgtgcaactctggtcttgagtgtatacacagatatatatcaccactcaatgttagaacattgtcatcacttcaaccttgtacagtttagcttttgcccccctgcctgcctcccaaccctaagcagccaccactaatttatggattgagctattctgcacatttcatagaatggaatcatcaaatatgttgacttctgtgactggcttctttcacttagcctgctttcaaggcatatccatgttgtaggatgtatcagtacttcattcctttttttgaccaaatagtattccattgtatggatataccacattttgtttactcatttcatggacatttcggtggtttccaccttttggctattgtgaatgctaatataaacatttatgtacaagtctttatgtagacatatattttcatttcttttggatatatacccaggagtggaattgctggattatttgtaactttatgcttaagcatttgaggaagtgccagaccattttctaaagtgaatgcaccattgtgtttgcccaccagcagtatatgagagttacaacttctctgcatcctcactacttgctattcatcagacttcttgattgtagttctcctagtggatttgaagtagtagttttattgtagtagtcgtctcattatagttttgacttacattccatgatgatgctttttttttttttttcttaagatagagacgaggtctcactatgttgcccaggctggttttgaactcctggtctcaggtgatcctcccacttcagcctcccaaagtgctggcattacaggcgtgagtcactgtgcctggcctgatgatgctttttggccatttgtgtatatctgccttgaacaaatggctattgagatcctttaccctttttttctccttttttttcttttttttttttttttcgagacagattctcgctctgtcgcccaggctggagtgcagtggcgcgatctcggctcactgcaacctccacctcccaggttcaagtgattcttctgcctcagcctcccaagtagctgggattacaggcatgcaccaccacacccggctaatttttgtatttttagtagagatggggttttaccatgttggccaggctggtcgtgaactcctgacctcaggtgatctgcccacctccacctcccaaagctctgggattacaggcgtgagccaccatgcccggctcctttacccttattttaactggattgtcttatttctgagttgtgagagatttttatatattctagatagaagtcccttatcagataatctgcagtttttcccattctgtgggttgccttgtcactttcttgatagtgtctttgaagcacaggtttttaattttcatgaaatccaatttatctctcttttcttacttgtgctttgatgttatagctaagaatccactgccaaatccaaggtcatgaatatttattcctatgttctcttaacaattttatagtttcagcccttatatgtctttgatccatttgaattaatttttatatatggttaaattttgtaaaggttaaatttcattcttttgcatatgactgtctggttgcagcaccatttgttgaagggactattctttcctcaattgaatggtcttggcatctttgttgaaaatcagttgatgtggttttacttctgggctccctttccttttcattgatctatgtgtctatccttatgtcaataccacactgtcctaacattgctttatggtatgtttttaaatcaggtaatgtgagtctttgtactttcttctttttttaaaattgatgtggctattctggatctatggcaatcctgtatgaatcttagaatcaatttgtcaatttctacaaagaagtcagttcgggttcttacaaggattgtatcaaatatgtagatcaatttgaggagtattgacatcttaagagtaattcttccagtccatgaacatgggatatttttccatttattttaatattctttaatttctttaaacactatttgtagttttcagaatataaattgtgcacatcttttgttaaacttcttcctaagtattttatacttcttgttgctatcgtaaatggatttgttttcctaatttcattttcagattgtcacaaatgtatagaaatacagttgatttttgtatactgacttatgtcttacaaccttgccaaacttgattattagttctaatagttttttagtggattcgttacaattttccacatataaattctgttttctgcaacaacctacaatttaaatgcaaactcccataaccctagcagactcccagaaatatgagcactagatatcaataccagagtctgttagggttctgaatctccattctgcacatcattcctcatcactgtcaaattgcttcctttccaagtaaagccgcatttgggatcttttataataaagagggatgtagaaatctcacaacagtagcctcaaagatcagtcaataagggttacattatagcccccttactttttttttttttaatagagctggtgtctccctgtgttgcccaggcttgtctcaaactcctgggctcaagcaatcctcccacctcaacctccccaggtgctgggattacaggtgtaagctactgtgcctggctggcccccttatttctaataaaaacaatagtcagatattaccatgttgatcttagcatgtctcataaacatttctgtgagataaatgcctggaaaagtcagattattgataccactcttaatttggggagaaacggaacattcctattcttacctgttatcaggctactgcttctgataagggcagagtttgtggctcctttaaccattctggaagcagaaatgattggcagtagtgagcactgctcataactgtgagtgcattactgtgtttgaggtgagtttaattgataagtccatttgaattttggtattggtattaaacagcaaggtaatacatttttgaagacttttcataggaactttgcagagtgtctctctgaaatcggctggcatagaacttagtgtacaaaatgagagaaaaatcacaatcctgtttgtttccatgtattaggaaaagtcatcagtatatgatgaatgtcaagggaatttcacagttacaaaaaaggtacttaaccaggagttgctcctgtaacaaatggggatgggaactcagtatgtagtgaagtagctgacatgagcaagaaacatcataattaatttttatagctttatttttattataaatataaatcataaaacttatccataaaattagacaaaaatttagtctcaccacccaaaaatattcattttttattttatccttccagatttttcctatgcatatatacagagacatagtaataacaataacaaacatttcttaaacattgtctgtgtgccaggtaccattctaagcattttgcatgaataaactcattaattcctcaaaacatcattatgaggaaggtactatttttagtcctaacagttatacatcaatgggaccaccgtatatatagcatctcttcttaaaacttatggatatatttatgccaagaaacagatccatatcatttttttgttatctttatgatattctgcagtatggttatactagttcatttaaccagtcctcattggtgaatgtctaggttatttttgcaattgtagctgtcactgcatcattacacattgttaaacagcagcctttgtgctggcccagttattctcttgagataaattaccagaagtggagttcctccttcagagcatacttttaattttaatatatatttttaaaacttctgtccacaaaggttaaaccaatttacgttcctactaaaccttgcataagcacaggtacaatggtgagtttgtttttttgttgttgttttgagacagagtctcgctctgtcacacagtctgtagtatggtggcatgatcttgggttactgcaacctctgcctcccggattcaagtgattctcctgcctcagccacccaagtagctggcattacaggcgtgcaccaccatgcccagctaatttttgtatttttagtagaaacagggtttcaccatgttggccagggtagtctagaactcctgacctcaggtgatccacctgcctcggcctcccaaagtgccaggattacaggcatgagccactgcacccggcctgtgtttgttgttttttttttttaatatgacaatgttgacaccataagttgcagtatttttaataataggtaaaaaatcagtatcatttgtgttattactgctgagctttttaaatgtatttagcgatacattcctttagtaaattatatttttccttaacctatatttctgttggatgttggaatttcttactaatttctaaaaattctttatattgagaaaattagcccttcaaattaaagagaaagtatgttgcaaatgtattttctcattttactgcttagtgtttttgccacctctaagttttctttttattgccaaatccatcttcttatctttggtttcttccttggtgtcatgcttagaaaggttttcatcccctaggttatataaatacttgcttatattttcttgatttttaaaatactttaaacattaaatatttagctggcagctgtgttttgcatgtggtacgacatggatatataactttaattttcaaatggataaacagttctcttacatcctttattgaatatcctatacgctggagagctgtcatttcctctttgcgaaaatgttcttaaaaccttttcgttaaagatctcttttgttaatcaaacaagatggatgctttactgttagtcattacatccaatttagctagttgactttgttgttcttgttgagacagaagtctccaaatgttgcccaagctggtctgggacacctggacccaagggaacctcctccctcagcctgccaagtagctgggattataggcacatgccattgtgcctggctagtttacttcttgagcattaaaaatgggtgtattggcttgtcatcgactcttcgttcagttttccctctaggagtttccacactcaagaaaacctgactcctttctggtttgcaactatcataaggacactaacaactaagagtaggtcccagccctggtcagaagccattcctcctctaaggtattcctgggtatctagagatactttaatatgaaatccaaaattgtattttagcataatgccgtttatccatcagttgccagcctggtatacctgagccctctataacttacatgaagtgacagtaagggtcattgtgaatcatcgttacaagtcttttttacctaggccctgtcctctcagactgacgtatatcactgagtagcaatcagagcctcttaatgctcccttaagtgtttttccaatcatctaggaagaatggggctggaggaaagaatcacaggccactgataagtatctatatggctatcctccaaagtatatgaccactcctttctgggttatcttaggagagcagggatgaaggaaaatgtgtatttgactactgcctactaatataatccatgcttgagtattttctgccttgttcttattcagcccagttctctctacattgcttattttgttataattaacaaaatgataagatcatatttattaaaaacttgcctggtttccatcttttccacacctactgattacctcaccccctgcttagatcaacatgcacatcttcactcatactctttgttcatgatcttccttgtcataggtttccatcatgcttatagaggttacctgcacggtttatctgtgaaggaaatgattgattccggcaagaacagcacagttcagtgggcaatagcaaaaaaaccttaaatgagctataaccttgtagccttagaatcagatctgtgtctaaagagtctgacctgtgagcaacactgggcaagtcaatatttgtaaactagaacgctctatgcaaatatatggtgttatcatcagtggcaggagtgtcattactaccaagtaactcctttatgtttagagaatacaagtagcatacagtgtggaacataattcctgtttaaaaaacgttctcctgtttaaacatcagttggaattgctaaaacaccagcttcataactgaactgctctaatacttaataagcatatggtattaaaattatatagtagcatacattttagtcagatcttatgttattataaatgtcaattactaggtataaagagaactaactaaaataaaaaataagagggaagtggatggtgataaaggaaatactttgtattatttgaaggtttggcagcaaaaggtcttcacaactgtttttcagttatcttttgtactttatttaccctatagaaaaacagatacttctgtattttataaaataccaagactatagtgaggaataaagttactatattcataaagaaatttaaatcattgtttaaattcaattctttggttttttttagactatattttctgaatttatcacaatcgaaatgttatttcacggcaaagctttagaggtctacactgctgcctaccagaatatacaaaacattgatgaagatgaagatttagaggtaggactatgtctatctaagctcagttcttctgttaatgtggaaatatttaaaagagaacattagtatgtgattaatatcttttttttttttgagacagagtctcactctgttgcccaagttggagtgcagtagtgtgatctcagctcactgcaacttccgtctcgtgggtttaagcaattcttctgcctcagcctcctaactagcttggattacaggtgcccgccaccatgcccagctaatttttgtatttttagtagagatgcagtttcaccatgttagccaggctggtcttgaactcctgatctcaagtgatacgcccacctcggcctcccaaagtgctgggattacaggcatgaaccaccgtgcccagccatgattagtatcttaactttgaacactatagtggttattatgtgtaatccaaaatagatgaacttttatgattttccatttattttcaatttttcaaattaaccatggcaaaagttccaagagttaatttattaatagctagtaaaatataatttacataaagccattaaataaaatactgtgtatcattttgactggtgatataagcccactgaagtgtgctaaaaaatagttaacatttattgacttcagtaacatttgagtgtttacatcatgcacaatgcccaaagctttacatgcattttctcattcaaacctcaaaatcttaggtggtaggtgctgctataactctcattttacaactacagaagcaggcttagaggatttaaataacttatttgtggccacttagctagtaaatagcagaatcaggattctgactgactgtgtaatgtaatcactaagctatgaaataaatgtaggttatgtaagcttgctttatgctgatggttttagttaaatgcaaataattctgattggccaactaacattagagcaagtaaatatcaaagactggtcctcaatgagcaattctgtaaatatccaaccctcttaccttccaaacggaaaaaatgaaggtacgaaagtatttatgctgaagtaactgttcaagacatactttccccatctcatctctaatatagaagtgaaaaaagccatgtaatcccacatataacaagagttctgtattaataaaatatggaagtgtctaccacttaacaaatttgaagattcccccgattttttttttttttttttgtatcttcccccgccttccaagacagagtcttgctctgtcacccagtctggagtgcagtggtgcgatctcggctcactgcaacctccgcctcctgggttcaagtgattctcctgcctcagcctacctagtagctgggattacaggtgcctgccaccatgcccggctaatttttctatttttagtagagatggggtttcaccatgttggccaggctgctctcaaactcccgacctcataatccgcccgccttggcctcccaaagtgctgggatcacaggcgtgagccactgcgcctggcctagttttttttgtatcttaactatcagtaaagagaccctctgagccttcctgtcccattactccacgggctccaggaaacttaaaaccagaatataggttaaagagaatgaagaaagtacatattacagtatgtgtatatgtgtttctaatgtcaaaatctaatttgttttatatcagttatatatacatatttatatttctctatttgtcaatcatgacttcccaagtgttaattccaaacactacagctaaggtttcttaactttcactccttttcatgtcctgcttttaaaaattgattatgaaggccaggcacagtggcccacacctgcaatcccagcactttgggagcccaaggcgggtggatcacctgaggtcaggagttcgagaccagcctggccaacatggtgaaaccccatctctactaaaaatacaaaaattagccaggcttggtggcacgcgcctgtaatcccagctactcgggaggctgaggcagaagaatcgcttgaatccgggcgtcagagtttgcagtgagccaagatcatgccactgcactctagcctggcaacagagtgagactccatccaaaaaaaaaaacttgattatcaagctttcatctgtcatttataaaataataaaatagcaaacgtttatataattactttgagtcagctactgatctttgcattttaactatatcattttaatcctctcaataactttgataaaagtacttatttctgatttctgtggatgagaaaactgaagcacagtgaggttaagaaacttcccagagatctcatagctagtaagtagcagagctggaagtctgatccggaagtctgactacaaggcccattatgctttaatcctctctacattagacttccagaagtatggttcttgatgagtggcattaaccatttcctgcaagaagtaacactgcatttagtggcagcttcaaaagtgatcccccaattctccttcaagactgtagtccactttataagtattttcattcttctttgtataatacctttgacataccatttgttaactgaccttaaagttccttcaagcccttcagtccccaaggttttcctcctcatcccagaggtcctagatatttttttgtcacaccacttcctttataactttttaccagtactcttaatcagccatctaagtagtttgtgggagaagagctctatgtaaaactaaaggtctccggaatatgtggtagatttttttttaatatcaactcccctactttctagtgaagtaatactgagcaagttaacttcttcgctcttcagcttcctcctttctaaaatggagatactgtagtacttacctcatatagtgtttgttcaacaactgtttattgagcacctcatatgcaccaagcaccattctaagtgtgaaggatgtagcattctaagaaacagtccaagttgtcaaagcagtaactttaaatctaccagggaattcagacattaaaaactgtgtaatgatttttttatatgaccagtcctataaagaaaaaaaaaaagtgttgtgtgtgatggagggttacaaatagtctggagaatcagagtgatttcttagaatcttgagggatgcatgggaggatgcctggcaaaaactttcaggtagagggcatagatagatataccaaggtcctgaggcaggactgttgtgaagaaagaacagtgtatttaaaacaacacagttgagaatcatggcatgtcatggaaaaaaacaaaaacaaaacagcacagtatagggcacgagcacgtgttcaatgaaccacaggcataaactattattatgccattattgtggagagaacagtctggagagaactgtggaaccaggggaagtaactaattgatgtaactgatatatcaaacaggtacctaccaagaggaaagatcctgtaaatacaggtttcttggaaagaagtaaagaaaacatgcagaaaaagacagaaataacttgctattcttccagatagtccatgctttgtaagaaccgctgagatttattccagctgcagccagtgttttgtagttaggcacctccagttatatcacaaaccatcttaattgttcttcacataaaaagtactgtcagctgggcgcggtggctcatgcctgtaatcccagcactttgggaggccgaggcaggcggatcatgaggtcaggagttcgagaccatcctggccaacatgatgaaactctgtctctactaaagatataaaaaattagccaggcatggtggcgcgtgcctgtaatcccagctactcgagaggctgagatggaaggaatcgcttgaacctgggaggcagaggttgcagtgagctgagagtgtgccaattgcactccagcctgggtgacagggtgagactctatctcacaaaaaaaaaaaatattgtcaggtcacctctgtattaacttcagagcacattcagatcttgagaactgctcttagaagagatcttggaccatgttggaaaatgcattattgccaataaattggagtaaaatgttaattgtaataaatatttaactggtatagacttgtatcccaagggttacatactgttttccatttcccactttaaattccatctttgctagaaaagttaatgttttaagaaaaatgtttctcctccaaataccagctaatgagtcattgcatttattttttatttatttatttatttttttgagacggagtctcgctctgtcgcccaggctggagtgcagtggcgctatctccactcactgcaagctccgcctcccggattcacaccattctcctgcttcagcctcctgactagctgggactacaggcacccgccacctcgcctggctaattttttgtatttttagtagagatggggtttcaccatgttagccaggatggtctcgatctcctgacctcatgatccgcccgccttggcctcccaaagtgctgggactgcaggcgtgagccacggtgcccggcccaagtcattgcatttttatgtcataccaggatgtcagtggtccatgtctggcaccaaaattgaatttggtccttggtaacctgttaacctaattagcacccctgaattactttaaaacacaagtctcacctcctgtcttttatccttgactccttccgtgtcctgaagttctcttaaaggaatgtgtagccaccccctaatttaggtctccttttccccccctcatagatgttaattaaattcacttttgccaaatgaatgatgttaactatgtttgcaacttaactgttaacatcattcatttggcaaaaatgaatttaattaacatcttctatttgccagggaggagatgcatagataaaacagggctccgttggtctagagaacttaagactcattgagacagatatgtaatcaattacaaaacactgagttaaaaagcagtacttgagggtatgaacagtaggtgctactcagacaacaggggaatgcagaagaaagatggcgttttacattgtgcttgaaggacaagtaattcttgaaggacagtttgttgtaattctaggctaaggaaccagcattgcaaaggcatagtataacttaggttctgcatttacagtcaagagccacaaaaagttttagaatagagaaagaggccaagcgtggtggctcacacttgtaatctcagcattacgggaggctgaagcaggaggattgcttgcggccaggagtttgagaccagcctgggcaacatagcgagacactgtctgcacaaaaagtgaaaaaattagccagagtacccctgtggtcccagctactcaggaggctgaagcaggagaatcacttgagcccaggagttcgaggctacagtgagctatgactgcactactgcaattcagcctaagtgacagtgggtccctgtctaaagagagcaataacatattttggccttaaataaaaagtaagctgtgaagggtatgtagagtcaataaaagagaagtgcctcaggtgagaaatgtataagttttatatatataaaattttttttaagacagggtctcatcctgttgcccatgctggcgtgcagtggcacaatcacagctcactgcagccttgacctctgagcttaggtgatcctcccacctcagcctcccaagtagctggaattataggcacgtcccactatgcctggctaattttcatattttttgtagagatggagtttcgccatgttgcccaggctggtcttgaactcctggggctcaagcgatccgcctgcgttggcctcccaaagtgtcaggtgagaaatttagggagaatgcccaggcttatagtttggtcttctaggtaaaagataatgtctttcattgtaatagctaatctagagctacacggttcagtaaagtagccattaggcatatataactatttaaagttcaatttaaaaattcagctcctcggccacgtgaaccacatttcaagtgcttagtagccacacatggccagtggctacgtttctgtacagtacagaacagcaagcatttccatcatctcagaaagttcttctggacagtgctggtctagagcaggagatagttgggagcatgaatacagctatcacagggtatgcttgtcaggggattagttgaagggtagtcattaacagtgtagataagatctttcagagaaactttttttttgagacagggtctcactctattgcccaggatggagtgcagtggcgtgttgtgatcttggctcactgcaacctctgcctcccaggctcaagtgattctcctgcgtcagcctcccaagtagctgggactacaagcatgcaccaccacccctggctgattgtttttttgtttggagagatagggtttcgccatgttgcccaggctgatctcaaactcctaggctcaagtgatcctcctgccttggcctcccaaagtgctaggattataggcatgagccactgtgtgcagcagcattgtttttatatataataagtggcctaaaggaaaccctttaaaaatattttaggtataagtagtagaaaaggagatgtaaagaaatagagaagccaggacaatgaaagagtttagtagcatttaagtttcaggaagggggtcagtgaggatgaagaggaaaaaaagaccttggtgatgtgaggaagagcaattttagtgggaggtgaaaagctcaattgtagtttgttgataaataaatggaaaagaaatttgtttaaaaagaaaatggagatgaagtcgaatattcaagaaagttttttaagtagttataccttgagataactaaaaaaaaaaagactgatcttgagcttgttttttaggagagggaacctgtgacaacaaaagcttttgttggttgggtttgaagttttggttaaaggaaaaatgcacattggaactaaatcagaatggtatttttaaagagaaagaaggaaaaggaggggcgaaaagcttgagggaaagttcaagagattcatatctgataaccttacctattagtctatatagagaaatggtgggggtagggtagaaaagatggagctagaaaggcttaaaagtggtaaacatttggaaatagtgccttaaggaaagagaactgacaagtcatggcattccagatcctagtaaggttggaatccataaattatagtggttccaatttactcttatgtaattttcatagcagtactgcagagttaaattggtaagagttgagaatttgcagaacagaaagattcaaaggtatgagtcgcagcctccctactagcttgcatgctctttgagggtctcaacttctgcagttctcctggcaaaagcatttaaatgattgtttcatgactaattactgtttaatatctgtcatcatcttacatagttcaaatagaatttttagctttcatctttctagcttatttttgttgtcttttcttttacatttacaataattggaattttgtccatttggggggagttgtttttttaaaaaaaaatcttaactaaggaacttaatttgactgtcttgattttgtttagcatctactttataatgctattttatcattacaataggttttccgaaattctctgtatgcaccagattattcatctcgtttagatattgtaagagcaaattcaaagtcacctcttcagagatcactgtcagctaagtgtgtatctggaacaggacaggtgagcaagaaaccgtactctaaaggaatttgagctgctgcctttggaattgttgagttctaaaaatgtttcccctcagtcatatcacctcggtaacttatcctcccctggacctatttcttctcttctataaaatgacagaagattgcattaagtgcagctctattatttcttaattatcttttatactgtaattacatattactctctaaagcataacacttgagagcagaagtggaaaagacaaaagaatgctaatgcagatgtgttatctgctataatatgaagagcagattctgaagtccaacttaggtttaaatctcactatcaaaacttagtggatctcattaaattataaagttaaataccaaattatactaaaaaagggcttttactgaacacagaaatcatttcattttttttctatatccagaaagcttgagtttcccagtatctagagcaggggctgacaaactttttctttaagatgtggagactaacattcttaggctttgtgggccatatggtttctaccccaacaactataaataacaactgttaagtaacacataaagcagtatgactgtgttctaataaaattctatttacaaaagcaggaggctggctgggccgcaacttgccaaaccctgatctagagagctatgcccttttcatatctagccttcagaatataaaattcaacaaacttattttcaagatacaacttttaggtaaatttgataccatactttctattttcatttgattctcctgtaagcatttattttgttttatatgtatgtatctctcccccaacccaattgtattttttttattccggcattaagtgccttgaacataaattccataaatttacttttatagtccatataaagttttgactacaactaataatgtcaccttagctaacacttgtatagcacttcagaatgcattatcccagggtttctcaacctcagcactgctgactttgggacaaataattgggcccaccagggaggaagaaggggacggaatactgtcctgtatattgtgacgacatcaagcagatattagcatcccccgcctctacctacaacatgccagtagcacacataaacacacagccccaatactgacaaacaacagtgtctctagacattcccaaatgtcccctgggttagatataatcaccctcaagagaagttttaagcaatatgccccacgtggcggcagtcaggcaacttaaaactggtgaattcagattctcaactcattccatttaaatcacactacttttacatcagtatttctgtcccactgcctagctgaaatatccttctatttttgccatccattttatgattctcaaatgctgtttctgtgacccaaaatttatttttaatattcataatatagagtctatacttttaatgtttttgaagtattgatggctatccaactaaaatcaaatggctaattacacatttttattcaaaaaaatgtgatgaatgaaaaaactggcttctgagcttaaaattcatagggaattttcactactaaaaattatgacatggacatttttttgaaatatttgttgtgtgccctttaatagcataaaaatataccaagaatgtaaaatttttttaagttagtatttttattttaaaaagtgtgttaacttttaacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaa

SEQ ID NO: 76 - DNA, 20223 bp, Homo sapiens
ctggaattgaggctgagccaaagaccccaggtaagggtcagggactttgtttctgggaacctgccaggttggggtttggaaggaagtaatgggccttgtttggtggtggggaggggggcaaagtgtgggggtttctcattgcagaagagaattttcagaggatagactccattgccaaaggcagggaaaggcagaagtatggaaaacagctggggtctgacatgctgtaggcagccagcactttctcttgaaatgagaaacattctggcaaaaaaaaaaaaaaaagagaaaaagagaaatggatgttcccagaagagtggcaaagagagagagagagagaaatattctcatctcaaggaaggagggagagaacgtagggaggccatggctcccatattacatttccttaactgcagaattatttgttttgtttattcgccatatcatttcattcctctttactaatttattgaaatataatatacatatagaaaagtacgcaggccaggcacggtggctggcacctataatcccagcactttgggaggctgaggcaggaggatcacttgaggccaggagtttgagaccagcctgggcaacacagagagacccccccgcccgccacatctctacaaaaaaaaaaaaaaaaatcaaaaaatgaactgggcacggtggtgcgcacctgtagtcctggctactcgggtggctaaggagggagaatcccttgagccttggaaagttgaggctgcagtgagctatgacagcatcactgcactccagcctgggtgacagagtgagatcctatcttaaaaaacaagaaaaagagaaaagaaaggtatgcaaactctaagagtacaactcaaagaatttccacaagggttaaaaggtgaaccagcacccagataaaggaacagagcataccagcccccagaacgcccccttgaaaccgctttaagtcagttgccccaaagggtgaccactcttctgactcccatctttttttttcttctttttttttttttggacggagtcttgctctgtcgcccagactagagtgcagtggtgtgatcttggctcactgcaatctccacctcccgagttcaagggattctcctgagtagctgggattacagacgcacaccaccacacctggctaatgttagtacttttagtagagatgggtttcactcgcgtccatgtgaagagaccaccaaacaggctttgtgtgagcaataaagctttttagtcacctgggtgcaggcgggctgagtccaaaaagagagtcagccaagggagataggggtggggccgttttataggatttgggtaggtaatggaaaattacagtcaaaaggggttgttctctggcgggcaggggtgagggacacaaggtgctcagtgggggagcttttgagccaggatgagccaggagaaggaatttcacaaggtaatgtcatcaattaaggcaagaacaggccattttcacttcttttgtgattcttcagttacttcaggccatctggatgtatacgtgcaggtcactgggggatacgacggcttagcttgggctcagaggcctgacattcctgtcttcttatattaataagaaaaataaaacgaaatagtggtaaagtattggggcggcgaaaatttttgggggtggtatggagagataatgggcgatatttctcagggctgcttcgagaaggattaggggcggcatgggaacctagagtgggagagattaagttgaaggaagatttttgtggtaaggggcgatattgtggggttgttaaaaagagcatttgtcatataaaacgattggtgaaggcccggatgccgttctgtatgaattgagaaactaaacgaaagacacaagttccgaataagagaaggagaaaaacaggtattaaaggactaagaattgggaggacccaggacatccaattagagagtgtccaagggggtttagtgtaattacttgtttggttggtgagtttttgggctctgtttttgacagagtccttttatttttttttttaagttgagaggctgagcttggggggtgtgtctttttttttttttttttttttttgcttttggagacggagtctcactctgtcgcccaggctggagtgcagtggtgtgatcccggctcactgcaagctccacatcccaggttcacaccatcctcctgcctcagcctcccgagtagctgggactacaggtgcctgccaccacgcttggctaatttttttgtatttttagtacagacggggtttcaccatgttagccaggatgatcttgatcttctgaccttgtgatctgcccgcctcagcctcccaaagttctgggattacaggcgtgagccactgtgcccggctggtgaggtgtgtctttaaaaaaccattagtccgttttacctttcctgaagattgaggatggtaaggggtacgaagtttccactgaataccaagagcctgagaaactgcttgggtgatttgactaataaaggccagtccattatcggactgtatagaggtgggaaggccaaaccgaggaattacgtctgacagaagggaagaaatgactgcagtgaccttctcagaccctgtgggaaaggcctctacccatccagtgaaagtgtctacccagaccaagaggtattttagtttcctgactcagggtgagtaaagtcaatttgccagtcctgggcgggggcaaatcccccagcttgatgtgcaggaaagggatggggcctgaacaatccctgaggagtagtagaatagcagatggaaccctgataaatgatttccttgaggatagatttccatgatggaaaggaaatgagagtttctaagaggcgggctagcagcttgtaacctacatggaagaggttatgaaatgacagaatagaatgggcctgtgaggctggaaggagatattttccttggtttaagaaccatttgtcttgtgtgggaaaagattgataggtggaagtttcagtgggagagtaggtgggagtgaccgatgagaagaagaaaaactggccattggaacgttagctgcttctttaaaagctaccttatcagcataagcgttgccctgagctacgggatctgatgccttttgatggccctgctttgactccagctttctttggaagtaaagcggccttgagaagagtttttattaaagaggcattaatgatggaggacccttacgagggaggaaacctttcagcccataaaacagtatggtggcgcaggatatggggtcagtataaatattgacgcgtagtccctttgcaagagtgagggcccgagttaaggcaatgagtttgacttgctgagaggtagtggagggaggcagagcggtagcctcaatgatagatgtggaagatactatagcatagcctgccttttttggtgagtggcgatcaggcctggtggaactgccatcaataaaccaaatgtgatcagggtgaggaacaggaaagaaggaaatatgcggaaatggggtgaatgtcagctggatcagagagatacagtcatgggagtcaggtgttgtatctggaataatgtgggaggccggattgaagtctgggccaggaacaatggtaattgtgggagactcaacagagactgagtatagctgaaggagccagggagcagaaagtatatgtgtcaggtgtgaggaagacaatagattttggaagttatgagaactgtagagagtgagttgagcatagtttgcgattttgagggcctctaaaagtattagggtggcagcagccgctgcatggagacatgatggctggcctaaaacagcaaggtcaagttgtttggacaaaaaggctacagggcgcggtcccggtccttgtgtaagaattccaactgcacagccctgcactttggctgtgtgtaatgaaaagggttgggatgagtcagggagagctagagtgggggcagtctctaaagctgtcttcaaggaacggaaagaggaatggggaaaggatttaggatcgatagggtcagctaggtttccttttgtgagtttatgtaaaggttttgttaggatggcaaaaccaggtatccaaaggtgaaagtatccaaccatgcccaggaaggaaaggacttgttgttaagtagaaggtgttggggtttgagagatcagtcagacatgatcgacagggagagcacgtgtgtttttatgaagaattatgccgaggtaggtaatggatggagaagaaattggagctttgtgggggatacctgatatcctttggagaataaatgttgaaggagcaggagagtgtcttgttgagaagattcaaaggaggggctacaaagtagaaggtcatcaatatattgaataaggtgagaagcagaggggtagaaagaaaataaatcatgggaaagagcttggctgaagtaatgagggctgtccctgaagccttgcggtagcacagccctggtaagctgcggggactgatgggtgtcagggtcagtccaggtaaaagcaaagagaggctgggatgaggggtgcaggggaagagtgaaaaaagcatctttaagatcaagaacaaaatagtgagttgtggaggaaggtattgaggacaaaagagtgtatgggttgggcactacggggtggataggcaaaacaatttggttgataaggtgcagatcctgaactaacctgtaagacttgtctggtttttggacaggtaaaatggggaaattgtaaggagagcttttatgttttagaagcccatgctgtaacaggcgagtaataacaggctttaatccttttaaagcatgctgtgagatgggatattgccgttgagcggtgtaagggtgattaggttttaatgggatggtaaggggtgcatgatcggtcaccaaggggggagtagaggtgtcctatacttgtggtttaaggtggggagatacaaggggaggatgtgaaggaggctttgaactgggggaaaaggtggcaatgaggtgtggctgtaacccaggaatagtcagggaagcagataatttagttaaaatttctgaacctaataagggagctgggcaggtggggataactaaaaaggagtgcataaaagaatgttgtccaagttggcaccagagttggggagttttaagaggtttagaagcctggccatcaatatccacaacagttatggaggcaaaggaaaaaggcctttgaaaagaaggtaatgtggagtgggtagcctctgtattgattaagaaggggacgacttactctccactgtaagagttacccaaagcatctgtgatggtccaggaggcttccgaggtgttcaggcagtgtcagtcttcagccgttaagccgagaagatctgggaaggagtcagtcagagagccttgggccagagttccaggggctctgggagtggctgctgggcgagttggacattccgatttccagtggggtcccacacagatgggacacagcttaggaggaatcctgggctgtgggcattccttggcccagtggccagatttctagcacttatagcaagctcctgggggaggaggttctggaggaacccctggcagctgcggttcaggcgtttggaagctcttgtgtgatggagatgtggctggggtttgtctcacagtgggggcaaggaattacaacttagaaatacattgctacttggcttcctctactctattattgtacaccttgaaggcgaggttattaagtcctattgtgcggtttgaggctggaatttaatttttggagctttatttaatgtcaggagcagattgggtaataaaataaaatgtatattgagaataagacggacttctgacctttcagggtgtagggctgtaaagcatctcagagttgctgctaagtgggcaatgaactggactgggttctttaccttgggtagtttctttctttttttttttttttttgagctggagtctcgctctgttgcccaggctggtgtgcagtggcacgatctcagctcactgcaagctccacctaccgggttcacgccattctcctgcctcagcctcccgagtagctgggactacaggcgcctgccaccactcctggctaattttttgtatttttagtagagatggggtttcaccgtagtctcgatctcctgacctcgtgatccgcccacctcggcctcccaaagtgctgggattacaagcgtgagccaccgtgcctggctggtagtttctttaagtttgtcataattaacagctttgtaagctgcctttttaagcccttcaacctggcaggaaaccatgtaatctcacctagctatacctggggaatcagcctgatagttccattttggatctcctaggggaactgctctaataacttcctggaggtctggctcgtgaagccggcggttatcagtgtgagattgggctagagaaaaaactctttcctgttcatctggggagagggtagaagttaggatgacatttaagttactccaggttaaattgtaggacagagttagatatcggaattcctgtatatatttagtggggtctgatgagaaagagcctaaacactggctgatttgggaatgtctgatagagaaaaaggcacatgtaccctgactatgtcttcagctccaaccacctctctaagaggaaattgttggacaggtcggggagggctagtcacggaacgaaactgtaagccagaccgggtgtgaggaggggaggtgatagaaggatgatagggttggggagcagaggctgaggaaaattgggacctggtttggcctggtgaggagcagcctggagaaaaggggagaggtcagatgagtccatagaaaagaaggattcaaaggactcagagcttggggtggagactgaaggaacagacaggagagaaagaagaaagatttgggatgagtctcattgggagcagagactagggagggactaatgtgtaaaagaatgcctggacgtcaggcacctcaggccatttgcccatttttcgacaaaaattatctagatcttgtaggatagacaaatggaaggtgccattctctggccacttggagctagtgtcgagtttgtattgggccaagcggtattgcagaagaaaataagacgcttagattttaggtcaggtgagagttgaagaggttttaaattcttgagaacacaggctaagggagaaaaaggaagaatggagggtggaaagttgcccatagtgaaggggacaagtttaaagagaagggtagagacatggagaaggggggtggggagcagccctgggctgcaatgtgggtgagcagccaaaccaggtgtccccgcaattgacttgccaccaagggaatgtgggtgaatgaccaaggcaggcgtccacgcagagatcagacaccaatgcaacgtgggtgaataatcagagaggcgtccccgcaatgattaaacaccaagggaaggctgccttcccgagtccgtgactggcgccggagttttgggtccacgaataaaatgtgtctcctttgtctgtaccagaaaatgaaaggaattgaaattaagagaagggagagattgaagggtggcgccaagattgaaaggaaaaagaggttgagggatagtgagagaggttggagaagagagtaaaaagaggccacttacccaattttaaatcagtgagatattccttgggctggttggtctgaggaccagaagtcataggtggatcacttcatggagtgagggtgaggacaggggactggtctcccgaaggagtcccactgacctgggtcttcagcaccaaatgtctcacgtgtccatgtgaagagaccaccaaacaggctttgtgtgagcaacaaagctgtttatttcacctgggtgcaggtgggctgagtccgaaaaaggagtcagtgaagggagataggggtggggctgttttataggatttggataggtaaaggaaaattacagtcaaagggggttgttctctggcgggcaggggcgggggtcacaagatgctcagtgggggagcttttgagccaggatgagccaggaaaaggaatttcacaaggtaatgtcatcagttaaggcaggaacaggccattttcacttcttttgtgattgttcagttacttcaggccatctggatgcatacgtgcaggtcactggggatatgatggcttagcttgggctcagagccctgacagtgagttagacagtcctattttcattggggtcccacacagatgggacaaggcttaggaggaatcctgggctgcgggcattccttggcccagtggccagatttctggcacttgaatcaagatcctggggtaggaggttctggaggaacccctggcagctgcggttcaggagtttggaagttcttgtgtgctggagatgtggctggggtttgtctcacagtggaggcaaggaattgcaactcagaaatacgttgctacttggctgcctctactctattattgtataccttgaaggcaaggttaattaagtcctgtcgtggggtttgagggccagaatttaatttttggagttttatttaatgtcgggagtggattgggtaataaaatgtaaattgagaataagacggccttctgacctttcagggcctagggctgtaaagccgctaagggttgttgtgaaatgggccatgaactgggctgggtttttcatatttgatgaaagagcctaaatgctaactgatttgggagagttcagataaagaaaaaggagcattaaccttgactatgcctttagctcccgccacctttttaagaggaaattgctgggcaggtgggggagggctagtcatggaacgaaactgtaagccggacggggtgtgaggaggtgaggtgataaaaggattgtagggtgggggagcggaggctgaggaaaaactgggacctggctcggcctggcaacgagcagcctgtggaggaggggagaggtcagatgggtccatagaaaaggaagattggaaagactcagagacgcttggggttgggactgaggggacaggcgggagggaaagaagcaagatttgggatgagttgcattgggaacagagactagcgagggactgatgtgtaaaagaatgcctggacgtcaggcacctcagactgtttgcctatgttatgacaagaattatctagatcttgaaggatggaaaaatcgaaagtgccatttttctggctatttggaacaactgtcgagtttgtattggggtcaagtggtgctgcagaagaaaataaggcatttaggttttaggtcaggtgtcggttgaagaggttttaaaagtttttgagaacacaggctaagggagaagagagaggaatggagggtggaaggttgtccatagtgaaggaggcaagcccagagaaaagagagggtagagacacagagagaaaagttagtgggtgcttgtgccccaggaaagtggagagaaaagatagggtagagacacggagagaaggggtggggaatgcttgcctcccaggaaagtggagaaggggtgggaggtgcttgccccccaggaaagtggaaaaaggggtgggaagtgtttgccccccaggaaagtggagaaaaggtaggaggtgcttgccccccaggaaagtggaaaagggatgggaggtgcttgccccccagaaaagtggagaaaagagagggtagagacatggacagaaggggtggggggtgcttgccccccaggaaagtggaaaaggggtaggaggtgcttgtcccctaggaaagtggagagaaaagagagggtagagacatggacagaaggggaggggggtgcttgccccccaggaaagtggagaaagggtgggaggggcttgccctccaggaaagtggaaaagggatagagacacagagagaaggggtggggagcagccctgggctgcaatgtgggtgagcagccaaagcaggcgtccctgcaattgacttgccaccaagggaatgtgggtgaatgaccaaggcaggcgtcactgcggtgatcagacaacaatgaaatgtgggtgaataatcaggcacgcgtccccgcgtgattaaacaccaagggaagactgtcttcccgagtccatgactggagccggagttttgggtccacggataaaacgcatctcctttgtctctaccagaaaaggaaaggaactgaaataaagagaagagagagattgaagggtggtgccaagattgaaaggagaaagaggttgagggatagtgagagagattggagaagagagtaaagagaggccacttacccaatttaaaattggtgagatgttccttgggctggtcggtctgaggacctgaggtcataggtggatctttcttacggagcaaagagcaggaggacatgggatttatctcccaagggaggtcccccgatccgagtcacagcaccaaattccactcgcgtccgtgtgaagcgaccaccaaacaggatttgtgtgagcaataaagctttttaatcacctgagtgcaggcgggctgagtctgaaaagagtcagcgaagggagataggggtggggctgttttataggatttgggtaggtaatggaaaattacagtcaaatggggttgttctctggcgggcaggggtgggggacacaaggtgctcagtgggggagcttttgagccaggataagccaggagaaggaatttcacaaggtaatgtcatcagttaaggcaggaacaggccattttcacttcttttgtgattcttcagttacttcaggccatctggatgtatacgtgcaggtcactggggatatgatggcttagcttgggctcagaggcctgacaatggggtttcaccatgttggtcaggctggtcttgaactcctgacctagtgatctgccccccccaccttggcctcccaaagtgctgggattacaggcatgagccaccgtgcccggcatgactcccatcctttaaagattagttttatgggcatggtggctcaggaggctgatgcaggggaatagcttgagcctgggaagcagaggttgcagtgagctgagattgagccactgcattccagcctgggcaacagagcaagactctgtctcaaaaaaaaaaaaaaaagtgcaaagaacccttaatagacatttctcaaagacatacgaatgaccaccaggtacattaaaaaaaaaaatgctcaacatcactaatcattagagaaatgcaaatcaaaaccacagtgagatatatcacttcacaccattagaatggctatttatcaaaaagacaagtgaagcctgggcaacatggcaaaacctcatctctaccaaaaaaaaaaaaaaaaccacaccaaaaatacagaaactagccagacatggtgacacacacctgtagtcccagctactcaggaagctgaggtgggaggatcgcttgagcccaggaggtcaaggctgcagtgagctatgatcgtgccactgccctccagcctgggtgacagagtgagaccatgtctcaattagaacaaaacatttaaaaaggacaaatgataagtgttgatgagatgtggagacaagggaaccctcgactctgttggtgggaatgtaaattggttcagtcattatggaaaacagcagggagtttcttcagaaagttcaaataggcaataggagtgccagtacatcccagcaacctcacttctgggtacctatcaaaggtaattgaaataaatatgtcggctggggttggtgcctcatgcctgtaatcccagcactttgggaggccgaggcgggtgaatcacctgaggccaggagttcgagaccagcctggacaaacatggtggcaacatgcagaggctgcaatgagccaagatcgtgccactgcactccagcctgggcaacagagtaagactccatctcaaaaaaaaaaaaaagattagttttgcttgtttggtttggtactttacacaggtggaatcctacaacattattctttcttatctagctgctgctgctttttttttttttttttttttctgagacaggatctcactctgttgggtagtcctgagctttgaactcctgggctccagcaatcctcctacctcagcctcccaagcagctgggaccaaaggcatgtaccaccaaactcagataattttgcttactttttgtagagatggagtcttgctatattgcccaggcttgtctccaactactgggctcaagcgatcctcctatctcggcttcctaaagtgctgggattagcagtgtgagccactacacctggcttatatctgactttttcccctcagcattaggttgtgagttgcaagtaactgtagttcattctcactgcggaatagtattgtattatgttattaaatgacaatttattttccattctactattgacagacatgagggtcatttccagtttggagctattataaataatgctgctatgaatattctagtgtgtgtcttttggtggacataggaacacgtttttgtttttgttttttaagatggagtttcactcttgctgcgcaggctggagtgcagtggtgcaatctcggctcactgcaatatccacctcccaggttcaagcgattctcctgtctcagcctcctgagtagctgaaattacaggtgtccaccaccacacccggctaattttttgtatttttagtagagaccgggtttcactatgttggccaggctggtctcaaactcctgacctcaggtgatccacccacttcggccccccaaagtgctgggattacagttgtgagccaccgcgcctggccatgaacacgtttctgacgggtacatgcctaggagtggaattgctcgattatagagtgtgcatatgtttggctttaataaatactgccaatagttttccaccccacccccagcagtatgacttgccatgcaccacatcctcactaacgtttgatgttttctgtctttttccattgtagccatctggtgagtgtgtgcatagtggcacactgcggtttaagtgtgtatttctgtgatgactaataaaaccaagttgctttttatattcaccatgtgggtttccttctcgtaaagtgttcacgcctcagccattatctttctttttttctttccttcttctttctttctttcttgcttgctttccttcttccttccttccttccttccttccttccttccttccttccttccttccttccttccttccttccttcctttttggagtgcagtgatgcaatcgtagctcactgcagcctccacctcctggcctcaagcgatcctcctgcctcagcctcccaaagtgctaggattacaggagtgagccaccatgcccagccccagctaattaaaaaatttttttggctgggtgtggtggctcacacctgtaatcccagcacttgggagaccgaggcaggtgaatcacctgagctcaggagttcaaaaccagcctggccaacatggtgaaaccccatctctaccaataatacaaaaattagtcgggcatggtggtgtgcgcctgtaatcccagctacttgggaggctgagacaggagaatcgtgtgaacctgggaggcggagattgcagtgagctgagattgtgccactgcactccagcctgggcgacagagtgagactctgtctcaaaaaaaaaaaaaaaaaaaaagagtgtgaactaatttgaaaatagggcctttgcagaagtaattagtgaagaggaggacatactggattacagtgggctctaaatccaatatgtctttataagaaggccatggagggtggtggctcactgctgtaatcccagtactttgggaggtgggaggatgccttcagccactgcactccagcctgggtgacagaatgagactcagtctcaaagaaaaaaaaaactaaaaaaaggaaagttcagtctaaagaagagaacatcagggcaaacatgatcatggcttcagcggatactgtcaggtaactccccgtatcccttcagcagtcacttttgtaaaccaaaggccacttcctggggactcttcctgagggccttgttcctggtcacagagaaccctcagtttgatcataacacaagccaggagtgtagggtgcagccctcaaccagtgacagcagggaactggggggtacctgacccacccgctaagccagctctgaggtctgccctgcacaggctcccagaactccttggctgctcacgccatgccctgcttaataactccccttgcgttgctgcctctgcttccttgcctcagtttccccctcctctcctggggctcccgtggaatcacctcccaaataaaggacttgcaccagaatccttgtctcagggcctgctggaggaactgaaataaaaacaacgatcttcaaatctgcctaagcctcaatttcctttatcttccaaaataaaagacaagttaagcatttttgtaaagaacagggtcaataggtagaagaaatgggaatatagatttcagtcaaaaaagaatttgttttttttccttctgaaatggagtctcgccctgttgcccaggctggagtgcagtggcgtgatctcagctcactgcaacctctgcctcccggttcaagcaatactcctgcctcatcctcccaagtagctgggattacagacacgcgacaccatgctcagctaatttttgtatttttggtagagacggagtttcaccatgttggccagactcatcttgaactcctgacctcaaggtatccacccccatcagcctaccaaagtgctggcattacaggggtgagccaccgggcccgaccaataattctttttttaaagagacagagtcttgctcggtcacctaggctggagtgcagtggcatgatcatagttcactgcagccttgaactcctgggctcaagtgaccctcctgcctcggcctcctgagtagctgggcctacaggtgcacatgccaccatactcagttaatttttatttaattaaaaaaaataggccgggtggggtggctcacacctgcaatttcagcactttgggaggctgaggcgggcagatcagttgaggtcaggaattcgagaccagcctgggcaacatagtgaaaccctgtctctactaaaaatacaaaaattacccgggcatggtggtgcatgcctgtaatcctagctactcagaggctgaggcagaagaatcattcgaacccaggaggtggaggctgcagtgagctaagattgtgccactgtactccagcctggatgacagagcaagactctgtctcaaaaaaacaaacaaacagctgggcatggcggtttatgcctgtaatcccagcactttgggaggctgaggcaggtggatcacttgaggtcaggagttcgagacaagactgaccaacatggtgaaacaccatctctactaaaaatacaaaattagccgggcgtgatggcgcatgcctgtaatcccagctacttgggaggctgagtcacgagaattgcttgagcctgggaggcagaggttgcagtgagccgagattgtgccatagcactccagcgtatgcaacaggagcaaaactccatctcaataaaaacaaaaacaaaaacaaaccaccctctcatgatcatccagactgttgtgcctggtttgagtgacaggcaactcaccatctatcctcttcccacctacaacagctctgactatcacaaacttctgttaagttcttttaaaaatttggctgaagccaggtgtggtggctctcccctataatcccagtgctttgggaggctggagtaagcagatcgccttgaagccaggagtttgagaccagcctggcaacctttgggctctacaaatttctttttttttgtgacagagttttgctcttttttcttaggctggagtgcaatggcacgatcttggctcactgcaacctctgccccccaggttcaagtgactctcctgcctcagcctcccaagttgctcggattacaagcatgagccaccacaaaattagcccggctaatttttgtatttttagtagagacggggtttcaccatgttcgccaggctgatctcaacctcctgacctcagacgatccccctgcctctgccttccaaagtgctgggattacaggcgtgagccactgtgactggccccacacacacacacaaaataataataataattgaccaggtatggccagacgtggtggctcactgtaatcccaacatttttgaaggccaaggtgagacagtcacttgagccaagagtttaagaccaacctgggccacatagagagacctcatctctatttttttttcttttttgagacagtcttggtctgtcgcccaggctggagtgcaatggcgggatctcggctcactgtaacctctgcctcctgcattcaagcgattctcctgcctcagcctccctagtagctgggattacaggtgcccgccaccgtgcctggctaatttttttatttctagtggggacggggtttcaccatgttgaccaggccctctctctcactatatatatatattatttgttgttgtttgtttgttttgttttgttttaagcctcgggtgattgtgatgatctgtcaggtttgggatctgttagatctctcaaatgcccccagccagccctggccctacaggtgtggccccaagaagatgggctggcacctgcctggaccctgtttttaaatatccattgtcgaggttgggctactctatgatcacatcttgagaccatccagagctccacacagagataagcaatgcttagaaaggaaacaaaactttgcccaagagccagaaacctatcttcaacaaccaattgtgctataaagtaacttagttcagttcactggaatattacttaatttcctctgctttttctttttaaacaagaaagtgttgactcagccaacagcactgggaaccagactccctggggcctgcctgcccctgctcttctcccaaattctcttctttttttgtccctgttgatggaattcaataaagggatctctaccatctgtcacttgtttttttttgttgtttgtttgtttgttttttttttttttggcagagtctcactctgtcgcccaggctgcagtgcagtggtgccatctcagctcactgcaacctccacctcccaggttcaagtgattctcctgcctcaccctcaggagtagctgggattacagttgcctgccaccatgcccggccaatttttgtgtttttagtagagacagggtttctccatgttggccaggctgatcttgaactcctgacctcaagggatccgcccacctcggtctcccagagtgctgtgatcacaggcatgagccaccacgcccagtgccagattatctttcttcactgtctaatttcattcctatgagtattagtttacttttcctttgttgggtcaaaagtgctgcttctgttcccaaccacagaattctctggaattgttttcagggccgtctcagtctcataaaaggggatcaggcaggaggagtttgggagaaacctgagaagggcctgatttgcagcatcatgatgggcctctccttggcctctgctgtgctcctggcctccctcctgagtctccaccttggaactgccacacgtacgtagctggcccattcccctcctggggttccttcccggaccgcctgggagtggatggaaatgagtatctccaaacccttcctctccctgatttttaggtgggagtgacatatccaagacctgctgcttccaatacagccacaagccccttccctggacctgggtgcgaagctatgaattcaccagtaacagctgctcccagcgggctgtgatgtgagtatttctcggacgtactttctggggccccatcagtcatgcaacaggatgggtgctgggcagacccccaggatgagccttgggatgggaacctggaaaccccacctctgcacactaacaagtgtgactctgagcttcaggtagaacctgactttttttttctctttttgagacggagtttctttcttgttgcccaggctagagtgcaatggcacgatcttggctcactgcaacctccccctcccgggttcaagcaattttcctgcctcagcctcccaagtagctggaattacaggcacatgccaccatgctcagctaatttttgtgttattagtagaatttcaccatggttggccaggctggtcttaaacttctgagctcatgtgatttgcccgcctcagcctcccaaaatgctgggattacaagtgtgagtcactggacccagccaatccccacttttaataaactcacagtgaagtaagagctcaggaatcatcagctatgatgaataaccttgaaaatgtggctaacaattaaatgacatgttgagtgcagggttcctttctggggtgatgaaaatatcctaaaattgattgtggtgatggttgcataatctatgactatactaaaaaccattgaattataattatagcctttaaattggtggagttgtacatggtggggaggtttagacgatcgcttgagcccaggagttcaaggctgcagtgaggtatgatcgcaccactgcactccagcctgggtaacacagagagacttcatccctaacaaaagagaaaaaaaagagtgaattacagttatcccccagtaaccacaggggattggtgccaggattttggcatacaatttcccctgaatttatgcagcttttgcatcaccgagttttgtattttctatcctcctttggttggcaaaaggctgcctatgagtgggcccacagagttcaaatccgtgttgttcaagagtcaactgtatgtgccgtgtgaattatatcccaacaaagctgttctattacaatgaaagaatcagccaggtgaggtggcgcaggcctgtaagcccagttactccggaggctgaggcaggagaatcgcttgaacccgggaggcggagtttgcaggagtagagatcgcgccactgcactccagcctgggtgacaagagagaaactgtttcaaaaaaaataaaataggccgggcgtggtggctcacgcctgtaatcccagcactttgggaggctgaggtgggcagatctcctgaggttgggagttcgagaccagcctgaccaacgtggagaaaccctgtctctactaaaaatacaaaattagctggacgtggtggcgcatgcctgtaatcccagctacttgggaggctgaggcggaagaatcacttgaacctgggaggcagaggttgtggtgagccgagatcgcgccattgcactccagcctgggcaacaagagtgaaactccgtctcaaaaaaaataaaaaataaaacaaaataaaggctaggcgtggtggctcacacctgttatcccagcactttgggaggccaacacaggcggatcacctgaggtcaggagttcgagaccaccctggccaacatggcaaaaccttgtctctattaaaaacacagaaattcgctgggtgtgctgatgcgtgcctataatcccagctacttgggagtctgaggcaggagcatcacttgaacctgggaaatggaggttgcaatgagctgagatcatgccattgcactccaatgtgggcaacagagtgagagttcgtctcaaaaaaaaaaaaaaaaaattaagtgtcctggtgcaggttacatgctgcaggctagaactggtggaaaacggtaaatggtacctggtagaggtgggtctggaggcatagtttccagtggaaatcaagataggaaagaggagggagacaaggcccaggagaagaggggacagggacagagagcaacaagtttgtggcaaggccagaagactagtgagagagctgcccctccttccctttctatcccaccccaggaggcaaagagtctcaatattgacttatccgtgtctctttttcacagattcactaccaaaagaggcaagaaagtctgtacccatccaaggaaaaaatgggtgcaaaaatacatttctttactgaaaactccgaaacaattgtgactcagctgaattttcatccgaggacgcttggaccccgctcttggctctgcagccctctggggagcctgcggaatcttttctgaaggctacatggacccgctggggaggagagggtgtttcctcccagagttactttaataaaggttgttcatagagttgacttgttcat

SEQ ID NO: 77 - DNA, 1069 bp, Homo sapiens
cggggccccccccaggcctggcgggaccaggatgctgccctgtcacctgccccccagccccacacaacgcccccacccacccgaacatccagtctgactggagacagccggatgccctctgaccccgggcccgaggcgggcagtggctggccgggcctcctcatgtcctgcctgaagggtccccatgtcatcctcaagatggaggccatgaagattgtccaccctgaaaagttccctgagctaccggctgccccctgcttcccgcctgctccccggcccaccccaactctggcacccaagcgtgcctggccctcagacacagagatcattgtcaaccaggcctgtgggggggacatgcctgccttggaaggggcaccccataccccgccactgccacggcggccccgtaagggaagctcggagctgggctttccccgcgtggccccagaggatgaggtcattgtgaatcagtacgtgattcggcctggcccctcggcctcggcggcttcttcggcggcggcaggcgagcccctggagtgccccacctgtgggcactcctacaatgtcacccagcggaggccccgcgtgctgtcctgcctgcactctgtgtgtgagcagtgcctgcagattctctacgagtcctgccccaagtacaagttcatctcctgccccacctgccgccgtgagactgtgctcttcaccgactacggcctggccgcgctggctgtcaacacgtccatcctgagccgcctgccgcctgaggcgctgacggccccatccgggggtcagtggggggctgagcccgagggcagctgctaccagaccttccggcagtactgtggggccgcgtgcacctgccacgtgcggaacccactgtccgcctgctccatcatgtagtagcgcctgcctgcccgccactgcccgctgagcctcgctcgctgcttcttcagggacccggccctgccctgccgcccgctgacccttccttccccaccatggcttccggccccaccccgagtggcattgtcgctgcagccaactttgccattaaaactctttgccaaagttt

SEQ ID NO: 78 - DNA, 726 bp, Homo sapiens
tccccagacttgtgtccagggaagatagtgttgagggccctcaaggagagcggggcagggatgcctgagcagcacaaggaccccagagtccaagaaaatcctgatgatcagagaacggtccccgaggtcaccggggatgcacggtctgcattttggcccctgcgggacaatggaggcccctctccctttgtgcccaggcccgggcctctgcagacagacctccacgcccagagctcagaaatcagatataaccacacatcccagacatcctggacgagctcgagcaccaaacgaaatgccatctccagctcctacagctccacgggaggcttgccggggctaaagcagaggagggggccagcctcatcccgctgccagctgaccctcagttactcaaagacagtgagtgaggacaggcctcaggctgtctcttcgggtcacacacggtgtgaaaagggggcagatacagcaccagggcagacaatcgccccaacgggtggctcccccagatcccaggactctaggccccgtagacgcaagattcccctgctgccacgcaggcgaggggagcctttgatgctgccacctcccttagagctggggtaccgggtcacggctgaagacctgcacctggaaaaagagaaggcattccagcgcatcaacagtgcactgcacgttgaggacaaggccatctcggactgcagaccctcacggccttcccacact

SEQ ID NO: 79 - DNA, 245422 bp, Homo sapiens
gccgtcccgctgttgtaagtggagggacggcagtcagctgaccctgcagtgtgcaggcgagcgcagggagtacgccatgtcctgagaaggggcgattctcaggctctggcagttacagcttctcctcaccctgccgagcaaccaggccacggggctccgtgcatcgccacctagagtgttaccctcttccttgttcacagaggttctccgcagtgtgtgagaaagaggccctctctcaggtactgctcctctgattaacatcccccaccgcacctccaaatgtcaacagatgaacacacaaccagctgcacgaggaccacaaaactgaacagaggttgttgctattgccatcccctttgggtatagctgtcttggcagtggaaactcctgccccaaggtgttttcttgctggattagacatgtgatctgtggcgggagagccagagagaggagagaagatccagtgagaatgggttctaaaactgcaccatctagtggtcttacagcagagaggcgagttagaaggaggccaaatcagagttccagaaaggaagggagtaaggaaagtgggagaaagataccagaaggaatatttagcaagtggagaatttgtatttgatagtgttggccagtggggcccagtttttgagatttggtcctcccactttgcaatcaaccttaagaatgcacctcagagtcagtaggctgtctactttcaggagtaggccagtacagaggtggtgattgatgagacaaattactttgaccttgcaaagcctgaaatcactgaggcaggccaagggttggtagtgtgatgccagatattcctttagtagggatttaactgcattaaacaattagaaatgagacttaaaatccaaattcaaatacttgtgacaaaggagagtggatacacttgacaccatacttaggaatggaaaggggaatctaagcacactgaagtaaagtcatttatgtaacagtgcctagaacataataggtgctcaagaagtgcttgttgaatgtcactttatgaattatctaccttatttatttaaaaatgcatgacaccattggatactgtgtttagagtaaaataggtcttgggctatggcttgtagcttcaaagtgctattggttttggagatttatttttccattttataacttaaatgtaataatcatagaaatataaaaaagaaagcgtaaagaaaaaaattcccaaacactcaagagataacctgtattgacattttgatgtttatccttctggaaatacccccatgcaaatctatgtgtctatatctataggtatgtatatattttacaaaatgatgatttatcaatttgagatcttttttttaaatgtagctgttttatagttacaaatttccctctgagctgatgcttttgctgcatctctcaagtgtttggtgttatgttttcattcatctgaagatattttctcattttctgtgatttttttttctttgacacattggttgtttaaaagtatgttgtctagtttccaaatatgtatgaattttccagttttccttctcttattgatttctagcttcattctgctgtgttcagagaagatacattgtatggtttcaatcttttaaaatatattaaggcttgttttgtggcctaccatatggtttatcctggagaatattccatggaaagaatgtgtatttgcttttgttgggtggaatgttcttcatatgcgttaggtctaattggtcaatagtgttgttcaagtcctatattttcttactggccttctgtctagggttctactcattattcaaagtgagaaacacaaaaaatcagccgggtgtggtggtgtgcacctgtggtcccagctactggtgggctgaggtgggaggattgcttgagaccaggaggttgaggctgtctgagccatgattgtgccactgcactgcagcctgggccacagagtgacaccctatttcacacaaaaaaagtggggtattaaaatctccaactattattgtagaactgtttctttttcccttcaaatctgtcaatgtttgcttcatataatttgagcttgttgttttctacaaataattattttctataaataaatattataaacaagaagaaataaagtcttcttgtttaattgacgcttttatcaatatataatgcacttcttcgtccctcataacattttttgacttaaagtctattttgtctgataatagtatagcagctccagctctcttttggttattatttgcatggcatatctttttccctagttgtattttcaacttattaatgtccttgaaactaaaaagaatcttacactatatagttggatcacatttaaaaaaatctattttgccaatctttgtctttttattggaaagtttaatccatctacatttaaagtaattactgctatggaaggacttctgtcattttgctatttatttttacatgttttctgttcctcagttcttccattactaccatcctttgtgtttagttgattttttttatagtgtatcatgttgattcctttctcattccttttctgtatatatatttttagttattgtcttagtggttacttagagattacaattggcctcctaaacttataacaacctattttgaattaaaaccatcctagcttcaatggtatacaaaaccctgctgttatataatacatgtctgtctctacttttttgtgtgttattgttgtcacaaatagcatctttatacagtgtgtacctattaacatagatttattataattattttgtacatccatcatttaaatcatacataaaaagaggttcaaaccaaaaatacaatgctggctattaaatcacctatatagataccaaaaccagtatttttttatttcttcatatggcttcaagttactatatctttcatttctacttgaggatatccttttagaatttcttgtatggcaggcctactatagatgaacttaggatttgtttatctgggaatgtcttaatttcttctttatttctgaaaggtagttttgctgaatgtagaatttctggttgatggtatttttttcaactgtaaatatgttgtcttactgctttctcacttccatgaattctgctgagaaattgactgttcaccttcagtatcttaatatgtgaggaatcacttcttttttgctcctttcaatattttctctttcaaaatgtctttctcttttgaaagttttattgtcatgtatcagtgtggatcttttatgttattcttttggagtttgttgagcttcctgaatgtgtacaatcatttcttttatcaaatttgtaacattttcagccattacttctttaaatattttttctttccctttctctctctcctctttttctggagctcccaccatgcataagtggtacacttaagggtgtcttataggtctctgaggctctataaatttttcttcattcttcttccttttcttcaggctgaagaatttcaattgacctatcttcccctagctctttgaacatttttaagacagttgatttaaagttttggtccaatatctgtgcttccttagtagcagtttattttaatttctcctagccatactttgttgtttctttgcatacttcataataaaaaaacaaaaggtaaagtctggacagtttgtatgttacttgcatcattccgtgggcatgcatgtgcttttctggatgtccaatacatgcagacacttttttttttttttttttttttgagatggagtcttgctctgtcgcccaggctggaatgcagtggcgcgatctcggctcagtgcaagctccgcctcccaggttcacgccattctcctgcttcagcctcccgagtagctgggactacaggtgcccgccaccatgcccagctaattttttgtatttttagtagagagggggtttcaccgtgttagtcaggatggttttgatttcctgacctcgtgatccgtcctcctcggcctcccaaagtgctgggattacaagcgtgagccaccgcgcccggccagaaactttttgatacactaattattcaaataatctctctccccagcttttcctcccaaactttcagtgtgtccgttatttaaccatgattttagtctttttacccagatgccagcaggttgcctttcaatgtttttgaggaatgccctctttatagccacttttccgtcctgagagttatgttgatggatacttaggttatttccatatcttggctatttattcacaataatactgcaataaacatgatagcacagtagttttgatatttaagcctttctgagaatgtgcccatttgtattagataatatatatctatattagatatatagatattagaaatatatattagatattttatctaatgtatctaatatattagataatatagataatctatattgtaatgtcccttttttcattacttattttagttatttgagtctttttttaatgtggtcaacctagttaaaagcttttcaattttgttgatattttgaaaaaacaacctttaaattatttttctgtcatttttatattctcattttatattctccattatattaacatctctctaatctttattatttcattccttctgcttggtgtgggtatagtttgctcttttttatagttttttaaggtggaaaattaggctattgatttgggacctttgttgcttttaaaatataggcctctatagcaataaattttcctctaagcattgctttcctgtatcccataagttttagtatgttgtgttttcatttggatttatctcaaagtattttctaatttcttttgtgatttcttctttaatccattggttaattaagaatgtgttgtttaatttccacatatttctgatttttctaaattttttctgttgatttatcttttaatttcactgtgattgcagaatatattttgtatttttttttttttttttttaatgagacagagtctcctgtggcccaggctggagtgcaatggcatggtctcggctcactgcaacctctgcctcctgggtcaagcaattttcctgcctcagcctcctgagtagctggaattacaggcatgtgccaccatgcctggctaatttttgtatttttagtagagatggggtttcgccatgttagccagactggtctcgaactcctgacctcaggtgatccaccctcctcggcctcccaaagtgctaggattacaggcatgagccactgtgtctggccttgtatgattttaatcttttaaaatttactgaggcttgttttatggtataacatatggtttatcttggataatgttcatgtgcacttaaaagaatgtatattctgctgcggttgggcggaatgttctctagaagtctgttaggtctagttgatttatagtgttagttaagtcttctctttcttggttgatcttctgcttagttgattctattattgaaagtggagtattgacatctccaactatattcttgaattatccatatctcacttcaattctgtaagtttttgcttcacatatttttggggttctgttgttagggctatatgtgtttataatcattatatatacctgatagattgaccttcttatcattataaaatgtactttttcaagtaacaatttttgtcctaaaatctattttgtctcatagtatagccactccagctctctttgattacttcatgcatggcatattttaaaaaatctttttactttcaacctatttgtgtcttttgatctaaagtttgtctcttgtagacagtatatacgtagtggtatagttggtttttttggggggagggtccattctgactatctctgccttttgatttataagtaggatatacatgttttattttattattttatatatgtcatatattttttgttcctcaagtctttcttttattgtgttaaatagatatttcctagtgtaccttttaaatttgattgctgtttattttactatttttggagttattttctttctgatttatctggatattacagttagtttaatcttagcttaaaataatcttgtttggatttatactaacgtaacttcagtattatacaaaaactttgctccagtatactatgttcccgtcaccattctttgtattattattttcatacaaattacatctttacagattataaacccattcacacagctattgtaattgatttatgctgttatcttttaaaacaggtaggagaaggaaagagttagatagaaaagtgtgtttataacatcttttataatactatattagtccatttttcacactgctgataaagacatacccgagactgggcagtttacaaaataaagaggtttaatggacttagagttgtgactggggaggtctcacactcatggcagaaggcaaggaagagcaagtcacgtcttacatggatggcagcaggcaaaaagagagagcttgtgcagggaaactcttgtttttaaaaccatcagatctcatgagacttattcatgagaacagcacagaaaagatccacccctgtgattcaattatttcccaccgggtacctcctacaacacgtgggaattatgggagctacaagatgagatttgagtggggacacaaccaaaccatatcaaatacctaatgtacttatctttactgttgctctttattctttacatggatttgaattaccatcaagtatgctttcattctggcctgaaggactcattttagtattttatatggcaggatcgtttgatagtgattgtgtccgtttttatttaccgggaaatatataaactattttttcatttttatttatatatattttttggttatatagtaggtgtatatatctatgggttaaatgagatattttgatacaagtatgcaatgtgtaataatcagataagggtaaatggggtatctgtcacctcaagcatttatctttgtgtcttaaacaatccaattacacttttttagttattgtaaaatgtagaattaattttttttctatactaaccctgttgtgctagcaaatactaggtcttattcattccttctgtgcttttgttctcctttaccatccccactttcccccaattccccactacacttcccagcctctgttaaccatccttctactctctagctccatgagttcaattgtttttatttctagctcccacaaataagcgagaacatgtgaaatttgtctttctgtgcctggtttatttcacttaacattatgatctccagttccatccaggttgttgcaaatgacaggatcccatttttttttcttgagacagagtcttgctatgttgcccaggctgtagtgcagtggaacaatctcagctcactgtaacctccacctcctaggttcaagcgattctcaggcctcagcctcccaagtagctgggattacaggcatgtgccaccatgcctagaaaatttttgtatttttagtagagatgggatttcaccatgttggccaggctggtctcgaattccagaactcaagtgatctgcctgctttggcctcccaaagtgttaggattacaggcatgaaccactgcatctggccccattcgttttttatggctaagtggtactccattgtatatatataccacatttaaaaaatccattaatctgttgatggacactcaggttgcttccaaatattggctattgtgaatagtgcagcaataaacatgggagtgaagatatctctttgacatactgatttccttccttttgggtaaatacccaacagtgggattgtggatcatatggtagctcaatttttagtttttttttttttttttgttgaggaacctccaaacttttctccatagtgaaaataatttacattctcaccaacagtctacaagggttcttttctcttcacatcctcaccagcattcaatgttgcctgtcttttggataaaaaccattttaactggggtgagatgtcacctcattgtagttttgatttgcatttctctgatgatcaatgatgttgtgcactttttcatatgccagtttgccatttgtatgtcttcttttgagaaatgtgtatttggatcttttgcccatttttgattggattatcagattttttccaatagagttgtttgcgtgcctcgtatattctggttattaatcccttgtcagatgggtagtttgaaaatattttctctcattttatgggttgtctattcacttcattgtttctttggctgtgcaaaagctttttaacttgatgttatccaatttgtccatttttgctttggtttcctgtgcctgtgggatattacttaagaactctgctcagcccaatgtactggagagtttccccaaagttttcttttggtagtttcatagtttgtagtcttagatttgtctttaattttgatttgattcttttatatggtgagagataggagtccagtttcattctcctgtatatggctatccaattttccctgcatcatttattgaagagactgtcctttccgcaatgtatgttcttggaaactttgtcaaaaatgaattcattgtagatgtatagatttacttctgggttttctattctgttcctctggtctatgtgtctgtttttatgccagtatcatgccatcttgattattatagatctttagtataatttgaagacaggtaatgtgattcctccacttttctttttgcttaggatagctttggctattctggatcttttgttgttccatataaatttgaggattttttttttatttctgtgaagaatataattggtattttgatagggattgcattacatctatagattgctttgggtagtatggacatttaaaaaataatgattcttttaatccatgaacatggaatatctttccactttttggtgtcctcctcaatttctttcatcagtgtcttatagcttttattgtagagatctttcactttaattaattcctaggcacataattttatttttagttattgtaaatggcattactttcttgatttctttttcagattgcttgctgttggcacatagaaatgctactggcttttgtatgttgattttgtattttgcatctttactaaatttgtttatcagttctaatagtttttttttgtggagtcccgaggtttttccaaatacaagattatatctggatctgcagacaaagatctgaagtttctttgttgattttctgtttggaagatctgtccaatgctgaaagcggggtgttgaaatcttcagctattaatgtactggggtttatttccttctttacctctaataacatatgagtgctcccatgttaggtgcatatgtatttatgattgttatatacttttgctgaattgatccctttatctttatatagtgaccttctttgtctctttttatagtttttgtcttgaaatctattttgtctgatataaatatagctactcctgctctttgtttgatttccatagacatggaatatccttttccatcccttaattttcagtctatgtgtgccttcataggtgaagtgtgtttcttattggcaacagatcattgggtcatgtttttctttttattcattcagccactgtatgtcttttttattgaggagttaagtccctttacattcaacattattattgataaacaagaactgattcctgctgttttgttatttattttctggttgttttgtagtcttctcttccttctttctttcctttctgtcttctttttttctttttaattattatactttaagtactagggtacatgtgcacaatgtgcaggtttgttacataggtatacatgtgccatgttggttcgctgcacccatcaactcgtcatttacattagatatttctcctaatgctatccctaccccagcccccaagcccatgacaggtgctggtgtgtgatgttcccttccccgtgtccaagtgttctcattgttcagttcccacctatgagtgagaacatgtggtgtttggttttctgtccttgtgatagtttgcttagaatgatggtttccatcttcatccatttccctgcaaaggacatgaactcattcttctttatggctgcatagtattccatggtgtatatgtgccacattttcttaatctagtctattatcggtggacatttgggttggttccaagtctttgctattgtgaatagtgctgcagtaaacatacgtgtgcatgtgtcttcatagtagcatgatttataatcctttgggtatatacccagtaatgggatggctgggtcaaatggtatttctagttctagatccctgaggaattgccacactgtcttccacaatgattgaactaatttacactcccaccaacagtataaaaacgttcctatttctccacatcctctccagcatctgttgtttcctgactttttaatgatcaccattctaacctgcgtgagatgatatctcattgtgattttgatttgcatttctctgatgaccagtgatgatgagcattttttcatgtgtctgttggctgcataaatgtcttcttttgcgaagtgtctgttcatatcctttgcccactttttgatggggttgtttgtttctttcttgtaaatttgtttgagttttttgtagattctggatattagccctttgtcagatgggtagattgcaaaaattttttcccattctgtaggttgcctgttcacactgatggtagtttcttttgctgtgcagaagctctttagtttaattagatcccatttgtcaattttggcttttgttgccattgcttttggtgttttagccatgaagtccttgcccatgcctatgtcctgaacggtattgcctaggttttcttctagggtttttatggttttagatcttacatttaagtctttaatccgtcttgaattaatttttctgtaaggtgtaaggaagggatccagtttcagctttctacatatggctagctagttttcccagcaccacttttaaatagggaatcatttccccatttcttgtttttgttaggtttgtcaaagatcagatggttgtagatgtgtggtgttatttctgaggcctctgttcggttctattggtatgtgtatctgttttggtctgtgtatctgtgtatgctgttgtggttactgtagccttgtagtatagtttgaagtcaggtagcgtgatgcctccagctttgttctttttgctttggattgtcttggctatgtggactcttttttggttccatatgaactttagttttttccaattctgtgaagaaagtcattttgcttgatggggatggcattaaatctataaattaccttgggcagtatggccattttcatgatgttgattcttcctatctgtgagcatggaatgttctttcatttgtttgtgtcctcttttatttcattgagcagtggtttgtagttctccttgaagaggtccttcacatcccttgtaagttggattcctaggtattttattctctttgtagcaattgtgagtgggagttcactcatgatttggctctctgtttgtctgttattggtgtataagaatgcttgtgatttttgcacattgattttgtatactgagctttgctgaagttgcttatgagcttaaggagattttgggctgagacgatggggttttctaaatagacaatcatgtcatctgcaaacagggaccctttgacttcctcttttcctaattgaataccctttatttctttctcctgcctgattgccttggccagaacttccaacaccatgttgaaaaggagtggtgagagagggcatccttgtcttgtggtggttttcaaagggaatgcttccagtttttgcccattcagtatgatattcgctatgggtttgtcataaatagctcttattattttgagatgtgttccatcaatacctagtttattgagagtttttagcatgaagggctgttgagttttgtcaaaggccttttctgcatctgttgagataatcatgtggttttggttctgtttatgtgatggattacgtttattgattggcatatgttgaatcagccttgcatcccaggggtgaagccaacttgatcatggtggatagactttttgatgtgctgctggattcggtttgccagtattttattgaagattttcgcatcgatgttaattagggatattggtctaaaattctctttttgttgttgagtctcttccaggcttttgtagcaggatgatgctggcctcataaaatgagttagggaggatcccctctttttctattgattggaatagtttcagaaggaatggtaccagctcctctttgtacctcttttagaatttggctgtgaatccgtctggtcctggactttttttggttggtaggctattaattattgcctcaatttcagaacctgttattggtctattcagagattcaccttcttcctggtttattcttgagagggtgcatgtgtccaggaatttatccatttcttctagattttctagtttatttgcatagaggtgtttatagtattctctgaaggtagtttgtatttctgtgggattggtggtaatatcccctttatcattttttattgcacccctatttgattcttctctcttttcttctttactagtcttgctagcgttctatcaattttgttgatcttttcaaaaaaccagctcctggattcattgattttttgaagggtttttttgtgtctctatctctttcagttctgctctgatcttagtaattttttaccttttgctagcttttgaatttgtttgctcttgcttctctagttcttttaattgtgatgttatggtgttgattttagatctttactgctttcagttgtgggcatttagtgctataaatttccttctacacactgctttaaatgtgtcccagagattctggtatgttatgtcgttgttctcattggtttcaaagaacatctttatttctgcctttattttgttatttacccagtagccattcaggagaaggttgttcagtttccatgtagttgtgtggttttgagtgagtttcttagtattaagttttaatttgattgtgctgtggtctgagagatagtttgttgtgatttccatttttttacatttgctgaggagtgctttacttccaagtatgtggtcaattttagagtaagtgtgatgtgctgagaagaatgtatattctattgatttggggtggagagttctgtagatgtctattaggtctgcttggtgtagagctgagttcaagtcctggatatccttgttaacctgtctcattgatctgtctactattgacagtgggatgttaaagtctcccattattattatgcgggagtctaagtcttttataggtctctaaggacttgctttatgaatctgcgtgctcccatattgggtgcatatctatttaggatagttagctcttactgttgaattgatccctttaatattacgcaatggccttctttgtcccttttcatctttgttggtttaaagtctgtgttatcagagactaggatcgcaacccctgctttttttttttttttttttttttttttttgctttctgtttgcttggtagaccttcctccatccctttattttgagcctatatgtgtctctgcatgtgagatgggtctcctgaatatagcacactgatgggtcttgactctttatccaatttgccagtctgtgtcttttaattggagcatttagcccatttacatttaaggttaatattgttatatgtgaatttgatcctgtcattatgatgtcagctggttattttttccattaattgatacagtttctttatagcatcgatggtctttacagtttggcatgtttttgcagtggctggtactggtcattcctttccatatttagttcttccttcaggagctcttgtaaggtaggcctggtggtgacaaaatctctcagcatttgcttgtctgtaaaggattttatttctccttcacttatgaagcttagtttggctggatatgaaattctgggttgaaaattcttttcttcaagagtgttgaatattggccctcactctcttctggcttgtagggttttggccaagagatctgctgttagtctgatgggcttccctttgtaggtaacctgatcttcctctctggctgcccttaacctttttcccttcatttcaaccttggtgaatctgacaattatgtgtcttggggttagtcttcttgaggagtatctttgtggtgttctctgtatttcctgaatttgaatgttggcctgccttgctaggttggggaagttctcctagataatatcctgaagagtgttttctgacttggttccattctccccatcactttcaggtccaccagtcaaacgtagatttggtcttttcacatagtcccatatttcttggaggctttgttcccttctttttactctgttttctctaatcttgtcttctcgctatttcattaatttgatcttcaatcactgatatcctttcttccacttgaatgaatctgctgtgaagcttgtgtacgcatcatgaagttcttgtgccatggttttcagctctatcaggtcatttaaggtcttctctccactgtttattctagtacccattcatctaacctttttttcaaggtttttagcttccttgggatgggttagaacatcctcctttagctcagataaatttgttatttactgatcttctgaaccctacttctgtcaacttgtcaaagtcattctctgtccagctttgttctgttgctggcaaggagctgcgatcctttggaggggaagaggcgctcttgtgttcagaattttcaggttttctgctctgatttctctccatctttgtggttttatctacctttggtctttgatgttggtgacctactgatgaggttttggtgaggatttttttgttgttgatgttgattctattcctttctctttgttttccttttaacagtcagatccctcagctgcaggtctgttggagtttgctgggggtccactccaggccgttcgcctggatattaccagtgtaggctgcagaacagcaaatattgcagaacagcaaatattgcttcctgatccttcctctggaagcttcgtcccagaggggcacctgcctgtatgaggtgtcttttggcccctactgggaggtgtctctgagttaggctacatgtgggtcagggacccacttcaggaggcagtctgtctggagaatcactgctctcttcagagctgtcagacagggacgtttaagtctgcagaagttgtctgctgccttttgttcagttatgccctgcccacagaggtggtgtctacagaggcagtaggtcttgctgagctgtggtgggttctgcccagttcgagcttcctgaccactttgtttacctactcaagcctcagtaatgtggatgcccctccccccgccaggctgcagccttgcaattccatctcagactgctgcgctagcagtgagcaaggctctgtgggcatgagacctgccgagccaggcacaggagagaatctcctggtctgctcgttgctaagaccatgggaaaagtgcagtatttgggcaagagtgtaccgattttccaggtacagtctatcatggattcccttggctaggaaagggaaatctcccaaccctttgcactttctgggtgaggcaatgccctgccctgctttggctcaccctctgtgggctgcacccattctccaaccagtcccagtgagacgaaccaggtatctcagttggaaatgcagaaatcacctatcttctgcatcaatcattctgggagctgcagactggagctgttcctattcggccatcttggaacagaaaccagacctttctgtcttctttttagtgaaggtgattttctctggtggtatgatttaatttcttgctttaatttttttaattaaaaaaaattttttttaagacagagtcttggtctgttgcccatactggagtgcagtggtgtgatcatggcttactgcagcgtcgacctcctggactcaagcaatcctctcacctcagctccctgagtagctgggcctacaggcatttgccaccacacctggctaatttttaaattcttttcagagacagtgtctcactatattttccaagctggtctggaactcctgggctcaaatgatccacctatcttggcctcccaaatcattgagattacaggtatgagccattgtacatggttgctttttattttttgtgtatccattgtatgttttttgatttgaggttaccatgaggcttgcaaatactatcttataatcagttattttaagtttatagcaacttaacactgtttgaataagaaaacaaacaaaaactaataaaatctctacaccttaacttcatccccctgctttttaactttttgttgtttctatttatatcttatagtactattttttgaaaaattattattttcaaatggctcatattttagtaatgatttttgatttgttcatcttttagtctttctacataagagtagtttacataccccagttatagtgttataatattctgtgtatttttccgtgtacttactatcaccagtgaattttatacctttagatgatttatttttctttatttcttctaaaaaagaaacgggatacatgtatacatgtatgcagaacgggctggtttggtacataggtatacgtgtgccatggtggtttgctgcacctattgactcatcctctaagttctctcccctcacccccaccccacaacaggccctggtgttgttgttcccctctctgtgtccatgttttctcaatgttcacctcccacttacgagtgagaatatgcggtgtttggttttctgttcctgcgctactttgctgaggatgagggctttcagtttcatccatgtccctgcaaaggacacgatctcattttttatggcttcatagtattccatagtgtatatgtccacattttctttatccagcctgtcattgatgggaatttgggttggttccatgtcctggctattgtaaatagtggtgcaataaaaatacatgtgcatatgtctttatagtagaatgatttatattcctttgggaatacacccagtaatgggattgctgggtcaaatggtatttctggttctagattcttgaggaattgccatactctcttccacaatggttgaactaatttacactcctatatattcagaatagttagcttttcttgttgaattgttccctttaccattatgtaatacccttctttgtcttttttgatcttttttggtttaaaatctgttttgtcagagactaggattgcaaccctgctttttttttctttttatttgtttggcaaatttccctgcatccctttattttgagcctgtgtgtgtctttgcacataagatgcttctcctgaatacagcacgccaatgggtcttgactccttttttgccagtctgtgtcttttaattagggcatttagcccagttacattttcttttccttcctttctctctctctctttctctgtttctctctctctttctttcttttctttctttctttctcactctcacccaggctggagtgcagtgtcatgctctcagctcactgcaacctccacctcccagattcaaacaattctcctgcctcagcctccctagtagctggactataggcacctgccaccacacccagctgatttttgtatttttaatagatatagattttcaccatgttggccaggttggtctcaaactcctgactgcaggtaattcacctgccttggcctcccaaagtgctgggattacaggtgtgagtcactgtgcccagtcccagttacatttgaggttagtattgttacgtttggagtttgatcatgtcatcatgatgctctttggttgttttgcacactagttgatgcagtttcttcatgtgtcattagtttttatattttggtgtgtttttgcagtggctggtaccggcttttcctttccatagttaatgtttctttcaggagctcttgcagggcaggcctgctggtaatgaaatcccttagcatttgcttgtctagaaaggattttatttatcctttgcttatgaagcttcatttggctggatatgaaattctgggttgaaaactgttttctttaagaatgtcaaatattggctcccaatctcttctggcttgtagagtttctgctgagaggtctgctgttagtctgatgggcttccctttgtaggtgacctggcctttctctctggctgcccttaacagtttttccttcatttcgactttggagaatctgatgattgtgtgtcttggggttgatcttctcgtggactatcttaatggtgttctctgtatttcctgaatttgcatgttggcaaagttggggaagttctcctggatcttcccaggagatcatatcctgggaaatcttcctggatcatatgctgaagtgtgttttccatcttgtttccattctccctgtctcctggtactccaatcaatcgtagatttggtcattttatgaagtaccatatttcttggaggcttttttcattccttttcatttttttttttaattcttgtctgcatgtcttatttcagtaaggtggtcttcacactgatatcctttcttccgcttggttgattcagctgttgatacttgtgtattcttcatgaaattcttgtgctgtgttttgcagctccatcaggtcatttatgttcctctctaaactggctattctagttagcaattcctctaactttttatcaaggttcttagcttctttgcattgggttagaacatgcttctttaactcatcatagttttttagtacccatcttccaaagcctacttctgtcaattctttcatctgatcctccatccagttctgtgcccttgatggagagacattgcaatcatttggaggagaagaggcactctgaccttttgggttttcagcattttttcattgattcttatctttgtgagtttgtctagttttggactttgaggctgctgacccttggatggggtttttgtagatgcctttttgttgttgttgttgttgatgctgttgttgtcactttctgcttgtttttctttcaatagtcaggtccctcttctttagggctgctgcagtttgctggggatttgcttcaggccttatctgatttgctcccgtgcctggagatgtcattcaaggagtctggagagcagccaagattggtgcctcctccttcttctgggacctctgacctcaaggggcaccaccctgatgccagtaggatcgttcctatatagagtatctgacaacccctgttggagtgcctcacccagttgggtggtacagggagcaggactcgtttaatgaagcactttgtcccttggtggagagggtgtgttttgtggggggaaacccacttgtctgggctgcctggattcctcagaaccaccaggaggatcagctaagtttgctggtctgcagagactgcagccatccctccccttaggggctcaggcccagggagatctgaattctgtccctgagcctctggctggagttactggagatcctgcagggaagccccgcccactgaggaaggatgggtcagggttagacctgaagaggcactctggctgctgactgccatagccaatgtgttaggctgtggggacaagtattgggaccaagccgtccagcctccctggctccagcagcggaaaagcgcagcctggagctatagaaatgggtgtcactcttctcccacgcagggagcatgttaggcagttgtgagtcccagtgctggctgctgcccctccctcgaggagctcaaacagcttagagagcaggcagcagcagccggtgctggtcgcccctccccacaggagtttggtaggcttaagcagattccagctgaaaagctgtaagaatccacgcattccaggactgggatgctaggccccggtggcatgggttcgcgagcggggtcttctgatctgtgggttgcacggtttccccagctgggtagcatgctcactcaccgcctcccttggctggggagaggtggttccccttccccacgtggctctcaggtaggctgcagcaccacactgctctcccttctctccgtgggtcatgccagccttctactcaattttgatgagagaacctggataccttggttgccggtgaaggattcacaggcgtattatgattttttttgatgggagctgtaaagtcctctgagctggccgcaccatggtcaggccatcgtgacattcccccgcccttgtgataatgtactttgtgatattccccatccctgtgaatgtactttgtaagattcctccctgcccttgtgacaatacaccgtcccgcccttgtgaatgtactttttaacattcctccccgcccttgtgaatatactttgtaacgtccatcccctgcccttaaaaaattgctcctgactccactgcctatctgaaacctgtaggaaccaatgataatcccaccaccctttgcagacccctttctcggactcagcccacttgcacccaagtgaataaacagccttgtttctcacactaagtctgctcagttcgtctcttatacgaacgcgcataacaggagcctccaaacgcagctgcttctagttggccatcttggcactgccggccctttcagatgatttcttattgctcattaacattcttttatttctgactgaagtactcccattagaatttcttatagaaccaggtctggtattgatgaagtccttcagcttttgtttgtcggggaaagtctttatttttccttcatgtttgaaagacatttttgccagatatactattctagggtaaaagtttttttcctttggcattttaaatttgtgtcactttctccagacctgtaaggtttccactgaaaagtctgctgccagatgtattggagctccattgtatttatttgtttcttttctcttgctgcttttaggatcctttatacttgacctttgggagtttgattactatttattacctccttgaggtagtcttctttgcttggtgttttataatcttcttgtactctgatattgatatctttctctaggtttaggaacttttctgttattatccctttgagtgaactttctatgcctatgtctttctctagctcctctttaacgccaataactcttagatttacccttttgaaactattttctagatcctgtaggtgtgcttcgttattttttattcttttttcttttgtctcttctgactgtatattttcaaatagtctgtcttcaagcttactaattcattcttctgcttgatttattctgccattaaaagactctgatgaccatgttggccaggctggtctcgaactctaaggtcaggagtttgagaccagcctgaccaacatggtgaaaccccgtctctactaaaaatatgaaaatgagccaggcatggtggcaggcacctgtaatcctagctgcttgggaggctgaggcatgaaaatcgcttgaacccgggaggtggaggttgcagtgagccgagatcacgtcattgcactccagactgggtgacaagaaactatctcaaaaaaaaaaaaaaaaaaaaaaaggctctgatgtgtttcttaacatttcagtttcatttttcagctccagaatgtgtgcttattttaattatttcaatctctttgttaaatttatgtgatagaattctgaattccttctctatctctgtgatagaattctgaattccttcaaagaaatcttgaatttctttgaatttcctcaacacagttattttgaattctctgtctgaatagttacatatctctgtttctccaggattggtccctggtgccttatttagcttgtttgttgaggtcatgttttcccagatggtgttgatgcttgtagatgttctttggcgtctgggcagaaggcttaggtatttattgtagtcttcacagtctgggcttatttgtacccatccttttcagaaaggttttccctgtaatcaaaaggatttgggtactatgacctaagccatatctacattagggggcaccttgagctcagtaacattgtggttcttgtagagtcatcgaggtgctaccttggcagtcttggataacgtccagatggattctctggattaccaggtagggactcttgttctcttctctttctctgaaataaacagtctctctctctctctctgtgctgagcttcctggagctgggagtgggatgacagaagcagccctgtggccatcaccactgggactgctgcagtgcatcatacttgaagccaatacagcactggatcttgcccaaggcttgctgtaatcactcccttgctactgcttatgttcgctcaaggccctagggctgtacaatcagcaggtggcaagcggcaaagctagtcaagcttgagttcttgttttcaggtcagtgagttacctcaggtgccaggtgggtccagagatgttgtccaggaaccagggactggagtaaaaaaccttagacatctacttggtgttctcttgtactgctgttgagctggcactcaaacaacaagacatagtccttcccattcttccctcctctttacacaggcaaaggaacctgaccctgtggccgctaccaccacaggcccacggaaagtactgccaggcatccaccagtgttcacgtaaggtgcatgggctcctcaggaagcttgtggtgaatggtgccaggctgggactcacttttcagagtagtgggcttccctctggcccagcatgggtttagaaatgccatccaagaaccaaggcctggaatcaggattcttaagagcccaactggtactctaccccattgtggctgagctagtacctaagatgcaagccaaagtcccctttacttttccctctgcttttctcaaggagatggagcctctcaccatagccaccacagctgggaatatgctgtgtctcgcctgaagccagcatggttgagagtctccccaagactcacagagtactacctgggtatcactgctggttattcagttcccaagggcttcttagtcagcaggtgatgggaccttcaaggcagtgggttcacttctggcctagggtatgtctagaaatgtctgagagctagggcctcatgactgcccagtgccccatcctcgtgtctgagctggtacccaaaatgcaagacaaaattctctcttctcccaggaggaaggatggagtttcttttggaactgtgagctgtacagcctgcagttgggtgaggggcggtatatgcattcccttagctgccctggctgatagtaaggtcatgtgctcccctagtccactggctctgagcccagcttagtgctaggactcacctaggagttgcagtccttgtggcctagacttcgtttcaagtttatttagggccccagtgcatttcaacccacagtggcaagactttctagaacttaagtttttttgggatgggcaatttccctctggctagggccagtccaaatgctttctttgtgggcaggtatcagctatatacagttcggttctgttttcttctgtgagagggcagcactgagttcaatgcaaagtccccaaattgctgtgttctctctacccaagtgcacagattttccatgccatgtagctgctgccaggagtttgggaaggggtaacatcagcaattcaagacactttcctgcccttttcagtgcctctttcagaaatatgaaattaaaatcaggtactatgtggtgcttacttgatttttagtttttatgaatgtacttttttgtgtagatacttgttaaatttgatgttcctacatgagggacaattagtgcaaccttctactccaccatcttgcttcacctcgcttcttcatttttaaatgagagattctttggacagaattcttagttgactgtcattttcttttaacactttgaagatcttatccctctgtcttctggcccccatggtttcttataagaagtcagctattaatcttgttgaggattccttgtacatggtaggttgtttttctcttgccaccttcaggattctctcttagtgtttgacttttttccatttgacttgagtatgtcttggtggaaatctctgagtttattctactcggagttcattgagctttttggatttacagactcatttatgtttatcaactcagagtttttagtcacaaattttctttcagtcccattctctttttcctctttttcttgggcctctgttttgcatatgcggtatacttggtagtttcttgtatatctctgaggctctgctccccttcttttcattctcttttctttcttctcctcagactgaatgatttcagttgacctacctatctttaaatttgataattcttctgcctgctctaatcagctattaaaacactataataaatttttcattttagttattgtacttctcagctgcagaattttcatttggttcctgttaataatttttatctcattattcctatcctttatttgttgagacagtctcctggcttcctttagctctttactcatggttcctttacctctttggacacattaatagtagctaatttaacatctttttctgctaaatccaaaatggtcccctcatggatattttctattagttgcttttttcaatgtacatgtgatattttcctgtttttttcataagtgtcataatttttcattgaaagctggacattttagaaaatatattttaacaactctgatatcagattcttctatcccctaaggtttgtcattattgccattttggctgtggtttttcttgttgtttatttgtgtctgtttgatttttctgtattaattctataggtcatgataatacaggagttattaagatactagttttaggcagttagaaagggtaaaagagttctcagtagaattttcctttattaaaaagcaaccccaaaccatttcttctctaacagaaagcagcctgaagagtaagtcatagttacgtaaactaggatcttttatatgtaaattccatcagctgtacctggaagccaggtacattcaatatggtgtctcctgccctcttttccttgtcaccatttgtgctggtgtcatggcaaccttcaggtaaaacctgtacaggtatcatggtgacccaccaggtagaagccacatttgtataacaaaaggttagggtgggaggccaatcttttcacgggctatgtaaatggcacacctggtcaaactgatcccctgatccctatgtagatcaatcaccaccttcttaagcctctgtacacaattgattgcattccactgcaaaccagagaccttttcttgggagacttgctttctcagcatgaggaaaccttttttctctctcttcttttttgcctattaaaccttccactcctaaatccactcctcatgtgtgtccatgttctgaattctttctcagccaagacgaagaaccagggtatataccccagacaaagaagccatttcactgattccttgctgtgttgtagtgtatggccacagttctttgctgcttttatttttttaagttattgcttttgtttttaagccctggctttctagggatcactcttggattagtataatttagtggctaactgatagttggttagattttcttaaatgttttgacagtagtgtttcatgctttgccaaagggttctgtgtgagatatcatgcctccagccgtcaggcactttaagactgctttattccctgcttggacaggacctcaaggtcagtcagagacgaatgactgatgccatctttgccaggtctttccttggcatgtgcacagtcttttagattttaggaatatgtttgagctttttaaaattccctaagcaaattcttgagaactagattaagcagcaaaacattcaagagatgacttgggtgctgtcaaagtcattcaagaattttcttttaaattctaagccaggctcttctttgccccaactaacatgatagccttaggcagttgtaatgttgccagcagtttgctattgttttgataattgcctgaggataacccccctcccccacctgctaagctgagttctgaggagaaccagagtgaggtagtcaccgtactctgagaattgaaatttttctgggagatgcatgttcagacaaaacattgactgtgttctggggatggttcttgtaatggaattccaaaagcagtcaaagatgctggcttttggcttctgccagtgagctggagagggaggagtcatgggaatagacccaagtttaaaatatcacagacaaccctgatatcgtttggttgtgtccccacccaaatctcatcttgaattcccatgtgttgtgggagggacctggtaggaggtaattgaatcatggggacaggtctttcctgtgctgttcttgtgatagtgaataagtctcaggagatttgatgattttaaaaagaggtgtttccctgcacaagctctctttgactgctgccatccatgtaagatgtgacttgctcctccttgccttcctccatgattgtgaggcttccctggccatgtggaagtttaagtcccttaaactctttttcctgtgtaaattacccagtctcaggtatgtcttcatcagcagcatgaaaatggactaatacagtaaattggtaccaggaattaggtgctgctgaaaagatacccaaaaatttggaagcggctttggaactgggtaacaggcagaggttggaagagtttggagggctcagaagaagacaggaaaatgtgggaaagtttggaatcttttagagacttgttgaatggctttgactaaaatgccaataatgatatggacaatgaaatccaggctgagatggtctcagctggagatgaggaacttgttgggaactggagcaaaggtgattcttgttacattttagcacagagactggtggcattttgcccctgtcctagagatttttggaactttaaacttgggagagatgatttaggggtatctggcagaagaagtttctaagcagcaaaacattcaagagatgacttgggtgctgtcaaagtcattcaattttgaaagagaaacagggcataaaagtttggaaaatttgcagcctgacaatgtgatagaaaagaaaatcccattttttttctgagcagaaattcaagctggctgcagaaatttgcataagtaatgaggagctgaatgttaatcattaagacaatggggaaagtgtctccagggcatgtcagagacctttgtggcagcccctcccatcagaggcctggaggcctaggaggaaaaaatgattttgtgggctgagcccaaggttcctgtgctgtgtgcagcctagggacttggtgccttgcatcccagccactccagctgtggccgaaagggaccaaagttgagctcaggccgtggcttcagaggatgctagcctcaagccttggcaacttccatgtggtgttgaccccgttagtgcacagaagtcaagaattggggtttgggaatctccacctagatttcagaggatgtatggaaatgcctggaagtccaggaagcagtttgctgcaggaatggggccctcttggagaacctttgctagggcaatgcagaagggaaatgtggggtcagagcctccacacagagtccctactggggcactgccaagtggagctgtgagaagagggccaccatcctccagaccccagaatgctagatccaccaacactttgcactgtgcacctggaaaagccacagacattcaatgccagcccgtgaaagcagctgggaaggaagctataccctggaaagccacaagggcagagctgtccaagaccatgggaacccaccttttgcatcagtgtgacccagatgtgagacacggagtcataggagatcattttggagctttaagatttgactgccctgctggattttggacttacatagggcctatagcccctttgttttagccaatttttcccatttgggatggcaatatttacccaattcctgtaccctcattgtatctgggaagtaaccaacttgcctttgattttacaggctcataggtggaagggactaaccttgtctcagatgaaactttggactgtggactttgggttaatgctgaaatgagttaagactttgggggactgttgggaaggcatgattggttttgaaatgtctggacatgcgattttggagggaccaggggcacaattatatggtttggctgtgtctccacccaaatctcatcttgaatttccatgtgtcgtgggagggacctggtaggagataattgaatcatggggggcaggtctttcctgtgctgttcttgtgatagtgaataagtcttaggagatctgatgattttaaaaagaggtgtttccctgcacaagctctctttgcctgctgccatccatgtaagacgtgagttgctcctccttgccttccttcattattgtgaggcatccccagccagtggaactgtaagtccattaaaccccttttcctgtataaattacctagttttggggtatgtctttatcagcacgatgaaaacagactaatacaaccccctcccccatcttaccaagattgagtagtttttttttttttgataacttccagtttgtgttttgacctccatgtgtaatcatctgaggggttcttcctgcccattgcataaagagagaccatgaaattgtagcagagaaagagtttaatagacatgagctggacatgttatgtgcgagatgaagtttgtactcaaataatctcattcaaagcccatatgttaggggtttttcaaggacagtttgggaaaaggggtgggggtggccaggtaccaggtgcttgctgctgattggctggggcagagatgaaatcatgggggtcaaagctttcctcctgcaggccaaatcacttctgggtggggctacaggagtggggttgtcggttcaggtagagccatcaggtccaggtggagacatgggtgtcagatatgcaaaaaattctggaaagatatctcaaaaggccaatctaccataatggtgttatttgcaagagtaattggtgaatttgcatatcttataagctctggaataatgtctgcaccttagcaggactcaggctcctctcctccctttagcctgatggcttcctattagctttacaaaagcagttgagttttgggcaatgtctattatcatttaaactgtagcctgaatgtcttccaaagttagcatggcccaatatgccaggaataataaaggaaaggcaagatgggggttagcttagcttagtttactgtaataattttttcactgatataatttctgcaaaggtgattttacatatagtgaggaattggcttatgtgattatgaaggttgagtaatatcatgatctgctgtttgcaagttggagacctaggacatccagtggtataattccagtctgagttcaaaggcctgagaaccaggggagccagtggtataaattccagtccaagagcaaaagaccaatatttcagctcaagcaggcaggcaggaaaaaaaaagagcatattccttcatcttctgcctttttgttctgttcaggacctcaatggattgcatgatgcccacctgtattgggaaggataatttacattactgagtccaccaattcaaatgctaatctcatctagaaacacccttccagacacacccagaaataatgttttatctgagcactctgttgtgcaattaagtgaaaaacaaaattaaccatgacagttgtttggctcatatttttattgtttagaggtagagtaaattcacaaagctcctcgttttgtcatttcagaagtaggaccttaattatataatcttaagacttaaaatgttttcctaaggcttttgtgatagcaaataaagttttgcaccacttttataaatttttgagggaatcagcagacaccaaatggtaaaccactaatttttttatcacctcattttagaagattatatagattgtacatttattagttaagatttctctatttttggacatatgggattatattaaattaaaaagcttcaccgaaaaggaaacagtcaacgaagtgaagagacaacccacagaatgagagaaaatatttgcaactattcatctaacaagggattagttaccagattatataagggacccaaacaactctataggaaaaaatctgataatgcagttaaaaatgggcaaacaatctgaatagacatttctcaaaagaagacatacaaatggcaaacaggtatatgaaaaggtgctcaacataattgatcatcagagaaatgcaaatcaaaacttcaatgagatatcatctcacctcagttaaaatggcttttatccaaaagacaggcaattaacaaatgctgccaaggatgtgaggaaaagggaacccttgtaccctgttggtgggactgtaaattagtacacccactatggagaaaggtttggaggttcctcaaaaaactaaaaatagcgctaccttatgatccagtaatcccactgctaggtatataccccaaagcaaggaaacccaatgtatcaaagagatagctgcactttcatgtttattgcagcactatttacaatagccaatatttggaagcaacctgagggatatggtttggatttgtgtcctcacccaaatctcatattgaattgtaaccccaatgttcaaggagggacctggtgttgatgattgaaccatggggatgggcttcttccttactgttcttgtgatagtgactgagatctggttattttaaagtgtgtagcacctccccctttactctcttcctcctgctccagccatgtaggacatgtctgcttcccctttgccttccatcatgattataagtttcctgaggcctccccagccatgtttcctgtacagcctatggaactgtgaggcaattaaacctctctataaattacccagtgttaggtacttcttgatagcaatgcgagaatgaactaatacagaaaattggtacctaagagtggggcattgctataaagatacctgaaaatgtggaagcaactttgaaactgggtaacaggcaaaagttagaacatttgggagggctcagaaaaagacaagaagatgagggaaagtttggaacttcctagagacttgttaaactattgtaaccaaaatgctgatagtgaaaaggacaaggaagtccaggctgaggtggtctcagaaggaaacgaggaacttattgggaactgtagcaaagatcacttttgttatgtgttatcaaagaggttggaggcattgtgcctctgccctagggatctgtggaactttgaccttgagaaggatgatttagggcgtctggcggaagaaatttctaagtgacaaaatgttcaagagtgaactggctacttctagcagcctaggcttatatttgtgagcaaagaaatgacctggaattagaacttatatttaaaagggtaacagagtataaaagtttggaaaatttgcagcttggccatgtggcaaaaaggaaaaacccattttctggggacgaattcaagctggctgcagaaatttgcataagtaaggaggagacaaatgtcaatagccaagacaatggggaaaatgccttgaaggcattttagatacctttgcagcagcccctcccatcacaggcctggaggcttaggtttcatgggccatgggctgggcccagggccctgctgccctgtaccacatcaggacactgctccttgcatcctagctgctccagctccagctgtagctaaaagggccccagatatgtctcaggtcactgcttcaaaggatgcaatctgtaagccttggtggtttccacatggtgttaagcctgtgggtgtgcagaggctaagagttgaggcttgggaacctccgcttagatttcagaggacgtatggaaatacctggatatccagacagaagtctgctgcaggggcagagccctcatggagaacctctactagggcagtgcagaggggaaatgtggggtttgagacctcacacagagtccccactggggcactgcctagtggagctgtgagaagagggtcaccatcctccacaccccagaatggtagatccatcgacagcttgcaccatgtgcctagaaaagctgcaggcactccaccctagcctctgaaagcagtcatgggggctgtaccttgcagagccacaggggtggagctgcccgaggccttgggagcccacctgttgcatcaacatggcctggatgtgagacagggagtcaaaggaggttattttgaagctttaagatttaatgagtgtcatcctgggttttggacttccatgggacctgtagctcctttgttttggccagtctcttccttttggaacaggagtatttttccaatgcccatatcctcattgtatcttgtaaataactaactggttttgagttagggacttgccttgtctcagatgagactttggactgtggacttctgagttaatgctggaatgagttaagactttgggggactattgggaaggcataattgtattatgaaatgggagaagaaaatgagatttgggaggggccaggggtggaatgatatgttttgtatttctgtccccacccaaatctcatgtcaaattataatccccagtgttagaggaggtgcctggtgggatgtaattggatcgtggggcagacttctctcttgctgttctcatggtagtgacatctgagagacctcatgagatatggttgtttaaaagtgtgtagcacctccccctttgttctcttcctccttctctagccatgtaggacatgtctgcttcctcttcactttctgtcatgattgtaagtttcctgaggcctcctctgccatgctttctgtacatcctgcagaactgtgagcgaactgaagctcttttctttataaattacccagactcaggtagttctttatagcaatgtgagaatggactaatacactatgtgttcatcaacagatgaatggataaagaaaatgcaggacatatggtgggaggagccaagatggccgaataggaacagctccggtctacagctcccagtgtgagcgacacagaagacaggtgatttctgcatttccatctgaggtactgggttcatcttactagggagtgccagacagtgggcgcaggacagtgggtgcagcgtaccatgcacgagccaaagcagggcaaggcattgcctcactcgggaagcgcaaggggtcagggagttccctttcctggtcaaggaaaggggtgacagacggcacctggaaaatcgggtcactcccacccaaatactgcgcttttccaacaggcttaggaaacggcacaccaggagattatatcccgcacatggctcggagggtcctacgcccacagagtctcgctgattgctagcacaacactctgagatcaaactgcaaggtggcagagaggctgggggaggggcgcccaccattgcccaggcttgcttaagtaaacaaagcaggcgggaagctcgagctgggtggagcccaccacagctcaaggaggcctgcctgcctctgtaggctccacctctgggggcagggcacagacaaacaaaaagacagcagtagcctctgcagtcttaaatgtccctgtctgacagctttgaagagagcagtggttctcccagtacgcagcttgagatctgagaatgggcagactgcctcctcaagtgggtcccagacccctgacccccgagcagcctaactgggaggcaccacccagtgggggcagactgacacctcacacagctgggtactcctctgagacaaaacttccagaggaacgatcagacagcagcattcgtggttcacgaaaatccgctggtctgcaggcaccgctgctgatacccaggcaaacagggtctggagtggacctctagcaaactccaacagtcctgcagttgagggtcctgtctgttagaaggaaaactaacaaacagaaagaacatccacaccaaaaacccatctgtacatcaccatcatcaaagaccaaaagtagataaaaccacaaagatggggaaacaacagagcagaaaaactggaaactctaaaaagcagagcgcctctcctcctccaaaggaacgcagttcctcaccagcaaccgaacaaagctggacggagaatgactttgacgagttgagagaagaaggcttcagatgatcaaactactccaacctacaggaggaaattcaaaccaaaggcaaagaagttgaaaactttgaaaaaaatttagatgaatatatgactagaataaccaatacagagaagtgcttaaaggaactgatggagctgaaagccgaggctcaagaactacgtgaagaatgcagaagcctcaggagctgatgcgatcaactggaagaaagggtatcagtgatggaagatgaaatgaatgaaatgaagcaagaagggaagtttagagaaaaaagaataaaaagaaacgaacaaagcctccaagaaatatgggtctatgtggaaagaccaaatctacgtctgattggtgtacctgaaagtgatggggagaatggaaccaagttggaaaacactctgcaggatattatccaggagaacttccccaatctagcaaggcaggccaacattcagatacaggaaatacagagaacgccataaagatactcctcgagaagagcaactccaagacacataattgtcagattcaccaaagttgaaatgaaggaaaaaatgttaagggcagccagagaaaaaggtcgggttacccacaaagggaagcccatcagactaatagcggatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaactggtaccagccgctgcaaaatcatgccaaaatgtaaagaccatcaagactaggaagaaactgcatcaactaatgagcaaaataacgagctaacatcataatgacaggaccaaattcacacataacaatattaactttaaatgtaaatggactaaatgctccaattaaaagacacagactggcaaattggataaagagtgaagacccatcagtgtgctgtattcaggaaagccatctcacgtgcagagacacacataggctcaaaataaaagggtggaggaagatctaccaagcaaatggaaaacaaaaaaaggcaggggttgtaatcctagtctctgataaaacagactttaaaccaacaaagatcaaaagagacaaagaaggccattacataatgctaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagtcagatctacaagacagaaagttgacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcaacaaatgtgacagaacagaaattataacaaagtgtctctcagaccacagtgcaatcaaactagaactcaggattaagaaactcactcaaaaccgctcaactacatggaaactgaacaacctgctcctgaatgactactgggtacataacgaagggaaggcagaaataaagatgttctttgaaaccaacgagaacaaagacacaacataccagaatctctgggacacattcaaagcagtgtgtagagggaaatttatagcattaaatgcccacaagagaaagcaggaaagatccaaaattgacaccctaacatcacaattaaaagaactagacaagcaagagcaaatacattcaaaagctagcagaaggcaagaaataactaagatcagagcagaactgaaggaaatagagacacaaaaaacccttcaaaaaattaatgaatccaggagctggtttttcgaaaggatcaacaaaattcatagaccactagcaagactaataaagaaaaaaagagagaagaatcaaatagacgcaataaaaaatgataaaggggatatcaccaccgatccctcagaattacaaactaccatcagagaatactacaaacacctctacgcaaataaactagaaaatctagaagaaatggataaattcctcgacacatacactctccgaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgagtatctcaatagatgcagaaaaagcctttgacaaaattcaacaacccttcatgctaaaaactctcaataaattaggtattgatgggacgtatctcaaaataataagagctatctatgacaaacccacagccaatatcatactgaatgggcaaaagctggaagcattccctttgaaaactggcacaagacagggaggccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcagcccaaaatctcctcaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatccaacttacaagagatgtgaaggacctcttcaaggacaactacaaaccactgctcaaggaaataaaagaggatataaacaaatggaagaacattccatgctcatgggtaggaagaatcaatatcgtgaaaatggccatactgcccaaggtaatttatagattcaatgtcatccccatcaagctaccaatgactttcttcacagaattggaaaaaactactttaaagttcatatggaaccaaaaaagagcccgcattgccaagtcaatcctaagccaaaagaataaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatagaaaaattaattcaaggtggattaaagacttaaatgttagacctaaaaccataaaaaccctagaagaaaacctaggcattaccattcaggacataggcatgggcaagagcttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcacctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacatatgaaaaatgctcatcatcactggccatcagagaaatgcaaatcaaaaccacaatgagataccatctcacaccagttagaatggtgatcattgaagagtcaggaaacaacaggtgctggagaggatgtggagaaataggaacacttttacactgttggtgggactgtaaactagttcaaccattgtggaagtcagtgtggtgattcctcagggatctagaacaagaaatactatttgacccagccatcccattactgagtatatacccaaaggactataaatcatgctgctataaagacacatgcacacgtatgttgattgtggcactatttacaatagcaaagacttggaaccaacccaaatgtccaacaatgatagactggtttaagaaaatgtgaaccatatacaccatagaatactatgcagccataaaaaatgatgagttcatgtcctttgtagggacatggatgaaattggaaatcatcattctcagtaaactatctcaaggacaaaaaaccaaacactgcatgttctcactcataggtgggaattgaacaatgagaacacatggacacaggaaggggaacatcacactgtggggactgttgtggggtgggaggaggggggagggatagcattaggagatatacctgatgctaaacgacgagttaatgggtgcagcacaccagcatggctcatgtatacatatgtaactaacccgcacgttgtgcacatgtaccctaaaacttgaagtgtaataataataaaaaaaaatgtgggacatgtatacaatggagtactattcagccataaaaaagaatgaagtcctgttatttttgacaacatggatggaactgtaggtcattatgtcaggtgaagtaaaccaggcagagaaaagcaaatttcttacttatttgtgggagctagaaacgaaaacaattgaacttgtggagatagagggtataaaaatggttaccagaggctgggaagggtagtgggaagttcggggggaaatggtgatggttaatgggtacaaaaaatagttagaaagaatgaataaaacctactatttgatagtataactgggtgactatagtcaataacaatttaattgcatccttaaaaacaactaaaaaagtataaatggattgtttgaaacacaaaggataaatgcttgaggtgatggatatgccatctaccatgatgttattattgtacattgtatgcctgtatcaaaatatctcatatatcccataaataaatcaagaggatgcagggaattatggcagacatacctcttaacgtggatccttaaatgtgtgatccctttgctctatatatgttttgcattcaatatgtttgtaatatgacaaataagtatgaaccaattttttgcctccgtgtagaaagagatccagaaagcttgttggttggggttcaaggggagtataaaaaagaaaagaagtataatttaatttttggagtaagaaagggcaaaaagggaccttaactaaagtgagagagaatttagccctattttgtggtggtaggccaaaggaatctaggctgagaaagacctggatatgggcattgggagtgctcatccagattgaggaaaaaaatcagtaaatgccatcttgcaagctaaaggacttcatgtatggtatgtgtggtttcctaatctgaaagagcttgtaacttttttactcctcaccatttatgtcagaggaagttttaaattactaaagaaaattggataagtgtgttactgttttgataagttgtgactgatgcaggtgacctactacaaggagtaatataggagataaagaaggtcaaagtctctggatggttgcagccatggtggaaaagtagtatccattctattaccctgatccatcttgatacaactgtgggtaatcccatacagatctagtttggggtagctttagttaatccattctcctattaaagtttctgtgtgattaattggtctgatgaaatggtttccatcctaatattttgttatggctccaaatcctgtacccaagaaggttttcctaaaataaactatttaaaaattttaaaaaatgaaatacatataatgttatgatgacataaagtctctcttcccctgttctcaccttcctcaggcaagaagaataaatgtctctggtggaacttttgctctggtggaactgcttttctagaactggttagtgacttgacattggaaaagttttattactattagtggttattatctcttatggcctggctgagtgaaaggctttttgtgatactaacttctatgtatattctcctactactaaaaaaaatcttccatttctaagtcctgggaaaaatcattttttctttcaaaaaatatttattgagcccttgctatgtgtcaggcactgtggattcaataagaaataagacagaattcttaacgttgagaatgcatatgctggagggtgactctgataagaaaataagcaatgcaattataacacactgtgttaagagctatgatgggagaagtataaacagctattggtgcctgtagaagaagcacataacccaaagctgaagggtaaggagaagtgacataaatatagtaaaatgtatagtcagtttgttgttctaaggcctttggagtgctggagttcagttgcagctacaacatttactagttctgtttccttatacaagtttcataaccttttaaaggttcaattttcttatatttaaaatagagacaataataccactcacttcattggctagctgtgaaaataaatgagttaatacatagaaattgcttagcacagtgcttttgtaaataataaaaaatggaagcttattattactatgctgagagctgaagggttattaagatttaagaagtgaatgggagtgatcagtgtcaggagaagcctattccaggcaaagagaagaacatattacatgcttggaggcatagcagattacggggagtttgaataactaaaagaaattcgatatgttgtaatattgagtgtgaaggggctgggtaataatagatgaggcaggagaggtagataggggacatatagagatgtttagcttttattccaagaatatgcagagtcatcaaatgatttcttgcagggtattgacaaaattagacttgcactttagatcatgctggttgtaattggcaaaaatggattgaggaggggattggaaattgggcgactaagatgaccttattatagaaatttctattttaaaaatggctaagtaaatacggtactgtcctcctattctctcagaaatcaatccaaggtaagaacaaaaaacagaaatgtaaatttcatctttttaaaaaaactagatgaaacctataaaccttagccacaatatatgagggggcattaccaagagcagttatgggtgaagaggagtattggcagatacagttaggtgctgcttgcatctgtataactcaagcaaaactggggaaatacccaacaattccttatttggaattatgggaagatggtagtggaagtctccttaacccactcaagtcaatactagtaagaagcaggattggtaggaatgagggaaaaatcacactaataggccatatctgagttttacattttatttcattagtggtacagggtggaccaaagagactctgcattggatacagccctatagcaactgatctttgatgactttggagaagtaaaaagaaaaaagaaacttttacgcataaccttgtgtcataagaaacataactgttaactgggaagaatttctgctaatccagaaattcttggcttagcagaaaggaagatcttagctccttcctcttataaacctcctgccagtagtgatcataagaaaaactcatcacattcaaacatgagcagtagtcaaagaggaattaacacaggatttgtataagtataaaaaaaaaaagaaggaaaggaacagtagacaccaaaacaagcagagaaagaaaaactcatcagaaaaaaagttgtcatagatcacataaaaattttgggccgggcgcggcggctcacgcctgtaatcccagcattttgggaggccgaggtgggcggatcaagaggtcaggagatcgagaccatcctggctaacacggtgaaaccctgtctctactaaaaatacaaaaaattagccagtcatggtggcggacacctgtagtcccagctacttgggagactgaggcaggagaatggcatgaacccgggaggcggagcttgcagtgagctgagattgcgccattgcattccagcctgggcgacagagcgagactccaactcaaaaaaaaaaaaaaaaaattggccaagtatgaattaaaatataaaacaaaacaacaaaccttaattatgcactccttctgtaaatatgaactcaaaacgaagaactccaacggctcagagaagacatactaagaccacagagggacttgacaaatgagctcagggaagaaatggagaattaaaaaactattataggaatgaaggtcttattggaagaagccgaaagaaaactagatataacttaaaacactttggagatgtgggagatggaatgaagaaaagcaagaaaaatgaaacagaatccacaaaaaatttagaagtattagggacaaaaataattgataggaaagatgaggaggtccaatatataacaatgagtatagattcaatggactagatgcaatatttgaatatataattcaaaaatattttctagaaacaaaaaatgtcttggatataagtatggaaatggtattctgtagcctaggaaaacttgacatggaattgttaacatttatgttatgttcaaacaaaattactgttcctcaaagattaagactcttttatgcaactaggcaaaacagtctaatttcatgtaagaaaaaaaattcagactggctcagacctccacagcagcaatcaatgctaggaaacaatggaataatgcttaaaattccttaaggagagaaagtgtggactccagaaatgcatttccagatgttatccttttagtgaaaagatagcagacatctctgaatatgcaaaaacccagagaatataattccatgaatttttatagcagatggaaaacctcaacaaccacagataaatggagaaattatggcaaaaggagtggcagtgatgtaccagtatgattaaatgtggaattaaggtgaaaataaacatggaggttacagttagaaaggaatctgttttataaactctgacaaagtggaaataatagaacaaacaaaagatggaaggggaagaaaaaatgggaggtagtgtaagcactttttataattagaagctaaaattatttaaaatatagatgaagtaattgaaagtacatgtatttaaaactttaaagacaagtactaagataaatcttataattcactaacattagatgctggagtaagaagaaagtgaaaatgaaatggaaatagactaatttatttaatcattgttgatactgtggagtcaatagataccgtccagtgaaacagagaattaaatgtgttatacatttagggttagcccacagatatatttgcaaatgtgagaaattaggtatatgaaaagatgtttatggcaacatgatttgtaaaagccaagaactgtgaatcaaggaagttcccattaattggaaccagtgaaataaattatggtatatccattcagtatagctcaggggaaggaaggatacattttattgtataccttttggtaatttaacattttttgtgccatgtctgtatatgctttactttttttgttttttgagatggtgttttgctcctgttgcccaggctggagtgcgggatgggatgatctcggctcattgcaacttctacctcccagattcaagtgattctcctgcctcagcctccctagtatctgggactacagacatgcgccaccacgcttggctaattttgtatttttagtagagacagggtttctccatgttggtcaggctggccttgaactcccgacctcaggtaatctgcccaccttggcctcccaaagtgctgggattacaggtgtgagccaccgcacccggcctgctttactttttaaaataacattttttagttttaaaagtaaatttgtaaaaagaggctatttaaatcatttgtattagaaatgatgatagcccgtgttagacaaatggcagtggcacggagagaagtggatggattggaagtattatcagtcagatttggtgttagaatgatgagtagtgaggaagagaaaggagttgaagacaacatctatgtttcttctagtttgggtaactggatagatggaggtggcattccacaagatgggatatactgattccccatggatctgtcctcaggattcatccctcatctccctctgtagaattctgttatgtcatcccattccatgactttcgatttacatatttgtgaacagtttccatatctttcataaactctagactacctggttatcagatgccccctggatgtaacttatatcacttatccttgactaatcacaagacccaagatcatacactttagatctaaaatgaaccttagaaacgtctcatggtccagcccttttattttaccaatgaaaagcctaagacacagattatgtgacttttggatttttcttgtaaatttaaataagttgaagtatgaagttacatatttttgatctccctactccttatttaaatgataataaactaaaacatttctaagcagtgaatagtagatcaattttgtcctttaaccacatgtggcaagtaggcaacgtatgggaattaatgacaaattgtcatcatctctgtgatctctgccacactggcttcaaaatatttctacctgcctagactcaaagcctcagggacttctttattctcttattctaaggatcttctcttatccaacactccacatcaacccactgttgagtgatttttgttctttttctgaaacatcttatatctgtgtctttttctctattgccattgttacagctgtggtttacattttcatctctggatgatatcagtggccttcaaactgacctccttgactttaggctttctctttttcagtttgtctttgaaactgcagtagtttctccttatccatgcttttgctttctgcagtttcagttacccacaattgcagtctaaaaatattaaatggaaaattccagaaataaacaatttatattttaagttgcatgaagctctgagtagcataatgaaatctcatgtcatcccgttctgtcttacccaggatgtgaatcattcctttgcccagcgtatcctcactgtacactctgcctgcccattagtttcttagtaattgtctcagttatcagattgagaaagtacagtgtacattgggttcaatactacccagagtttcaggcatctactgctgctcttggaatgtatccccagtggataagaagggactaatatacagcaaaatgtttttctaaaaccatggatcttactgcaacctcttgtaaaatgttcaataacttttcaaaacagatagatcaaagtccagatttcttgatggcattcaaggccctccatgatttctaaccagcccttgtgtctgatttgatttctgaatacacttgccactgcagctatacctgactagtcatcttttccaaaattcaagctgtaattttctactcatgtgtagtagtttacctttttccatctatgtgaagtaacttttctcttatttttttgttgatgatttaagtatccttaaagagctcattcatctaccatttactttgggaagcattcctagagcaaactttctttccctgtactcccatgtctctgaatttgtaccaccaatagaattatgttctcacagtttgctttccattctacttagtggtattgtgtccatgtaccttccctcatgcagagataatgtatttttcattttgatatactacactaaccttccctttcccagtttttgcccattctcagtgctcagaaaattttctggattgaattgagaactctttgtgactcctctgcagaacttcagtaatctgaaattggattaaaaactgaggttagacaccagagggattatccgcaaacattgaagtaatagtggaacaaaagtacccttgaaatttgttatacttctaaatgtcattctgcacctgtgacctttttttccccaattttcatatcttatttattttgcaatttgttataattggggcatattttaaaaagtgaaacattatacttaatatgactgatttcccaaagggagtaggttaggaatgcaaagaatttgttacctgagataataatgcaagttttgaaactttttttctgaaaacatgtgagacagagtagaaaagttattttgatttttaaaaaatatatgccagccaattgaggacatcacctttgtgtgctttacgttttctcccactagagagcagcaaagattcataattgactcaggcaacagctaaaaatgctttgggattacttttgaaatatagtttccaatgctaaattgcacaaaatgccttttccattaatttaaaaaacatattttattgactttctggccaagtggaaactaatccgtagtaaaggcttttaagtttagtaaagcaaattgtgctatatggcagaacaattttcttaccttggtttttggcttcatttcttatttcatttattcatacagcaaatgtgttaatctctattgtgctaggcactatgctgttcttgagggtacaaaactgaataagatatagtccctgcttcagagaaccctgtttcatgaaaaaaattgttttagtatttctatgctaaatacaatggagtatgcaaatatgttataagacatagtaacacatagcatgcgttgaatgcttacaatatgttaggcactgctctaagtgttttgcttccactatatcacttattattcacactctaagaagaaagaattagtattcccattttacaggcaggaaacagaggcacaaaaaaggttaagtaatctgccacacatcacatgacatataaatgatggagtcagcattttaactaaggcagttttaatacacctgcatacttcatcactgtactatactgtttcccacataagctttgttctccaaaagaaaaccaaattggctcggtgcggtggctcacacctttaatcccagcactttgggaggctgaggtgtgaggattgcctgagctcaggagttggaggcctgggcaacatggcaagaccctgtctctaaaaaaaaaaaaaaaaaaaaaaaaaaaaattagctgaatgtggtggcatgtgcctgtagtcctagctacttgggaggctgaggtgggaggatcgcttgaacctgggagattgaagctgcagtaagctgtgtttgcaccactgcactccagcctgggtgacagagcaagaccttgtctcaaaaaaaaccaatctcatatggagaaatgagacatcttggaaaaataaacagcatcatcgaagtaagtgctttctcttgaggtttgtaatggagtctcaataaaggtactctccttttccacctggattcttgaacagtttgaggaataaaacaaaagagttgggtgatggggtcaaaatatcaccctctgatagaggccaaactggaggatttgttagccaaatgacaccaagtccccaagttagcaggctctctctctctacctcgccacctcaggaaggccaggtttggggtgaacctcacccccaacctgtgcttgctggggtagattccctggaggagtagtgaaatgtgtgctctccataagcagtttgctccccagaggaaaaatgggaggttctgagccaagcatgccaaatttactcttcctaagtttaccaataagataaaccatttcatctcctgtgagcagagagatgccataattatagttaccgagctcctccagggaaggaaacatcagaagtagtggagatgatgcattcctccctaatatttcctaacttctgacagtgatttccttttttttgagaaacgtattatggcagacaaaataggggctcccaaagatgtctgcattctagtcgtggagcttgtaaatgtcgttacatggccaaaggaaattaaggttgtagatgaaattaagttcactaaccatctgactttaaaataggagattatcctggattatctaggtggatccagtgtaataaatcttaaaagtagaagagagatgtggaagaataatcaagatggcagcatgagaaaaacttggtaccaaaagtatgagaaagagccgttataacaaaattttttcttacaaacatgggaacttctagtccagaagaagggatggtatgcattacaagaagtagagctcagtgtcttaaaagctagaaactcttggccaccctttttgcctaaggctctaaaagatgaaattgggcctgcaagagagagaaagttactatttgtataagccaataaaggtctgtgttattgtttgtttcccctttgatacgccttggcatttagtaaagtcatgtttgaatttctagtcttttcccactgtgccactggacataaagaaaaggtgcactttcacagcatcgggtagagagttaaatacaaagtagcacaacttcacaacctagaggcaaatatgatgaaggcattagtaatctgcaagaagattcagaggagtggaaagagtctcagacaggatgaagtagtgtagttcagttgcttttctccatttgaagattcctcggcatttctggactgtattattattaatatagattgcatttcattttaagaatttataaccatatatatgtatatggctgtatatgtgtgtatatatacacatgtatatatgtgtgtgcattatatatatgtatgtatatgtgtgtgtgtatatatatattctacttgaagtcagagccatgtttcccacttccacatgtatgtccaaaagcctgggccataaggggtagaccagttaataaagacttgagggtgagtatgcccaccagtaggtaccctcccatcaagaagagtgcttgaaagccaagtcactgtaaccatgatagagtttactcaatacatccattgttttcttagagtttctactaagtactaaacactgtgctaggtagttgctggagttaaatataaataaataaataaataaataaaacagttttcatccttaaggaattctaagtatacttgaaaagaaggacatgcaagtggatagttagaacatgatataagctaagtaaaaaataaagaagtttataagatgcaatcttccatgggccctgagtatccccatatactccttctgggtataccaagaatgaaagcttctgatttatctctacctaagccattctcagggttgggtttgcagtatgcaaccttgagggtttaggtaacttcttcccccaaagaataggcttgctaactgtgaaagtgctgaatctccaagtttagtgtttctctcctgtaaagcaacctactgcatgtgtaggccatggtctctaactcaatgttgtttttttctgtgagacttggaggatgtgaggaactggcatgaacatgaagctttggctactacttttgctgtaagtaatgaagtccttggtccctatctaggaatctcatgtcttctgccaggatccatgaacagtaataggttaatttgttagcttgtaagtagagtaaaatcctagacccttcataatccctgactgtactctgccttgggaaagtaaactgatattttagctaagacttgaagagtgaatgtggatttttaggctgacaataaggtcacctgtaccatgtcaagtaacagagtcaggcaaggccaccctgtgaatattttagctctcttgttaattctgacccttgtatgtctgcttggttcattgttcaattcttggaaatattgtgtatattctctttgtgcaagattttttatagtctatggttattagtgtggagagggtattaacaaaaacaaagattatacattctcagatacgagcatgaaccatcccaagtgtgtatgtattagattcagcttcttattgtcatttttcaaataccaactttgtttgagtttttactttgatacttttctttagctcatttttcaatgtgaaattacttttcctgaacttttggaatagggtgggtttcaggaaagtttttcataatattacagaactccttcctttatgtggtgttaaaaatatagagacttgtccaggctcggtggctcacgtctgtaatcccagcactttgggaggccgaggcggctggatcatctgaggtcaggtgttcgagaccagcctggccaatgtggtgaaagctcatctctactaaaaatacaaaaattagctgggtgtggtggcaggagcctgtaatcccagctactcggcaggctgaggcaggagaatggcttgaacctgggaggcggaggttgcagtgaaccgagattgtgccattgtactccagcctgggcgacaagagtgaaactcagtctaaaaaaaaaaaaaaaaaatagagttgctctctgggattttctggctttgttcacctaccctactttggtgtagatattcttgttccttttttcctattcttttcaattttggttgcactcacagcagtttctctctttgttccacccttctgtagcactcctagctcttttttcaggatttccttcctggaagacatgaactgataaaaggattctgttgttacatctgtcagaaggtgcctaattgcttgttatctttcctaccaaagaaatgctaataccatacaggttttctggctgttagtggttcaccactacccatgtgtatgttgtggtttataggagtaccttgttgttcaattagtaaatgaatattactcattttttggtacaacaaccaaaaaatgagtaatatttatttactaattgaacaacaacttttttttttttttttttttttttttttacttcgctatgtagtccttctttccattttatgtggggacttgaaaaaatggaaaaggtatatttccactccttcatcttcctgggacccatattaaaatttttatcaactgtaactattaatatcattagctcggccaatatattcctgctacatgttatacctcatgaggtgatttaccgagattctgcacctttacgaaaatgtctcttaaaatctcttaagatcatattttctgattgtatctaggctatcttctgatcttaattggatttctcccttagaagtgctcatgttgattagctgagatgtgtaaatactcttggatattctatttctcatgataaattatccatatattcacttcaagttaagccttcttttgggtctactatctgtgccacagtatgagttgggtacaagagtcagagagttgaataaaccatagaccctacactgagaaagctcaaaggcaaatggtttactggcattagggacctgtctttacctctgatgatgtcagatccctgaaacaacctctgatgaagaaaaggaactgagctttttgactgtcaaagctttatgaaaatatctagtgaactttctggaaggtagagggaagtaaactgctgctgagccccaaattaatgtggaggacaatactttgctttcggtattgacgttgaagatacctcgtggttattaaagatttgtcgtcctaaaatgtggctgggtacaggcatttactgacataaatttttcctaagaagtgttttcaaccagagtaagtttaacggtcaggtttaaaaaaaaaaaaacgggtctcagaagcccatgtgtgtaaatggccagcagcttcttcggggagttctccatggtagtgtgtttgggtcagagctcattccattgatatgaagctgatgcagtgtaatccctgggaagtgtccaaaaaagtacagtgctaatgattgaaggtaaaatacagaagtgttgaaggcggacgtagctcagcaatctttagtgtcttctgtgagttaacacagggtgtgcattgttcgatagggcattttctgttattcacactttaaatatacctttgtgtttatttttttgtgtgtgttgatatcttaatatacaatcatgtgttacttaatgacaggggtactccctgaaaaatgcattgttagataattttgtcattgtgcaaacatcatacagtgtactgacacaaacctcgatgggatagtctaccatacacctaggccatatgctcacacaaacctagatggtatagccctactaaacacctagcctattgctcctatgctacaaacttgtatagcatgttactgtactgagtactgtaggcaattgtatcagaatggtaagtattagtgtatccaaacatagaaaaagtacaacaaaaatatggtataaagatgaaaaaaatggtatatctgtatagggcacttaacatgaatggagcttgcaggactagaagttgctctgggtaagttagtgaatcagtagtgagcgaaagtgaaggcctaggacattactatacactactgtagactttagaaacactgtacacggctgggcacagtagctcattcctgtaatccccgcactttgggaggctgagaggagtggatcacctgaggtcaggagttcaagaccagcatgaccaacatggcgaaaccacgtctctactaaaagtacaaacattagccaggcatggtgccacatgcctggaatcccagctacttgggagacaggagaatctcttgaacctgggaggctgaggttgcagtgagccaaaattgcgccactgcactcagcctggtcaacagagcgagactccatctaaaaaacaaaaaaaagaaagaaagaaacactgtataccacttaggctacactaaatttattaaaaattttttctttattttaactttgtttaatcttagcttactataatatttttacttcagaaactttttaattttaacttttttattccttcatatcacttagcttcaagcgcgaacacagggcgtggtggcacagacctgtaatcccacatacttaggagtctgaggcatgaaaattgcttgaacccaggaggcggaggtttcagtgagccgagattgcaccactgcactgcaatctgagtgacagggtgagactgtgcctcaaaaacaaaagaaaaaaccaccaaccccccccccccaaaaaaaccaaaaaccaaaaaacaaaacacacattgtatagttatacaaaaacattttctttgtttatattattactctgtaagtttttttctatttttaaattttttatttttattttcctatttaaaaaaaaattcaatatttattttacatacagggggcacatttgcaggtttgttacatgggaatggtgtgtgatgctgaggtttggaatatggatcctatcacccaggtaatgagcacagtatctgataggaggttttgcaacccatgctcccactcacttcttccctagtagtcttcagtgtctcttcccatatttatgtccatgtgtgctcagtgtttagctcccagttataagtgagaacatgcagtatttagtttttctgttcctccattaatttgcttaggatatggcctccagctccatctatgttgctgcaaaggatattatttcattcttttttatggctgtgtggtattccatggtgtatatgtatcacatttgtttaatccaatctaccatagatgggcacctgggttgattctatgtctttgcaatttcgaatagcacagcaataaacaatacaaatgaatatgtctttttggcagaagtatctgttttcttttgggtatatacacagtaataggattgctgggtcaaatggtagtcctcttttaagttctttgagaagtctccagactgctttccacagaagctgaactaatttacattcctatcaacaaagtagaagtgttcccttctctcttcagcctagccagaatctggtgttttttgactttttaataatagtcatctgactggtgtgagatggcatctcattgtggttttgattgtcatttctctgatgactagtgatgctgagcattttttcatgttttttggccacttgtttgtcttcttttgagaagtgtctattcatgtcctttgcacgtttttaaatagggttatttgttttttccttaagttccttgtagattctggatattagacctttgtcagatgcagagtttgcaaatattttctcccattctgtaggccatctgtttactttgttggtgcagaagctcattaattaggtcccgcttgtcaatttttgtttttgtttttatagttgcttttgggaacttagccaaaaattccttgccaaggctgatgtcaagaatctattttctaggttgtcttccaggatttctatagtttgaggacttacatttaaatctttgatccattttgaattaatttttgtatatggtgaaaggtagccatcaagctttaatcttctgcatatggctagctagttattctatcacaatttattgaatagagtatccttttcccattgcttgtttttgtcgaccttgtcaaagattagatggttggaggtgtgtggctttatttctgagtttttaaattctgttccattagtctatgtgtctgtttttgtaccaataccaagttgttttggttactgtggctttatagggcagtttgaagtcaggtagtgtgatgccttaactttgttctttttgcttaggactgctttggctatatgggctttttgttattgttccatatgaattttagaatagtttttctaattctgtgaaggatgatgttggtagtttgataggaatagcttcaaatctgtaaattgctttggcaatatggccatgtttacaatgttgatttttccaatgcatgagcatgggatgtttttccatttatttgtatcatctctgatttctttcagcagtgatttgtagttttcctttcacttccttggttagctatattcctaggtatttcattttctttgtggctattataaatgggattgtgttttttatttcactctcaccctggagactgtcagtatatagaaatgctactgatttttgtatattgactttgtatcttttttgttttttggtttgtttgtttttaagactgattgtggctctgttgcccaggctggagtgcagtggcatgataccagctcactgtaacctctgcctcccaggttcaagtgattctcctgcctcagcctcctgagtagctgggactacaggcaagtgccacccagtctggctaatttttgtatttttagtagagatggggttttgccatgttggccgggctggtctcgaactctcaatctcagctgatctgcctgccttggcctcccaaagtgctgagattacaggtgtgagccattgtgcccagcctgattttgtgtcttgaagctttactgacttagcttatcagcctggaagccttttggtagtcttcagtgttttccaggtatagaattatatcattagcaaagagagatagtttgactttgtctcctcttttgatgccttttatttctttctcctgtttgattgctctggctaggacttccagtactatattgtataggagtggtgagagtgggcatcctcgtcttgttccaattctaaaggagaatgcttctagcttttgcccattcagtataatgttggctgtgggtttgtcatagataggtcttgtttttttgaggtatgtttctttggtgcctcatctgttgagggttttttatcatgaaggaatattgtattttattggaaagcttttctgtgtctattgtgataatcatatggtttttgtttttgatcctgtttatgtggtgaaacattttttggtttgtgtatgttgaaccagccttctatcccaggaataaagcctacttgattgtcgtgtattaactttttgatgtgctgtaggatttagtatgctaatattttgttgaggatttttgcatctatgttaatgagggatattggtatgaagttttctctttttattatgcctctgccagatttttgtatcaagctgatgctggcttcatagagttagtcaggagagctcctactcctcgatttttttgaatagtttcagcagaattcgtatcagttattctttgtatgtcagtagaatccatccggtctaggactttttatggttggtaggttccttattattgatgcaattttagaagttgttattggtctattcatggtttcagtctcttcctgattcaatcttgggagtttatgtgcttccaggaatttatccatttcctctaaattttctaatttgtgtgcctagagttgttcataggagtctctgaggatcttttgtatttctgtgggatcagttgtaatactgtctttgctgtttctgattgtgtttatttggattttctctttttctttgttaatctagctagcagtctatcaatcatatttattttttgaagaaccaactttttgttccattgatcttttgtatggatttttgcatgtcagtttcattaagttctcaaattttagttttttcttcttttcttctactagctttggagttggtttgtcctgtttcatttttctctctttttgtttttttgtagtgcctttaggcacaaagttagattgttaatatgagatctttctaacttcttgatgaaggtgtttagggctataaaactttcctcttaacattactttagctgcatcccagagattttgataagctgtgtgtctattatcattaatttcaaggaatttaaaaatgtctgccttaatttcaatgttcactcaggagttatttagaagtaagttgtttaatttccatgtatttgtgtagttttgagagatcttcttgatattgatttctgtttttttttttcaccgtggtccacagagtgttcctggtatgattttaatttttttgaattttttgagacttgctttatgactgagcatgtgtcaatcttagaatatgttccatgtgcagatgagaaaaatgtatattctgtggttgttgggtggagtattctgtaaatgtctattaggtccagttgatcaagtgtcaagtttaagtccagagtttgttaattttctgtctcagtgattcatctaacattgtcagtggggtgtggcagtctcccacgattattgtatagttgcctaagtcttttgtatgccaagaagaacttgttttatgaatcttggtgctccaatgttgggtgggtatatatttagcatagttaaggcatcttgtcagattgtaccctttatcattatgtaatgcccttcattgtccttcttaatttttttccttatttattattaaaaaaaattttaatttttatttcaataggtttttggggaacaggtggcatttggttacataaataagttgtgtagtggtgatttctgagattttggtacacccatcacccaagcagtgtacactgtacccaatgtgtagtcttttatcccctgccatcccccaccctttcccccaagtccccaaagtccagggtatcattcttacacatttgcgtcctcatagcttagctcccacagatgagtgagaacatatgatgtttggttttccattcctgagttacttcacttaaaataatcgtctccaattccatccaggttgctgtgtatgtcattatttcattcctttttatgggttagtagtattctatggtgtgtgtgtgtgtgtgtgtatgtgtgtgtgtgtgtgtgtgtgtgtgtgtataacattttctttattcacttgttgattaattggtgggcatttgggctagttccgtatttttgcaattgcagattgtgctgctgtaaacgtgcatgtgcaagtatctttttcatataatgacttcttttcctctgggtagatacctactagtgggattgctggatcaaatggtagatctacttttagttctgtaaggaatctccacactattttccacattgtccttcttaatttttattgctttaaagtctgttttatctgatataagaatagcaactcctgctcttttttactttccgtttccatgttagatcttactccacccttttactttgagcctgtgggtgtcattacatgtgagataggtctcttgaagacaacagatagttgagtcttgtctttttattcagtctgccacttttgtcctttaagtggggcttttggcccatttatgttcaaggttagtattgctatgtgtggttttgatcctgtcatcatattgttagctggttgttatgtagacttgattaagtagttgctttatagtacctgtgggctatgtgcttaagtgtgcttttgtggtagcaggtgttggattccatgtttagcactcccttaaggacttcttgtaaggcttattgaaacatattccctcaacctttgcttgtcctggcagaattttatttctccttcactcatgaagtttagtttggtgggatatgaaattcttggatggaatttgttttctttaagagtgctgaaaataggcccccatctcttctggcttataagttcctgctgagaggtctgctgctaatctgatggggttccccttgtaggtgtcctgacctttctctttagctacctttaagatttttttttttcctccccctccaacttggactttttcttttgtgttgaccttgctgaatctgatgacactgttccttggggatggtgacttgtgtagtgtctggccacgtttttctgtatttcttgtatttgcatgtcaacctgcctagcaagattagagaaatttccatggattgaatcctcaaatatgttttccaagttacttattttctctccttctctcttaagaatgtcagtgagtcatatatttggtctctttacataatcccttgtttctcagagatgttgttcatgtttttaaagttctttatttttgtccgactgagttgatttgaagaactgaggcaggaaaatagggtccagaggcagggaacataaggccgattcacacttcagctgtaacaggaaatatcctctccatagtgcatatgccataaatgactttgtaactgtaacttcacttcatccttttcatttacatagtgtgtcccaagtagagggtattgaaactcacaaaaactctgtaacagggccttagagccgctttgctcaggccaactcccacactatggagtttactttcattttcaataaaacccttcattcattccttgctttgtttgtgcattttgtctgattcttttttcaagatgccaagaacctggacaccatccaccattaacagaactggtcttcaagctctgagatcttttccttagcttgctctgttctgctgttaacacttctgattgtattattacattcttttaatgaagtcttcagctcaagaagttcagtttgggtttttcttaaaatggctatttcatctttcagctcttgaatcatttttattggattgtttggcttccttggattgagtttcaactttcacctggatgttgatgagcttccttgccattcagattctgaatcctatctctgttacttcagacatttcagattggttaagaaccattgctggggacctagtgggctcatttggaggtaaggggacactctggctttttgaattgccagatttcttgcactgattctatctcactgggatgatttttatttcttaactgtggtgtaaatttgagtacacagtcggttggcttcatttatggaagttttcagagggctaaagctttgtacagggtctttgttaagtgcttggtcttagtttcgcaggtgggagaattagttttttgacattgtagtttgggctacaatccagtaggtgatgcttgagacaatgggcgacaggttgttactcagccatgcatctcctttgtgtatcctcacatttgcacctgtgttctatggtatgagggggagagaggtgacctcaccagctccactcttgagccttgggggagccacctcccatcattggcaatgtgcccacaattttattgttgttattaggtcttttgggcgttgaggctccctccagaagaggtccagtagggagataggccacacccttattggacaagccctgtggaaggaggcatacctaggttccacaccagcctgtgaacctgtgtgactcagccctctcagctttctgagaatgtgggctcctccccagctcaagtgccgggcacagatcctgtcttggcagtctggagccactggccacaaccctggaacaccaggacctgctcgtggctccctcctccaggtcctcaggactgggttctgggtgcactgagagatatgaagggcttacaaactgccagaatgcactcagatgaagcaagagacccaggttgggcagtagagcctgcactgtatgcacgcttctgcagggcagccagacaggagccctggaagggttggctggcaggcaagactgcagggcagatgtgccccagtcccatgtagaagaaagccttgctttcttcctggtgattagctgggagattagagggagatgggcagcctgcagtgggggtgggtgcttatggctgggctccactggaactaccccacacatgcttgctgcagatccatttctgtctaatctctggggaaatgcccctgctagctcaagcatctatgggggatgtggggtctcctgcagctaggatcccagaggtctatggtgcaagtgggatgtcctccatcctcttcactcaccctttccctaagtgcagttggaggcaggaaaccagccctagcatttaggcaccccacacgagattcccagcttcccagcttccttgccttcagcctcagtgtctgtgccttttcaccttccacatttggtgtgttctctccaaagatctgttcaaattacattggtttagacaaaatccttgtctttctctgtaggagcagcacttcctggctgtatctagttgtccatcttgccccctcctctatttttatacttttaaaacttttttgttaaaaactaagacacagacacacacattagcctaggcctacacagggtcaggatcatcagtatcactgtcttccatctccatattttgtctcactggaaggtccttgggcaataacacacagggagctgtcatctcctgtgataacaatgccttcttccagaatagctcctgaaaggcctgtctgaggctatttacattaaatttttaaaaaaaataaatagaaggagtatactctaaaagaatgatcaaaaacatagtatgataaatacataaacaattaccttagtagtttatcattagcaaatactgtgtactgcacataattgtatgtgctatacttttatatgactagcagagcagtaggtttgtttacacaaactggtgaataatgtgttccactaagatgttacaatggctacatgtctctaggtgataagaatttttgaattctattatatcttataggaccactatcatatatgaggtctgttatctgaaacatcattatgtggtacatgactctatgtgtgtgtgtgtgtgtttgtgtgtgtgtgtgtgtgtgtgtgtgtgtgtgatctttgtggtaagagtgtttgttctatagatcaattaggtcagttattcccaggagggataggaaaggaggtgggaataaactactacatagaaatagtcttaccaggtgcagtggcccatgcttgtaatcccagcactctgggaggccgaggcgggaggattacttgagccctgggtaacatggcaaaaccctattgctactaaaaatgcattaaaatagctgggcatggtggcttgttcctgtagtcccagctcctcgtgaggctgaggtgggctgagcccacgaagtcgaggccgcagcaagatcatgccactgcactccaccctgggcaacaggattgagatgctgtcccccacaccaaaaaaaaaaaaaaaagaaaaaagaaaaagaaaaagaaaaaaaaggaattagtctatgaaggtaattatctggggcaatcagtgaaagaacccacagcttatggtgctatacttgaatttaactggtcaatttagccttcttcattacagttttgtcctaaaacataaccctgacaattgattttaagtctgtataatctttactgatatttttctttttatactcccttgagacaaaataacattttttgtttgttttatatttgaaaaccctacttttatgtagatttggtcatagaagcatgctaagttgatgttttcagaggaagtttatcatacctcctagattcttcccttaagatttcagtaaagtttaattttttgttgttataaatgtttgaacatacaaacactaaacactaaatacaaactgaattttatattgcacccaatgaaacttacagtgacattaatctgacatactaagtgatgagtatgattgctattgaactttatgaaatttaaagataaatattgaactttgtcataatttatctgtggaagaatagtataaacgtaacccataaaacatgttattgtattgattgtaaggatgttattgaggataggatttaattcattatatattattttctgtatgaatactcatggaagatttttctctgttcttagaacctgtaatagttctgctgcttataaactattgttttgtttaccttttggagactctgtatcttataactgatcatattcctctttgcattgcctgccaggaagctcagagccagatttctggccaatctgtagttaagtgtggaggatattatggcatgaagtatatgtcctaagctcacattttatcttacttttatgttgccattttttcttacctattaaattttataacttattgtattgattttactttttggtaagccattaaatttcaattaacaggaggtctgaataaagaaagtgaatataaataattacaagtgggaggagtttacatagtcagatttcagggttggagctaactataggcaaactgaatgaagtaggaagtttctctatctgaggatctcaggaccatgaatgtaggagggattagaaggtcaggctttataatttctcacattggagtttcctaaatttcaggttgtctgggtactgtgcctcaaattcccttttttctctattcgtcattctcagtgcttaccttggcttcacaggccaagaagtgtttcttgtaccaaaggaggtttcttgtccctaaatatatttcataaatttccaccagacatagatttatttggacaagcaaatacccatgtaaggaataagatttaaatcttcctacctaccattcacaaggaggtgtgagtaagtaacagcatcataaaactgaaagggtctttagaaatccaaaacaactctcattttataagtaaggaaattgaggctccctgtggtaaagtaatgtgccaaagggcatacaatttgtaagtgttgaaaaccaggactagaatttctaaatacaaatccagcatatgttagaaaagaaacgctttttaaaagaactgtaggacatgggacagttctttatatatatttagtccatacttagtgtatataaaatactgtaccaaaggagtgtcacctttggaactggtagggacccacgctgcccttgtggattcagtattcacctaggtattatggttatgacaatgatcgagtagagcacaaagaaatagaatgggaaaaaggatatctggaacaagaagcaataaaaagtagagggaaaagaagtaaaggataagattatgaggagaagcaaggcagatggaaagatagagacaaaaatagaagtgaaagacagaaataggagaataaaaatgagcaaaagagaaacagacgaaaaatgggactatgaggatgaaaagtaagaaggagatagtaaagaataaaatatgaaagacatgaaaaatactcactagacagtcaaatgctcaatcagctgttgtaaataacatgtgaaacaacacattacacaattagtatttaaaaacattgagtattcattttactttctaagttactgagaggtaccaatatatttccctaaaatgaaaattaatacattgaaaaaaaaacaataaataaaccctgaaactttttgggtaaaattttagtaggaggaaattcattaatatattaatagattttttgatttgtggggaattagttaaactgggataaaaagcaactgtcaccctaggtctgagctatcttcctttaaagatgcaaattaagcatggactttcaaatagtacttaggataagaaagttacaattagctgctataataattgtgctctttggttctttctttgtttcacagtggctttaattaaaggcctagttatgtaggaaagtcacattaattattcatctgcaaacatttacatagacttccctgttccccttcaataaattatcaacttcacatctccataatttaatcaaaatgactaaaaatacaccatctcaggcttctgcccctcctctctgggctttgtctcttcagtgttacttgttcttgcagaagacttcccactgttattaagaaataagagaagaaaatctgtcggctgaaattgtatggatagtctttacttttttgcacactgtcatattgattggtacaaagctgtggtttgcaaatgtccataatttttttggagtaaaatgagagggatcatagaattgtagtattattaaaagccagtatgatgccagaatatattaatagaagcatattcaagaataaagaaaaaatgtttcccataatcctcagagtataaagaatcaaagcttccattactaagcatagaaaaattataaaagggaaattcttctaggggtttcagctaagcagtttagagagtcatatgtaaaattataaatatgatttaagaaaaattgcctatggaggcagatgtgcaatttgatagataaataattacttacttagtagggctgcaatttaacctaacccttttttatttccttccaacttttattttaggttcaaggtggtacatgtgcaggtttgttaaatgggtaaattgcatgttgctggggtttggtgtacaaattatttcattacccaggtagtgagcgtagtacccgataggtagtcttttgatccttacccttctcataccctccactcttaggtaggccctggtgtcttttgttccctgttttgtgtccctatgtattcactgtttagctcccacttgcagaagagaacatgcggtatttgatgttctgttcctgaattaatttgcttagagtaatgacttctagctgcatccatattgctgcaaaggacatgacttcattcttttttatggctgcatagtattccatggtatatatgcatcacattttgtttatccagcccaccattgatgggcatctaggttgattcctgtctttactattgtgaatagtgctgcaatgaacacacatgtacacgtatctctatgaaagaatgatttatattcctttgggtatatacacagtaatgggattgctgggttgaatggtagttctctttaagctctttgagaaatctccaaactgctttccacagtggctgaactgacttacattcccatcaacagagtataagcattcctttttctctgcaatttcaccaacatctgttattttttaacttttttttttttgagacggagtttcactcctgtcacacaggctggagtgcaatggcgtgatttcagctcactgtaacctccgtctcctggggttcaagtgattctcctgcctcagcctcccaagtagctgggattacaggcacccaccaccacacccggctaattttttgtatttttagtagagacaggatttcaccatgttgatcaggctggtctccaactcctgacctcaggtgatctgcccacttcggcttcccaaagtgctgggattacaggcatgagctaccatgcccggcctattttttaactttttaataatagtcattctgagtggtgtgagatggtgtctcattgtggttttgatttgcatttctttaatgattagtgatgtgaaacattttttcatgtgcgtgttggccacttgtatgtcttcttttgagaaatgtccgttcacttctgttctgtcctttgcccatttttaaatggggttatttgttttttgcttgttgatttgtttaaattccctatagattctggatattagaccattgtaggatgcatagtttgtgaatattttctcccattatttaggtagtcagtttgctctgttgatagttttgtttgctttgcagaagctctttagttttgttaggtcccatttttcaatttttctttttgttgcaattgcttttggagtcttcatcatgaaatctttgccagggcctatgtccagaatggtatttcctagattttcttctagggtttttatagttttaggttttacacataaatctttaatccatcttgagctgatttttgtaaatggtgaaaggaatgcatccagcttcaatcttctgcatatggctaatcagttatccctgcaccatttgttggacagggagtcctttccccattgcttgttgtcgactttgtcaaagattagacagttgtaggtatgtggctttatttatgggttctctaacctgtcccattggtaatggtctctgtttttgtaccagtaccatgctgtattggtgtaccattggtcatggtctctgtttttgtaccagtaccatgctgttttggttaatgtatccttgtagtatagtacttgacatcaggtagtatgatgcctctgggtttgttctttttctttgacatgactttggctattcagtctcttttttggttccatatgaattttagaatagttttttctaattttatgaaaaatgccttagtttgataggaatagtattaaatctgtaaattgctctgggctgtatggccatattaataatatcgatgttttctagtcatgagcacagaatgttttgtcattggtttgtgccattgctgatttctttcagctgtgttttgtaattgttgttgtagagatctttcatctcactggttagctgccttcctaggtattttattctctcgtgaatgagattgcattcttgatttggctctctgcttggacgctattggtgtatagaaatgctactgatttttgtacattgattttgtatcctcaaactttgctaaagttatttataaaatccaggagcctttggacagagactatggggttttctaggtatagaatcacatcattgtaaaaagagatagtttgacttcctctcctttctatgtggctgccttttatttctttttcttgcttgattgctctggctaggacttccagtgctatgttgaataggagagttgagagtaggcattcttgtcttgttccagttctaagggggaattcttccagcttttgcccattcagtatgatgttggttgtgggtttgtcatagatggctcttattttgaggtatattcctttgatgcttggtttgttgagggttttttttctttttaaattttattttaaattgacatataattgtacatatttatgaggtacagtgtgatgtttcttttttctttcattttaagttctagggtacatgtgcacaacgtgtaggtttgttacatatgtatacatgtgccatgttggtgtgctgtacccattaactcgtcatttacattaggtatatctcctaatgctttccctccccccttcccccaccccacaacaggccctggtgtgtgatgttccccttcctgtgtccaagtgttctcgttgttcaattcccacctatgagtgagaacatgcagtgtttggttttttgttcttatgatagtttgctgagaatgatgatttccagcttcatccatgtccctacaaaggacatgaactcatccttttatatggctgcacagtattccatggtgtatatgtgccacattttcttaatccagtctatcattgtggacatttgggttggttccaagtctttgctattgtgaatagtgccacaataaacatgcgtgtgcatgtgcctttatagcagcctgatttataatcctttgggtatatacccagtaatgggatcgctgggtcaaatggtatttctagttctagatccttgaggaactgccacactgtcttccacaatggttgaactagtttacagtcccaccaacaacgtaaaaaaaaaaagtgttcctatttctccacatcctctccagcacctgttgtttcctgactttttaatgatcgccattctaactggtgtgagatggtatctcactgtgattttgatttgcatttctctgatggccagtgatgatgagcattttttcgtatgtctgttggctgcataaatgtcttcttttgagaagtgtctgtttgtatcctttgcccactttttgatggggttgtttgtttttttcttgtaaatttgtttgagttctttgtagattctggatattagccctttgtcagatgagtagattgcaaaaattttctcccattctgtaggttgcctgttcactctgatggtagtttcttttgctgtgcagaagctccttagcttaattagatcccatttgtcaattttggcttttgttgccattgctttttgtgttttagacatgaagtccttgcccatgcctatgtcctaaatggtattgcctaggttttcttctagggtttttatggttttaggtctaacatttaagtctttaattcatcttgaattaatgtttgtataaggtgtaaggaagggatccagtttcagctttctacatatggctagccagttttcccagcaccatttattaagtaggtaatcctttccccatttcttgtttttgtcagttttgtcaaagatcagatggttgtagatgtgtggtattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttgtcaatgagggctctttttaggttccatatgaactttaaagtagttttttccagttctgtgaagaaagtcattggtagcttgatggggatggcattgaatctataaattaccttgggcagtatggccattttcacgatattgattcttgttgagggtttttaacatgaagagataattgaattttataaaaagctttttgtgcatctattgagatgatcatttgggttttgtttttagttctgtttatgtgatgaatcacatttattgatttgtgtatgttgaaccaatcttgcatcccaggaataaagcctacttgattacagtgggattagctttttgatgtgatgcttgatttggtttgctagtattttgctgaggatttttgcatctacgtttatgagggatattggcttgaatgtttttgtttgctgttgtgtctctgctaggtttggtataagaatgatgctaacttcatagaatgagttaggtaggagtccttctctttgtttttttggaatagtttcagtaggattggtaccagatcttcttttacttctggtggaatttagcggtgattatatctggtccagcattttttctgcttggtaggttttttattattgatttaattttagaactaattattggtgtcttcaaggtttcaatttctttctggtttgatcctgggaagttgtatattgccaggaatttatctgtttcttctaggtttcctagtttgtgtgcagaggtgttcaaagtagttcctgaggaatttttatatttgtgtgaggtctgtggtaatgtcccctttgtcatttctgattgtgtctatttggattctcttttctctttatttgtctagctagtggtatatctatcttacttattcttttgaagaaccatcttttggttttgttgatcctttgtatggttttttgcatctccatttcattcgtttcacctttgattttggttatttcttttcttttgccagcattggtattggtttgctcttgtttttctagttcctctaggtctgatgttaggttaatttgagatctttctaactttttttttgtttattttatttatttttttgagacggagtctcgctctgtcgcccaggctggagtgcagtggtgcgatctcagctcactgcaagctccgcctcccaggttcatgccattctcccacctcagcctcctgagtatctgggactacaggcacctgccaccatgcccggctaattttttgtatttttagtagagacagggtttcaccattcacaggatagtctcaatcccctgaccttgtgatccacctgcctcggcctcccaaagtgctgggattacaggtatgtaatctcgtgtgcctggcccagatctttctaactttttgatgtgggtgtttaacactataaacgttcctcttaacactgctttaactgtgtcccagagattccactatgttgtatctgtactgtcattattttcaaagaatttgttgatttctgcattaattttattgtttacccaaaagtcattcaggagcagattgtttaatttccacgtaatcatatggggttgagagaccttttggtattaatttctttttttattgcactgtggtccatgaatgtagttggtgttatttctatttttttaaatttgttgagaagtgttttatggtcaaatatgtcatcagttttagagtatgtgccatatgcagatgagaatgtatattctgttgttgttgggtagagtgttctgtagatgtctgttaggtccatttggtcaattgtcaagtttaggttccaaatatctttgttagctttctaccttgataatctgcctaatatggtcagtgtggtgttgaaatctcccactattactgtgtggttatctaagtctatttgcaggtctctaagagcttgttttatgaatcggggtgctccagtgttgggtccatatatatttagatgaccttgagaggtgacagcgtgctggcagccctcgcgtccctcgctcactcttggcgcctccttggccttggtgcccactctggccatgattgaggagcccttcagcctaccgctgcactgtgggagcccctctccggactggctgaggcgggagccagctccctctgcttgtgggaggtgtggagggagaggcgtgggtggaaaccggggctgtgtgcagtgctcacaggccagcgcgagttccgggtgggtgtgggctcagtggccccacacttggagcagccggccggtgctcccggccctgggcagtgaggggcttagcacctgggccagcaactgcagagcgtgcgccgggcccccagcactgccggcccaccggcactgcactagaattttcaccgggcctcagctgccttcccgcagggcagggatcgggacctgcagcccaccatgcccgagcccccccacggtgggctcccatgcggcctgagcctccccgatgggcgccaccacctgctccatggcaccatggcatccagtccccatcgatcgcccaagggctgaggagtgcagatgcgcggcccaggactggcaggcagctctgcctgtggccctggcgcgggatccactaggcaaagccggctgggctcctgagtcaggtggggacttggagaacttttatgtctagctggaggattgtaaatccaccaatcagcaccctgtgtctagctcaaggtttgtgaatgcaccaatcagcactctgtatctagctaatctggtggggacttggagaacctttatgtctagctaaaggattgtaaatacaccaatcagcactctgtgtctagctcaaggtttataaacacaccaatcaccactctgtctagctcaaggtttgtaagtgcaccaatcagtgctgtgtctagctcaaggtttgtaaatgcaccaatcagtgctctgtgtctagctaatctagtggggacttaacagaacttttgtgtctagctcagggattgtaaatgcaccaatcagcacccggtcaaaacggaccaatcagctctctgtaaaatagaccaatcagcaggatgtgggtggggccagactagggaataaaagcaggctgcccctgccagcagtggcaacctgctcgggtccccttccacactgtggaagctttgttcttttgctctttgcaataaatcttgctgctgctcactctttgggtctgcactgcctttatgagctgtaacactcaccgcaaaggtctgcagcctcattcctgaggccagcaagaccacgaaccaaccgggaggaatgaacaactccagacgcactgccttaagagctgtaacacttaccacgaaggtatgcggcttcactcctgaagccagcgagaccacaaacccaccagaaggaagaaagtctgaacacgtccgaacatcagaaggagcaaactccggacacatcatctttaagaactgtaacactcaccgcgagggtccgcggcttcattcttgaagtcagtgagaccaagaacccaccaattctggacacaacctaactcttaaagatacattggcaagcaattaaaggagtcataaaagatggtagtgggaaaaatatggatattgtagttagctggatctgagttcaaatctcaactttgctgtttagtactgctctgatttggggacagtttctgatttttaaaaaggcttatttgttaatcttgatagataatgccttagctcaggatcatttgcttgcaaggaagagaaacccactcaagctaaattaaatatagtgaacttactgtacggaaacaaagaaatctcacggaagacgtgctaaatatagccagaccttatggaaatttgaaagtttttaggcaacttttcttttcttggaatattctcctagagtctcttattttttattcctgtgcaagacttgtatttcctgaagaaattaaagaatacctaaataagtagaaagacattccatgtttgtggatcaaaagacttaatatttttaatatgacaatccaaattaacctagagattcagcacaatccctgtcaaaattccagctgttttgttttcgttgggcagaaattgacaagctgattctcaaattcatatggatatcatgaaggcccagagtagccaaaacaatcttgaaaaagaaaaatgaagtgggaagactcacacttactgattccaaaacttactataaagctaaaggaatcaagacaatgtatctctggcatgatgatggacatatagatcaatggaatataattgagaagtccagaaattatatatatgctcatatatatggtcaatttatttttgagaaggatgcccaattattcaatgggaaaagaatagtcttttcaacaaatggtgcttggacaactatatatccaaatgttaaataatgaagttggacccctacctcacactatatacaaaaattagctcaaaattgatcaaaaactaaatataaaagctaaaactataaaatttttagaagggataagaggtctaaatcttcatggccttggattaaggaatgctttcttaaatatgacaccaaaagcacaggcaacaaaagaaataatagataatttggactacatcaaaactaaaaatatttgtgcatgaagggacagtattaagtgaaaagacaacacacagaatgggaataaataattacaaattatgtgagtagtactgtggccatggtcatttatgcccattttgcctcttatctcttcctggtcttgcaggacttcatcctcctctcaaaaatgttttccagttgtttcatagaagctctatgattctggtgtttcacatgtgctcatgaaaacttctgtgttctttcactcttgtgtaagcctcctaactgcaagccaccagggagaagcatttctcccaacagctttttttgagggtgctactcatatgggtattctgttctctacctactgtaggccaaaagtatgttcacagtagtgttagaggaaaggaaaaataatctctgtgattctgtattgcacatgatcacttggacaaaaaagtagctatgttgtgttcagagcctcctgtcatgaatatacttcctttagccttttgccctaatactgctctcggaagaatttgaacccattctccagtatagacatggagagaaatggcacagcatcctgatcattgtccccaatttcctcttgtctttattccacaggtgcctctatatctgtattcatttaggaaaaaaaattcaaaaccccaaaacccaaaccaaaacaaagcaaacatcaacaacaacaaaaaacaaagaaggaatgaataaaaaaacatgtacataaactcttaatgtagatacttgaatgttacctgcacagcagaagatgtgatccttagctgtccagataggacacgattttaaaaatcatcttaaagtagttaaattttgagactgcatgaagtatccttaatcagtagttattttggtatgcttgcttagtcagttcaactcccatcactttatacattcttcccttatgtatttcaaatatatatcaatattctaattagaacaatattgtaatacattatttcagacataggtataattaccagcaattgctatatgcaggcacccaggaaaagtggtaagcccttttggttgaagattcgtttatttttgttttcagttttcaaaagagtaaggaaaaaacacatctgaaattcttgctgagggcctggggttaaaaattacataatctactgttttggtctagaagaactgtgataaagggagtaaagcatgagttctaaattccagaacttttgaattccaacttcacttcttatgtattcttgatcaagtttcattgtgagcttcagtttcctccttttaaacggaatatatttcccaatgttaatgagatgctgcaaagtgcctagcacctagtaggggctcaacagatgttacttcctcctacccattgctttttcttacagggttgtctcatactcgagtgaatcattgctatatgggagttttagaactgggaagaaataggtctcagtttttattgccatgacaacagaattcgagaagtaaaaaattttctcctgaaacagaatttgagaagtaaaaaattttctcctgaaacagtgagcaactgttaacaaagtagcacctttttaattggtggcaagtatgtgatttttttttttccctttttgcttcaactagttttcctaattttgtttattctgaaaggtccaaaaagagaagttggtttttgaatttctatttactgtgaaaatgttaacagtaatatctagcagttttctatcacctaccctgctacttgcaggatatcgtggagggtatcatgggttttattattatctgaaattaggccttttcataatcaatatatgtatttatcagatgtctttaagccataattatattttattcataaaatctcaaagactacaatggtcatgtagtatttccttcaccctctcaataagatcatttccaaaaggatttttctactcattgtttcaaaatacttaatgttgactcaattaatttccatggcaatatatttcactcactcattgtttttgtggtctaattaccaacccaacctactaaaatgtaagcatgttgtctctcctctctaccaaagatatggaaaataaccattgttggccaggcacagtggctcacgcctgtaatctcagcactttgggaggctgaggcagggcagatcacgaggtcaggagatcgagaccatcttggctaacacggtgaaactctgtctctactaaaaatacaaaaaaattagccaggcatggtggtgggtgcctgtagtcccagctactcgggaggctgaggcaggagaatggcatgaacctggtaggcggagcttgcagtgagctgagattgcgccactgcactccagcctgtgagacagagcaagactccatctcaaaaaaaaaaaaaaaaagaaaaaaaaaagaaaataaccattgtcactcataaatcatacctttatatgctctaattgcatgctttacttaagaaagactgtaagttatgatctcttttttagaataaataaaccattgtccttttatcatgtgagtcagtatgaagctattttaaaatactgttctgcttaaaacttatttctaaagtttctttgaaagctagagtcctcaaaagcagtttggcagagatcagtaaataaattatttactaaaaactttcttattagagagaagagctgaatgacagagaaatgtgttgccagtaaaattatttccttctcattgataaaggaccactacagatatggaagtcatgctgctagcatgcaaatattaaatggcataatgttctttgggtttttgataagtacttggagcagaaaataatttttctcttgtgcaattatagagaggaatttattagtcagataagaaagaagctaaaagaagtgctaagaatggaactgtggcagagattgctagctgcccacctaatatccattttctctttttctttgctatgaagttttcatgggggcaataatgtactcaagcttaaaatattacatttccaagcctcccttataggtagaagtggacaaataatatggtttgggtcaatgatgtaaacaaatggaagtttgtggttaggacatctgcaaatacttcaaaagttagtgatccactgctggtatgccttttctgctctatggacggtctcctttctccagcatggaacatgataggcatgataggtgaagacccatttatcttgtagcagtgagggaaagctgagagaacctaagtacttcaacttagacctcaaccttgtaatagtttcttagatgcagtcagtattgcttaagattggctactcattagaatctactagggatattgacatctactaacaggtaagatgtatgtagattgcagcaggccaatgtttccattgcaatggccagataaattacaaatacgtttttaaaggtatcagatacctgtaagagcaagtttataatactaaaatcctagagggggaagaatctagagagggtaggtgaatgaacaaatgcctccctctggggcttttgcctgttctaggcatggattgaggatcctgcttgatctaagtagagggacttcacggagaccaaaatacatgaaataaagtttttagtagtcattcagggttagaatggaaaagaggaaacttgaagcactttagatgcatgtctaaaaaaaaatctaaagttttttccccacagtacgttagtcaagttttggtattacgagggagctgaagagctaagctgaaagcttctaaaaggcagagtgaaattccctgcagtctcatgataacttaggaaacaaagacccaccaagggaggggaccttccttaaagatacagttgatttcctcctgaaaatatttgctagattttaaaatgtaggaggcaagaggctgaaggtgggctgaggaccttggaagggcagagctggatctacagtttgctagaactgaagaatgggaagctcaccaggatctccagaagaaagctcatgagagcctgaggaaaagaggtgagccagaggtagacttgacttttattaacactgaaactcagctccaacccagctccgtaattggattgaggtaatcagccaaccactcatcctatacgctagtacaggacagaagaaactctttggtgaaagataacattacttggagctttgtatcattttttaaatacatggagcttagcatacaataaaaagctactagatttacattgaggcaagacaaataggatgtataatgaagaaaaaagcagacagttatgctcgggccacatgtggtccagatattggaatttgcagacaataaatttaaataactgtgattaatatatttggaaaataatggaaaatgtggactcatagataaaatggtggaaaatgttgccagagaattggaatctctaagaaatgaaatagatgtataaaactaaaaagtataatatctgaaatcaagaactcaatagataggttttatggatacagcagaacacagattaagtgaactggaagacaattcaagagaaaatacccaagttgaagcatggcaagacaaaaggatcgaaagaacaaactggagtatagcaaacaggtatagtggtacgatgacaatccagttctctgggaaaaataaagtatcaatttgcagtgtttgctgactgtcatggtgtaaatactgtcaaccatggatgatttcaagctaccaatgatttaacaacaatctcacagaattcctgaatatttaacaattggctctgacaagctggtatgagctgctccagcacactactttatatgaatcatacttagaatctaaaatatgtttaattagagatccagagagaagatagagttgggaaagaaggaatatttgaagagattacagctgagaatatcccaaaactttgaaaataaatcacagcaaactataaatatggtaaatccaaaaaagactatacgtaggcatattatcatgaaactgttgcaaaccaaggtataatgggctggatggtgacacccaaaaagatatgtccatgtcctaacaaatgttaccttgtttggaaaaaggatctttacagatttaattaagaattttgagataagatcatcctggatcagttaatccaggtgggccctaactgttgtctgcctgtttcaccatgataaaaaaagaaatacagttacttgcattagttatgaaaagggggacattactatggattttatagacatcaaagttttgaaaattatgatgaaatggatgcattttaaaaaaatactactaaccaaagctgaaagaagaaataaaatacctgaagttttatgtttatttaaaaggttgtccattaaaaaacagccctcccctgatgaaaattacacattcaatgaatacacaggtaaattcttctaagaatttgtgaaattcttgtgaaacaaatatttcacaattcttttataaaacagaatactacaaggaatgctttcttgcttttttttttttttttttttttgagacagagtctcactgtgtcacccaggctggagtgcagtggtgcgatgttggctcactgcaacatccacctcccggattcaagcaattctcctgtttcagcctcccgagtagctgggattacagttgcacaccaccatgcccatctaatttttgtatttttagtacaggcggggtttcaccatattgctcaggctggtctcaacctcctgacctcaggtaatccacttgccttgacttcccaaagtgctgggattacaggcgtgtgccactgccccccgcctgcttccttgctttttgtgaggccagcgtaattttgattctaaaaactgacaaggaaattacaaggaaaaaaaattacagaccactgtgtcatgaaagtagatacattaaaaaaatccaattatatgtaaaaaacatatcccatgatgatgaccaggagatttcacagatacactgatgatttggcattcaaaaaaatcagtgaagacaatctatatatcatcaagaaaaagtgagaggtgacattatcattgcagcagatacagagaaggtatttgagaaaatttagtgcacattaatgattttttaaaatcttggcaaacttaacaataaaatggaatgcttttaatttgataaatatatctattaaaatcctatgtgatacatcacttgaaaagataaaatattcaaaactttctctctgaaattgggtatgagtcaaagaggccagctaccaacacttacattaaatatattctggaggtctcaggaagtacaataaggcaagaaaaataagtgaataaagattgaaagggaagaaataaacctatttttacatgacatgattgtacatgtagaccattcaaaagaatctatagtcaaactattagaatcaataagtgaatgtagtaagatttttggaaataagttagatgtataagagttaacttttttgtatgccagcaataatcaaatagaaaattaaatttgaaaaacaatactatttataattacatcaaagaatgtcacatacgagcaataaatttaattaaaaaggaacaagaaactacagaatattattgcgagaaatgaaagaatcctaaatgcactgattgatatgccatgttcttggattgggagccctaatattataaagatattttttcccaaattaatctatagtttcagtacaaccccagtcaaaatcccagagattttattgtgtaaattgaggtgatgattcctaagttcacatggaaaaaaaaaaaaaaaaaaaaaagagcagccaaggcaatctcagaagaacaaagctggaggacttacactaccagacatcaagacttaaaaacctacagtgtgtaggacagcgtggttttgggattaggatggagtaattgaccagtgagaacagaatagagggaaaaccccctacacatactcagccatctaatttatgacaaaggctatgctgcagttgttttaaaaagcctttttaaacaaatgatgcttagttacagtcaatattttggctattcctacctcataccatttataaaaattaaatccatatggactgcagatataaatgtgaaaaagtaaaacaaaaaagcttttagagtaaaatgtaggagaacttctttctgactttgttgtagtctctgatctgtggtcattttattccaactcagggttcctcttgcacaccagttttcttggcatctcagagtccccttcctcctttcaaccaaggacctaacgctactctgcactttctggaccactataatggaacatgtgcaactccatgagaccatcttttggcctactcatcaagacattttcccaatcatcactcttccacagctcatttgctaaaatgcagcagtgcctccttgcactactacatattacagagcaagtgaagacactcacatttgacttcctggcctctttccttctctctcttggttcctctttgaaaagttttcctttccttcttgctagggttggaacatcatctatgtagtatcctctgatttgtattcaggaagacttacaatataacacctttgtgtgaatacatctgacttgtctctagatatttaaaaaggaactactgaaattaaaaacaaaactatacactataataacaagaacacaacaaaagtaagacgtcccctatcttgaagcctggctaagagaaagtatttttgcatgggactaaaaaatgtaaccattgtactcaaagcagaagaatgacatttttttttctaggtacctgcactgttcatgtctgtgcacaaaaacaaaacaaaacataacaaaaaaacccctcatggcttgtcctcaaaagggaaaatttacaagaaaacatgatttacaaaggggaattaaaatgcacagttttgcttcaaaatatctcaattttttcacctgttccaaaaattatccactttccctttgcctagccaaccctcagtctttgtagaggaattatgtcttcggggaattctttccagctttctttgattgtgtcaaattgttctgttacaggcccattcagaactcagaccctctccttcataccacttttcacatttgttagtagaattatgtggtggtaaatttctgccttttccactagactgaaggtttcataagagcaaagacctattgatttttgctacttaatgtattatcaccagtaccctggacagagcctgggagattgtatattctcaaaaaacactgtaaaaccctattacaatgtatcccattaataatgagaatgaatatataattccgttgacaattcctgtcctatgtttagtccttttctcatagtgaggggaggggagttaaagggagtggaggctaaagtggaggatgtggtggggtgaatgaagttagagggttaaatccttcctaatcctgccttgagaagcagagggtgggttcctgtatatcatggcctgcatatgttcctgtatatcattcttgcatcaagctgatgaaacaagtgccagttcactgttcctggtatcactgatggaaccctggaagtatcaatcaatataggacccagaaacatttccatcaatagctaagctttagtttgaagtgccaccttgctaaaccatagttaggacataaatagatgcagattcagcaacaggacttctggaattcttggcaatcttgctaggcaatttattaccccaatcattttagaacctcgcaataatatgactatgtattttgcatgatctgattgtttagttttcactcaacacatcatagcaggatttttacatagttgttgaattgatgaaagactgcacaagagcggtgcaaattcaatggaaggacagagtggggttggttgtgaggcaaaggcatttgtggaagtgttaatgttttgcagtctctcatttcaaagatctatacagaggtatttccagtttattctggggagatatcttgattgtccacattaaattaaattcaaatattttcttatggctgcaaaatacaatgcagtgaaatatttgggtggaaataccaagtcaatggatctttcctccccatgatggcaaactttcaaataaaaccaattctactaataatggtaataataacagcagctaatcagacttgccaggctgattatcaggtaggcactgtaatgggcattttcatacatattacctgattcaattctaataacctgtgaagtaggaattatattccatttttataaggtggtagttgagatatacagaggttaagtgactttcccaatgttattaataatatagcacagttgaaattaagcaaaccttttatcatttagaaggtcaaatgcaaaagctctatttcgcatttaccttatttggttctagacatcaagaaatatacactatagacatgcccaaatctctaggacaagaagtatactattatcataattttgatgtatatttaaaaagagctggctactgaaaaaaaaaaactatagttaaatcttagtaggaaccacgtatatagatacataaaatctatttgaagttagttgtcttagtttgggttcccgtgaaagtatatcctgagtgaaaggctgatatatagttagtttatttaagaagtaatttcagggagaaagagtaattgatggggaagtgaaaaaggcaacaagaaaagccaaagatgcatttgttgttggttggttgtcattgatcatgccaggaacttctggggagcctgatgaaatgtggctacaaactgccacttggaggatgcaagggtgaaaggttatccattgagtcccatcctacattggtcaagagtggcccctatgcttccaggttgcacatgtctatggcaccggattcctgctggtgtcagagaatctctggagcagaaagagagaggtacttgatatagtccaaggcaaagcaagacactgttaagttatacctgtgagaagctgatctaagctgcagcagaaactagaataagagatagaactgagaagatatgaaatggcgcataagaagattctaatactgcggcactctttctttaagaatacatggtattaatatgtggattttggtaataataatgattagatatatattgatttttctaaaaatgatattaaaactgtgaaccaatttatttgaattaaaagtatcttttaggccatctaattttttccttattgtgttaccatagaaacagcatagctcactgtttttgagttccaatttttatgggttattcctgattttattattaaaaacatttcaaatccaggcattatttacttagtctttcatgtttacaaaatataaaacttctgattaatttttaaagagtgggttatctatttaattttatatgtctgtatctcttaaggaagagtgttcattaacagatacaaaagacaggctaaaatctgaacaaaagatattttagtattaaaaagtagcagaaaggttatcagtttccaattgttgatcagggtgctaattcaaatggaggtatctgcatatagtggaaagaacactggccatagagacagaaaacttgagttttactttctaagctttactattgatgagctgtatcatcttgactatgcagtttaaagcttctttgaatctcagttttctttatctggaaaaatgaagtaaaattacttgtatcacagcattgttgtgaggatttaaataagatgattgtgttaaagtgtatagtatagttacagtgcctggtccatataagtatgccataaatatggattaaatttaagtgtgaaatgtacacccatcactggttctgatctacacactgatcatatgtgctatcagattggaggcaattttttcaaaatcttatggttcttctcagggttgttttttcttatgttttgactcttttcttggatgttgctggtttaaaaagatctctgatggctctcattaggtaggaccctcctcacctcttttgaagtataagttaatcaatatctctaactttctggaaagacaagaatttcacaacactttaatcctaaagacaatgttcttggttgcaagcaacagaaactgatgatggttcattaaaggagaaaaggtccaggctgttaggtagctcatagaaaagacgggaagtctaaaggattagaaaataagcagcaaccaaaggaggctgaatagccaaatgacaccaaaggaacactctggtggggactcactggacagctcctggcaccaccaccactgctggcaccacagctacaactgtctctggttagtggacagtggaatgaactctttttcatctcttccttcttttatgtcttatcatttccttttccttcttctttccttatccctaaatttttgttacacttgctcaagacttacaattccaaatatgaggctctccagttggctgaaacttatgttatgtaattgcttcctggttgctagagggtatttctggcctctgcaggggaaggtggactctactttccactgaaaatcaaactctggaaaattgtctgaacattcgaagaaggtcttgatgcttagcaggaaaaaaaagcttggcagttaaaaaaaaaaatcaccagtgtctgcagttttggatgcctcacatccaccaataccctttcccttctagttgtactgaaaaataataaatgtatccttttcaaaaattatttcagtagtttttggggaacacgtggtattttgttatatggataagttcattattggtgaattctgacattttggtgcatccatcatccgagcagtgtacactgaacccaatgtgtacttttttgtaatcaccaccctccacccttcccctgagtccccagagtccatttatcattcttacgcctttgtgtcctcatgtcttagctcccacatataaatgagaacatacaatgtttggttttacattcctcagttacttcacatagaataatggtctccaactccatccaggttactgtgaatgccattatttcattcctttttatgactgagtagtttccatggtgtggtgtgtgtgtgtgtgtgtgtgtgtgtgtgatctgtgtatatacacacacactacattttctttctttttttaaattttattattattatactttaagttttagggtacatgtgcacaacgtgcaggtttgttacatatgtatacatgtgccatgttggtgcgctgcacccactaactcgtcatctagcattaggtatatctcctaatgctatccctcccctctccccccaccccacaacagtccccgatgtgtgatgttccccttcctgtgtccatgtgttctcattgttcaattcccacctatgagtgagaacatgtggtgtttggttttttgtccttgtggtagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacatgtgcatatgtctttatagcagcatgatttataatcctttgggtacatacccagcaatgggatggctgggtcaaatggtatttccagttgtagatccctgaggaatcgccacactgacttccacaatggttgaactagtttacagtcccaccaacagtgtaaaagtgttcttatttctccacatcctctccagcacctgttgtttcctgactttttaatgattgccattctaactggtgtgagatggtatctcattgtggttttgatttacatttctctgatggccagtgatgatgagcattttttcatgtgtcttttggctgcataaatgtcttcttttgggaagtgtctgttcatatcctttgcccactttttgatggggttgtttgtttttttcttgtaaatttgtttgagttctttgtagattctggatattagccctttgtcagatgagtaggttgcaaaaattttctcccattttgtaggttgcctgttcactctgatggtagtttcttttgctgtgcagaagctcttgagtttaattagatcccatttgtcaattttggtttttgttgccattgcttttggtgttttagacatgaagtccttgcccaagcatatgtcctgaaaggtattgcctaggttttcttctagggtttttatggttttaggtctaacatgtaagtctttaatccaccttgaattaatgtttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattggtctgtatctctgttttggtaccagtaccatgctgttttggttactgtagccttgtagtatagtttgaagtcaggtagcgtgatgcctgcagctttgttcttttggcttaggattgacttgtcaatgcgggttcttttttggttccacatgaactttaaagtagttttttccaattctgtgaagaaagtcattggtagcttgatggggatggcattgaatctataaattaccttgggcagtatggccattttcatgatatcaattcttcctacccatgagcatggaatgttcttccatttgtttgtatcctcttttatttcattgagcagtggtttgtagttctcctcaaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatctgagactttgctgaagttgcttatgagcttaaggagattttgggctgagacgatggggttttctagatatacagtcatgtcgtctgcaaacagggacaatttgacttcctcttttcctaattgaataccctttatttccttctcctgcctaattgccctggccagaacttccaacactatgttgaataggagtggtgagagagggcctccctgtcttgtgccagttttcaaagggaatgcttccagtttttgtccattcagtatgatattggctgtgggtttgtcatagatagctcttattattttgagatatatcccatcaatacctaatttattgagaatatttagcatgaagggctgttgaattttgtcaaaggccttttctgcatctattgagataatcatgtgttttttgtctttggttctgtttatatgctggattaagttgattgatttgcatatgttgaaccagccttgcatcccagggatgaagcccacttgatcatggtggataagctttttgatgtgctgctggattcggtttgccagtattttattgagactttttgcatgaatgttcatcaaggacattggtctaaaattctctgtttttattgtgtctctgccaggctttggtatcaggatggtgctggcctcataaaatgagttagggaggattccctctttttctgttaattggaatagtttcagaaggaatggtaacagcccctccttgtacctctggtagaattcggctgtgaatccatctggtcctggactttttttggttggtaagctattaattattgcctcaatttcacatcctgttattggtctattcagagattcaacttcttcctggtttagtcttgggagggtgtatgtgtcgaggaatttatccatttcttctagattttctagtttatttgcatagaggtgtttatagtattctctgatggtagtttatatttctgtgtaatcgatggtgatatcccctttatcatttttttattgcgtctatttgattcttctctctttcttctgtattagtcttgctagcagtctatcaattttgttgatcttttcaaaaaaccagctcctggattcattaattttttgaagggttttttttgtctctatttccttcagttctgctctcatcttagttatttcttgccttctgctagcttttgaatgtatttgctcttgcttctctagttcttttaattgtgatattagggtgtcaattttagatctttcctgctttctcttgtgggcatttactgctataaatttccctctacacactgctttgaacgtgtcccagagattctggtatgttgagtcttttttcttattggtttcaaagaccatctttatttctgacttcatttcgttatgtacccagtagtcattcaggagcaggttgttcagtttccatgtagttgagctgttttgagtgagtttcttaatcctgagttctagtttgattgcactgtggtctgagagacagtttgttctaatttctgttcttttacatttgctgaggagtgctttacttccaactatgtggccaattttcaaataagtgtggtgtggtgctgaaaagattgtatattctgttgatttagggtggagagttctgtagatgtctcttaggtctgcttggtgcagagctgagttcaattcctgggtatccttgttaactttctgtctcgttgttctgtctaatgttgacagtgggttgttaaaagtctcccattattactgtgtaggattctaagtctctttgtaggtcactaaggacttgctttatgaatctgggtcctcctgtattgggtgcatatgtatttaggatagttagctcttcttgttgaattgatccctttagcgttatgtaatggccttctttgtctcttttagccttcttctctcaacttgtcaaagtcattctccatccagctttgttccattgctggtgagaagctgcattcctttggaggaggagaggtgctctgatttttagagtttctggtttttctgttctgttttttccccatctttgtggtttatctacctttggtctttgatgatggtgatgtacagatgggtgtttggtgtggatgtcctttctgtttgttagttttccttctaacagtcacgaccctcagctgcaggtctgttggattttgctggaggtccactccagaccctgtttgcctgggtatcagcagcagtggctgcagaacaacggatattggtgaaccgccaatgctgctgcctgattgttcctctgaaagttttgtctcagaggagtacctggccgtgtgaggtgtcagtccgcccgtacttgggggtgcctcccagttaggctactcaggtgtcagggacccacttgaggaggcagtctgcccgttctcagatctcaagctgtgtgctgggagaaccactactctcacaccacattttctttatccactcattggttgatgggcatttaggctggttccataattttgtaattgcaaattgtgctgctataaacatgtgtgtgcaagtgtctttttcatataattacttcttttcctctgtgcagataaccagtagtaggattgctgcatcaaatggtaattctacttttagttctttaaggagcctctacactgttttccatagtggttgtactagtttacattcccaccagcggtataaatgtgttcccttttcaccagatccatgccaacatttattattttttagttttcaattatggccgttcttgcaggagtaaggtggtatcacattgtggttttgacttgcatttcttaataattagtgatgttgagcatttttcacatgtttggtgaccatttgtttatcttcttttgataattgcctattcatgtccttagtgcactttttgatgggattattgtctttttcttgctgatttgtttgaattccttgtagattctagatattagttctttgttggatacatagtttgtgaagatgcatagtttgtgaagatttttctccccctctgtgggttgcctgtttactctgctgattatttcttttgctgtgcagaagctttttagtttaattaagttccatctatttatctttgactttttgcatttgcttttgggttcttggtcatgaactctatgcctaaaccaatgtttagaaggtatttatgatgttatattttagaatttttatgatttcaggtcttggattcaagtctttgatccatcttgagttgatttttgtataaagtgagagatgaggatccagtttcattcttctacatgtggcttgccatttatcccagcaccatttgttgaatagggggtcctttccccactttatctttttgttggctttgatgaagatcagtaggctgtaagtatttggctttatttctgggttctcttttctgttccattggtctatatgcttgtacttataacagtaccatgctgttttggtaacgatagccttgtagtatagtttgaacttggataatgtgatgcctccagatttgttctttttgcttagtcttgctttggctatgcagggccttttttggttccatacaaattttaggattattttttctagctctgtgaagaatgatgttggtattttgatgggcattgcattgactttatagattgcttttggcagtatggtcattttcacaatattgattctacccatccatgagcatgggatatgtttccatttgtttgtgtcacctataatttctttcagcagtgttttgtagtttaccttgtagagatctttcatttccttggttaggtacatttctgagtattttattttatttttttgcagctgttgtaaaaggggttgagttcttgatttgattctcagcttggtcgctgttggtgtgtagcagtgctactgatttgtgtacattgattttatattctgcaactttactgaattcatttatcctatctaggagctttttggaagagtctttagggttttctaagtatatgatctatacctagaaaacagcagcaaatcagcaaacagtagcagtttgaatcctctttactgatttggatgccctttacttctttctcttgtttgattgctctggctaggacttccagtactacgttgaatagaagtggtgaaagtgggcatccttgtcttgttccagttctcagggggaaagctttcaacttttccccattcagtataatgttggctgtgggtttgtcacagatggcttttattacagttaggtatgtcccttgtatgctgattttgcagagggttttaatcacaaagggatgctggattttgtgaaacgctttttcagagtctgttgagatgatcatatgacctttgttttaaattctgtttttgtggtgtatcatatttattgacttgagtatgttaaaccaaccctgcatccctggcatgaaacccacttgataatggtggattatctttttgataagctgttggattcgattagttagtattttgtcgaggatttttgcatctatgttcattagggatattggtctgtaggtttctttttttttttctgtgtcctttcctggttttggtattagggtaatactggattcatagaatgatttagggaggattccctctttctctgtcttttggaatagtttcattagtattggtaccaattctctgaatgtctgacagaattcagctgtgaatccatctggtcctggactttttttgttggcaatttttaaatccctccctccctccctctcttcctccttccctccctccctccctctcttcctccctccctcccttcctgtttgcttgcttcctttctatcttttgtgacagatgtgattctcctgtctcagcctcctgagtagctgggattataggcgcacaccaccacacctggataatttttgtagtcttagtagagacagagtttcaccatgttggccagacttgtctcgaactcctggcctcaagtgatccacccaccttggcttcccgaagtggtgagattataggcatgagccaccgcacccagccaagaaccatctttttgtttcatttatcttttgtacatttttttgtttcaatttcatttagttctgctctgatatttgttatttcttttcttcttctgggtttgggtttggtttgttctttttttctagttccttgaggtgtgagcttagattgtctatttgtgctctttcagagtttttgatgtaggcatttaatgctatgaactttcctcttatcactgcttttactgtatcccagaggtgttgacaggttgtgtcactattattgttcagttcaaagaatttttaaattttcatattgatttcattgttgatccaaagatcatttggaaccaagttatttaatttccatgtatctgtatagttttcagggttccttttggagttaattttcaatcttattccactgtggtctgagagaatacttgatataatttcaattttcttaaatttattgagacttgttttgtgacctatcatatggtctatcttggagaatgttccatgtgctgataaatagaatgtatattgtgcagttgttgggtagaatgttctgtaaatatctgttaagtccatttgttctagtgtatagtttaattccattgtttctttgttgactttctgtcttgataacttgtttagtgctgttagtcgagtattgaagtcccccactcttactgtattgccatctgtctcatttcttaggtcttgtagtaattgttttataaatttgggagatccagtgttaggtgcatgtatatttagaattgtgatattttcctgttggactaatctttttattattatataatgcccctctttattttttttaactgttgttgctttaaagtctgttttgtctgatataaataagaacagctactcctgcttacttttggtttccatttgcatggaatatctttttctaccactttaccttaagtttatgtgagcccatatgtgtgagctgaatctcttgaagacagcagatacttgtttgtgggattttttttttgaaatttatttatttatttatttatttattaattattattatactttaagttttagggtacatgtgcacattgtgcacgttagttacatatgtatacaggtgccatgctggtgtgctgcacccactaactcgtcatctagcattaggtatatctcccaatgccatccctcccccctccccccaacccacaacactccccagagtgtgatgttccccttcctgtgtccatgtgatatcattgttcaattcccacctatgagtgagaatatgcggtgtttggttttttgtccttgcgatagtttactgagaatgatgatttccaatttcatccatgtccctacaaaggacatgaagtcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttataaccctttgggtatatacccagtaatgggatggctgggtcaaatggtatttctagttctagatccctgaggaatcgccacactgacttccacaatggttgaactactttacagtcccactaacagtgtaaaagtgttcctatttctccacatcctctccagcacctgttgtttcctgactttttaatgatcgccattctaactggtgtgagatggtatctcattgtggttttgatttgcatttctctgatggctagtgatggtcagcattttttcatgtgttttttggctgcataaatgtcttcttttgagaagtgtctgttcacgtcctttgcccactttttgatggggttgtttgtttttttcttgtaaatttgagttcattgtaggttctggatattagccctttgtcagatgagtaggttgcgaaaattttctcccattttgtaggttgcctgttcactctgatggtagcttcttttgctgtgcagaagctctttagtttaattaggtcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattgatctacatctctgttttggtaccagtaacatgctgttttggttactgtagccttgtagtatagtttgaattcaggtagtgtgatgcctccagctttgttcttttggcttaggattgacttgtcaatgagggctctttttaggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgaacagcggtttgtagttctccttgaagaggtccttcacatcccttgtaagttggattcctaagtattttattctctttgaagcaattgtgaatgggagttcactcatgatttggctctctgtttgtctgttattggtgtataggaatgcttgtgatttttgcacattgattttgtatcctgagactttgctgaagttgcttatgagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaacaggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttaccatgaagggctgttgaattttgtcaaaggccttttctgcatctgttgagataatcatgtggtttttgtctttggttctgtttatatgctggattacatttactgatttgcatatattgaaccagccttgcatcccagggatgaagcccacttgatcatggtggataagctttttgatgtgctgctggattcggtttgccagtattttattgaggatttttgcatcaatgtttatcaaggatattggtctaaaattgtctttttttgttgtgtctctgcctggctttggtatcagaatgatgctggcctcataaaatgagttagggagtattccttctttttctattgattggaatagtttcagaaggaatggtaccagttcctccttgtacctctggtagaattaggctgtgaatccatctggtcttggactctttttggttggtaagctattcattattgccacactttcagatcctgttattggtttattcagagattcaccttcttcctggtttagtcttgggagagtgtatgtgtcaagaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttatttgtcttgctagcggtctatcaattttgttgatcctttcaaaaaaccagctcctggattcattaattttttgaagcgttttgtgtgtcactatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtatcccagagattctggtatgtcatgtctttgttctcgttggtttcaaagaacatctttatttctgccttcatttcgttatgtacgcagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtgtgtggtcaattttggaataggtgtggtgtggtgctgaaaaaaatgtatattctgttgatttggggtggagagttctgtagatgtctattacgtcctcttggtgcagagctgagttcaattcctgggtatccttgttgactttctgtctcattggtctgtctaatgttgacagtgtgatgttaaattctcccattattaatgtgtgggagtctaagtctctttgtaggtcactcaggacttgctttatgaatcagggtgctcctgtattgggtgcatatatatttaggatagttagctcttctttttgaattgatccctttaccattatgtaatggccttctttgtcccttttgatctttgttggtttaaagtctgttttatcagagagtaggattgcaactcctgccttttttagttttccatttgcttggtagatcttcctccatccttttattttgagccaatgtgtgtctctgcacatgagatgggtttcctgaatacagcacactgatgggtcttgactctttatccaatttgccagtgtgtgtcttttaattggagcatttagtccatttacatttgaagttaatagtgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcgggagctcttttagggcaggcctggtgttgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaaccagacctttctctctctggctgcccttaacattttttccttcatttcaactttggtgaatctgacaattatgtgtcttggagttgctcttctcgaggagtatctttgtggtgttctctgtatttcctgaatctgaatgttggcctgccttgctagattggggaaattctcctggataatatcctgcagagtgttttccaacttggttccattctccccatcactttcaggtacaccaatcagacatagatttggtcttttcacatagtcccatatttcttggaggctttgctcatttctttttattcttttttctctaaactttccttcttggttcatttcattcatttcatcttccattgctgataccctttcttccagttgattgcatcagctcctgaggcttctgcattcttcacgtagttctcgagccttggttttcagctccatcagctcctttaagcacttctctgtattggttatcctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggagctgcgttcctttggaggtggagaggcgctctgatttttagagtttccagtttttctgttctgttttttccccatctttgtggttttatctacttttggtctttgatgatggtgatgtacagatgggtttttggtgtggatgtcttttctgtttgttagttttccttctaacagacaggaccctcagctgcaggtctgttggagtaccctggagtgtgaggtgtcactgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtgtgcagaggttactgctgtctttttgtttgtctgtgccctgcccccagaggtggagcctacagaggcaggcaggcctccttgagctgtggtgggctccacccagttggagcttcttggctgctttgtttacctaagcaagcctgggcaatggtgggcgcccctcccccagcctcactgccgccttgcagtttgatctcagactgctgtgctagcaatcagcgagactccgtggagtaggaccctccgagccatgtgcgggatataatctcatggtgcgccgttttttaagcccgtcgcaaaagcgcagtattcgggtgggagtgacccgattttccaggtgccgttcgtcacccctttctttgactcggaaagggaactccctgaccccttgcgcttcccaagtgaggcaatgcctcgccctgcttcggctcgtgcacggtgcacgcacccactgacctgcgcccactgtctggcgctccctagtgaagtgaacccggtacctcagatggaaatgcagaaatcacccatattctgtgtcgctcacgctgggagctgtagaccggagctgttcctatttggccatctgggctcctcccttttgtgggattttatccgttctgccattctctattttttaagtggagcatttaggccatttacattcagtgttagtattgagatgtgaggtactgttctattcatcatgctgattgttgcttgaattcctttttttaactgtgttattgttttataggtcctgtgagatttgtgctttaaggcggttctattttggtgtatttcaggttttgttccaagatttagaactccttttagcattttttgtagtgcaagcttgttagtggtgaattctgtcagcatttgtttgtctgaaaaagactttatctctccttcgtttatgaagcttagttttgctggatacaaaattctaggctgataattattttgtttaagaaggctacagatccttttggcttgcaggatttctgctgagaaatctggtgttagtctgatagcttttcctttgtatgacaggttaccagatggttttacctcacaactcttaagattcttttcttcatcttaatattagataacctgttgactctgtgcctaggtgatgatctttttgtgatgaacttaccaggtgttccttgagcatcttatatttgaatatctggatctctagcaagaccagggaagttttcctcaattatttcctcaaatactttttccaaacttttagatttctcttcctcaggaatactaattattcttatgtttggtcatttaacataatcccaaatttcttggaggctttgtttattttttaaaaattctttttttctttacccttgtctgattgggttaactagaaagtcttatcttcaagctctgaagttctttcttctacttgttcgatttgattgctgaaacttcccagtgtattttgcatttctctaagtatgtctttcattttcagaagttgtgattgtcttttctttatgatgtctatttctctggagactttttcatccatatcctgtgttgttttttaggtttctttaagttgtttttcacctttctcttgtgcctccttgagtagcttaataatcgaccttctgaattctttatttggcaattcagagattttttcttggtttggattgctgcagtgctaatgtgatcttttgggggtgttaatagaaccttgttttgtcatattatcagaactgcttttctggttccttcttttttgggtagactgtttcagtggaaagatctggaactcaagggctgctgttcagattgttttgtcccatgaggtgatcctttggatgtggtactctcctgcttcccctagggatggggcttcttgaaagctggactgcagtgattgttattgcccttctgcatctagccacccagtggggctaactgggctcccgtctggtattggggaatgcctgcaaaaagtcctatgttgtgatccatctttaggtctcccagccatggataccagaacctgctctggtggaggtggcagaggtgtgttgtgaactctgtgggagtccttggttgcagttttttgcaaccaagtttttgaatggttgttatgctagcatgctagcagtaaaattgtcatgtggatggactcaggacctctggttagctagggtgttgccggcaatggaatcagttgttatttcctccttctttggagcatggttgtgagagacatgactagctggatttcctaggccaactaagaatccctaagcatagctgggaaggtgaccacatccacctttaaacatggggcttgcaacttagctcacacccgactaatcaggtagtaaagagagctcactaaaatgccaattaggcaaaaacaagacagccagtcatctatcgcctgagagcacagggggagggaaaatgattggcatataaacccaggcattcgagctggcaacagcaaccccctttgagtcccctcccatttatgggagctctgttttcactctattaaatcttgcaactgcacaatcaggctaaaggcttgccattgttcctgcatagctaagtgcccgggttcatccaaatcaagctgaacgctagtcgctgggttccacggttctcttctgtgacccacagcttctaatagagctataacactcaccacatgagccaagattccattccctggaatccgttaggccaagaaccccaggtcagagaacaagaggcttgctgccatcttggaagctgcccgccaccatcttgggagctctaagaacaaggaccccctggtaacagttgttctgttatgagttgctgtaatggcttgagttggtttgcctccagccaggaggtggtgttttcaagagagcaccagctgaggtagtaggaggggtatataatcttgccctacatttggcaggatgggtacttaggtttctcaggtgatgggtagggccatagagctctcaagagcttatgccttttgtcttcagctaccagagtgagtagagaaaaaccatcaggtgtgggcactgttaggcaggtctgagcttaggcttttcttggacggggcttgctgccaccactgtggggggtaggaggtggttcccaggccaatggagttttgttcccagggggattatggctgcctctgctgcatcatacaggtcaccagggaagtgggggaaagccagcagtgacaggccttacccagctccctcataaccggcaaggtcagtctcaatcctgccatgccccagcaaccatattgagtttatatccagtcagcctgcaatcagggcttagatcttgcccaaggctacaaccctccctgctgagaaaacaagcagggctctcaggcttcgcccctccctgcctgcccactgagcactccaatgtgcactatgagcttccttcaccctgtggcctctctctgattctgctggctgccttctcttccccaaggacctctgtcagataaggccaggaatggcttctttgccttcagtgggcacttaataaaatgatcatctaatttttttcctttaacctcagtgtggtgcattgcattgattgttaaatattaaacattactctcatgaaataaatccaattggtgtgatgcattatctcatatatatattaggggactaatgctcatttgcatatctttgcataagaaaaattggcctattttcttttcttttctcctatcattcttgtcaatatttggtatgcagtataatggtagcatcataaaatgagtggagtgtttcattttttcatagttgtaaaagattgggtttgttttcgttttctgaacatttggtgaaatctgctgataaaattacctggagctagagttttatttttagaaggattttaaactattgcttcaattaccttaattgtacaggactatccacgttttctgcttatttttgagcaaatgttgataagttctatttttctaggatattgctcatttcctccaaattttcagattttttggcagaaaattattcacatttttcttctcttttaaatatctgcagcatatgtagtaatgtctccttttttattcttttttatttttattttttgagatggagtcttgcttgttgcccaggctggagtgtggtggcatgatctcggctcacagcaacctctccttcctgagttcaagcaattctcccaccttagccttcagagtagtagctgggattacaggtgtgcattaccacatctggctaatttttgtatttttagtagagatggggtttcaccatgttggccaggctggtctcaaactcttgacctcaggtgatccacctgccttggcctcccaaagtgctgagattataggcgtgagccaccacatctggccaccatttttattctgatattatttgaggtctctctcatttttaattttgattagtgtcactggaattttgttaactaacattttcaaagtgcaaatatttgactgtgtcaatcttctgtattatatatttgttaaacattttattgattttgcctctatattattttcttctattaatacttcctttagacctattttattttatcaaaattcttaagctaagtagtaatttatttgtgtttaggttttcatattttctgttataaacatttgaggctttaagttttccttcaaatagatactctagctgcattttacagatttcaatataaaatatttttattttcttctagatacactttagtttcctttatgatttcttgattttgaattatttagaattgctttttgtaatatctaaatgtgtgtaagtgtgtatttgttattgatatctaccttaataccattgtggtcaaagaatgtgttgtaaataatttcaatcctgtcagatttcttgagaattgcttcattcattgattcatccattcaaaatatttattcagtatctacatgtgtcatgatctgttaaagacactgagaattcagcaatgaataaaatagagttcctgtccttgtagatcatattgggtgaagcagacaataaacaaacaagattattaaaataattgactatgttaatgacagaatactaagaaaaaatacaacggggagagggattttaaaatgtcttttaaattttttattttagaaggatgatgttaactgcccaaggggttcaccttgcctgctgcctcaacagagccaattcatcaagacaggggaattgcaatagagaaagagtaattcacgcagagctggctgtgtgggagactggagctttattattactcaaatcagtctccccagacattcagggagcagagtttttaaggataacttggtggatgaggggaagccagtgagccaggagtgctgattggttagggatgaaattatagtgagtcaaagctgtcttcttgcactgagtcatttcctgggagggggccacaagatcaaatgagacagtttattgatctgggtggtgccagctgatccatccatcctgtgcagggtctgcaaactatctcaagcactgatcttaggagcagtttagggagggtcagaatcttgtagcctctggctgcatgactcctaaaccataatttctaatcttgtggctaatgttagtcctacaaaggcaatctagtccccaggcaagaagaaggtctgctttgggaaagggctgttatcgtctttgtttaaactataaactaagtttctcccaaagttagttcagcctacgcccaggaatgaaaaaggacaggttggaggttagaagcaagatggagtaggttaagttagatctctttcactgtctccgtcataattttgcaaaggtggtttcaatggtcagttacgacttaggtgacacatgagaaaagatcttaagaagtgaaaggagagctatacaaaaacgtagggaaagaacaattttagtggtcctgaggcaaacatgttcctgcctattcaagaaacattgaggaggtcattatggtgacagcagaatgactaaggggaaaaacagaagatgtggtcagagagataatgggggactagatccagtagggtcttgtggtaatcagaataagggccccccacaaatgggattccccacttcctaatccccagaacctgtgaatatattacctcctatggcaaaggggaattaacgttgctgatggatgctgttcaactgatctggaaatgaggtcattctggattatctgtgtgggcccagtgtaatcacgaggatccttaaatgtggaaggaggtgagaagggcttggccagatgttgctggatttgaagatagaagaaggggaccatgagccaaggaaagtaggtgggctctagaatctgaaaaaggtaagaaaatgattctccccggaacctccagaaaggaacacagccttgtccacaccttgattttagtctactgagaatcattttagacttctgacctcaagaactataacacatttgtgttgttttacgccaccaagtttgtcgtaatttgttatagcagcaatagacaactaacacgggccctgtcatttacagtaaggactcatcctgagtgatacaggaagccattggaaggtcttggacagacctgatctgacttcatcggatcaccatggatgctgtgttgagaatggactgtagatggattccttcctttgtgcagcctttggctttagttttccatgttttattcattcaagattacaatggattcatttaagattataaaaatatataatctcacatttttaataaatcaaggtctctaacctgttttgttgctggaagtgaaagtctgaactgcactttaaattaaacttctatggaaaacacctcagaattggaaaatactgaggtaacttcctataccccaatataaaatcaagtgaattaatctgaagcatattacctttaatgaaaactggtaaagaaacttggcagaatatttgaaaattatattccttataaaaatgaaaatacaaaaatttttcaggtgacatacaaaatgctacttatgctattgcctttttcaagtcctaaaaaaacctagtggtattattttaaatttgctattagaattaattcagtagcatttcgttacaatgttccctgctcagagagtaactttacccaaaaataaattagggcttcaagaaaaagagctaacttttcccaaaatggatgaagatgggaaactttgacaatattcacaacagtgatagggattgggctatggggaggaggatggatattgctgtttagctccttgtaaatcctatctaggaatggttgacagaggagtgggaagaaacagatgtaagaaagacaacaagatatcaatatatctacgttatgagttaatccaaaatttgagagtgttgttttaaaatattaagtggtctatttatgtcaacatacaataaacacttgttggtttactttctttcttactgtaatgatgccactattttgtttcccattcctttattgtcattttagagcttttcttgacattttgcaaagggggagggggagggagaaaaattcctctaaaattttacttctaaaaggaccaaactgtgctctagactatatgctggctctaagcagctgggttaaaatatatacagaatgagttactggctcaagcaaggatcaaacaggtttttcctaactttaagaataatgttcttataaaacactccatagacaaatacagaccaaaacttaaatgcaattaacctttaatttatatatatgaatgaagagggatctgaggtattaaaaacttaaaatagctaattcaaaaataatttatacttggcattggaaatccttataattccctacatcatttttctttcttaattatgttcctcctaagctaataataaagttaattttccattcttgaatgcagattaactgattgtggaaagaagtggtccagcattttgatgggttgaggagagcctgcctaggattaaaatgtgaactttagcagttgacttattttcacgtcatcaatgtttttgagtcaaaggtgccatatagcagagtcttctaccaggattcctcatcctgatcattcccctctccacttctttcttggtaaggtagaccaactataactctctcagagatgagggtggggccaatctcatccaaattttatagcttctcaggtggtgtctgggtgtggtagtgatcatggtggggcagaggtgggataaatctttaggaggcaagtacagtgttaccctcagatagctttaagacacagtatcctcctgtgtgaagacagggtcatcatacatgccttacccatcccccctgggtttgctgtgaagattaaatcagataataggtgtgaaagcactttgaaatttgtaaagtgttacacaaatataacatattgtctctgtctttagtactcagaatacttaagggatttaaagaaatccttctgtggtcgtaaagcagattaggataaaagagctggtgaaactcatcattactaataaaaaattactcaaagtatatgtcaatggtattatctctatgaatttttttaaaaaccacactttttgtttcctgggagagtgtccttggaagcctctgtgtacagcacttggagcttctagtactcctgatctgctttcttctggtccaccatctaccatctgccctcatgcttctcagcagctggattgcctcctgaaatctgatcatcctcactctcccttcagaagccacacttttttttttctattgaaagggctcctttactgaactgtgagcattgtcctcttaatgactcagtagctcttgcctggcaaggcagaagtatccttaggtgacaaagaggcagaactctatctgcttatttatgatagcacagatatagcccatatgcaattggaacttatttggggtcaggggtcatttttttttttttggtttaaccttaaacctggtgccttacaaagtgtaggtacttggtaaatagttgttaaattgatgcgataaatatatcagataacttgctttatcagagctttaagctcagattattaggttatttaaaggatatttatttaaaggataaatattctgcctctatatttatatctgggattatggtgacatgaagagttgctctcagtagctcctatcacttgaccgcttccttgtttttcttcttatattgcttactcttataccctgcttaggactggattagactgcaggaatatgtacaagagagggtgagggattgaattggatggaaaaaagaaactctagtccttaccctggagtttaaaagaatgagaatgagcctcgtgatatcatagttggaaatttaaatttgttattaatatgaaaaactctactgtcatatcatttatttcttgccattagagatctggtagggaattctagcaagttggaagtagtgagcaaagttgaggcatctctacttcataatcaaaatttatcctttcaggatattcttgttaaaagttattaacatttcttaacatgtttcatttttttaaccttaaaaatataatatccacattttcaaaaagaagtacatccataactccaccatcttgatattttaattttacatatatcttccaatccttgtccaaatgtatgtttaaaaaatattttacatatttttcttctgtgcatattatttttgtttctgagtttccctgggaggattgtatttgccagatgagggctcaatttctgaatggctccgagaaccctaatttatgctgctgtagaaactgaccaaaatgggttggcatcccctgggcaggtatgtcctcaaatttagaaggctcagtttggaggctgaagcaggaagtgactatgagctgtacaataaagagcagagcccagtataagagaataaagataggttttacaagaaaagatgtaggtagatatttaagtaaaacaatttcagatgctaggaaagtctttctccccacccaacccaaacaaacaagaagcaaaaacaaaaaacccaactaaacaacgattacaataaatgtacataccccactagttaacatgtatacttaaggtcagtttaagaaagcactaacgtttaagctggaaaacttaaaatattagaagttgacataaggtttacaaaaggggcaagagaagatggcagtctctctgataggaatggggagttaggggcatggtccagcctctatccacttttcaaggaagaaaggtgaaaaggcatccaggaaacagcgcaaaaccaaaacactgtaaaattaggaattcctaattctgccagagtcaggttctttcagattatttaggttttataagagaggactgaaagtgaaaaagccaaatataaattatccgaaaactgcaacaggaaagactcttgcaggctcagaggaaggctgtggaaaagtcattgctagagctctccaggatgcatcaggccgacaccacctgtttgcggaggggtttagaccaagggaggggccctaactccggcgaggagggcgcccacccctcggttcccggagctggtggaggcgtgcgggggagcgggcggcgcggtgcacaggtggcgggggccgcgccagctgcgcgccgcgctctgctccgcgggtgggccgccaggcgtcgcgctggagccgcggttgccctggagaccaagcggggcgagtgggcggcgcggcgaggagccgagctgcggctggagtagcggggcgtgagttggggggagtggctccccggactgcgcgaggggtcggctagtcctggggcagggctgggtggcacggctggcgagcccggaacgcctctggtcacagctcagcgtccgcggagccgggcggcgctgcagctgcacttggctcgtctgtgggtctgacagtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtgagtagctccagccctttcttcccggtggggccaggccgggtcggcgggcccggggcgaagctgtttggggacggcaaagagcctccttgctttgccgagggtcgggagtccaactttctcaggggcggcgttcgttgctgcggccgaggctcgcgcgcacctgcagcggctgcttctgccgcccgcgcagcccaggtgttccttgtcagagaggtaactaaactcgtccggctacctccggtcccaggccgggccctgactctcacctcgctgcgctctgcggaatgcaggatcctttttagataacgaactcccttactcactggtccagttagaaactgtatttagaaccagttgtctttactaggcggccctaggaaaactagaagtgcttttaaaatcatttggaaaactttatagctttaacgtaaccttttagaagcctatacacgttttggccgaaaatgatctttattttaaaactaattgtatactgtgctatactacaatcgaaaacaagaatttatttacactctagcttcatctccaaaggacttaagttggctctcaacaatacatagaatataacaatattagaacaaaataaataaatgtctttaaatttcttgttaacggtttttaaaacatctgtttataaatttagcttttaatctctgcttaatctttcttacattttcggtgaatagccatcatattaatttagatcctgattttcatcctatgcagtgctgtttgtttttgtgtgtgcattctcctgtggaatccagttttctgtcccatttattgctgagatttactgagattttttttctgaaggatgttatttaaaaagcgggttcagtgattttggaactttgtggttaaccctgttttttttctggagacaccagcatgtttccagtcatttcatggccttattcgaactgattttgaagtaacctaatactagccaacttaacttgtgcagattcattgaataggggagaagagaatacgaaaactttttgtatgtcttctccgtagaaactaatgaagctgttatcatcaaaattaacttttctagagttcagtaggtatatttttagtgatgatgtgcacacaataacatcaatatgtccatgttatgaacttgtgcttccaagtatcttgtactgttactagtttgagatggccagtttttctctctgtcctactacttttaagtgtgaaataagagagtaaatcggctttttatgcaatccttggacacagctctaaatattaccaatattacaagaacagctcaaatttttggtagaacattctattattaaagttgtatattataataaatgctcctctttttgtaaatagcatttgtgtatagtttgtttttgaattattaggcagtactttaaaagagttgatacaattcgcagactcagccttgcaaggtcatctgatttgttcttttttcttcagcaaaactattcccaagccatagaaaaatgtttttaaagacttccaaggacttctcagttttggcaataacctgttatgtagaggcattttccactttcaaaaacagtgttcattgttcaacagatatttacagagccatcactctgtgcttttgagtatctggtggggaaaggtggtggtggaatacaaagacgcgtgtgagtgtctgcagcccgtaaggagtttgcatttttaaaacaggctgtaagcatgcacaaataatttatggtacagggaatgtatgatgagttctatttgttaatgtaagtatcaagtaagacttcttggaaaagtttactttttatctggacattgaatgaatagggtatgaattggctcagatgggagtggatgggctttcttaaccaaaggaacagcctgaaggaaggatgtaaagtggaacaggcaggggtatactcttgaaaggccaagctgctagagcaggagatgtgtgcaagggagaaagagccaaaaagtagttgggggcaagatagtagagaatcttgaatgctgcgtttgggctttattcggctggccatggaaaaagtactgatgttcagtttccttactgtggggcggggaagaggatgaacagttagcacgcctgtttgtgctagcatacctgtctccaggagaataccttgccctaaccgaatttaattcttgaactagtcaagggcaaacttggtttgaatgaattatggctcatccccagaattttcaatgtggaatagcaggaggggtgtatatctgaacaaagctggttccattacaaaggggtaaagggaaatggatgctaggtaaataaccaatagcagtggccactacaatgaaatgatacaccaaaggtagaaatagagggtcttttcaataaatgaaagaaaatcgatgttaataaatttctgtttctatttctgtttattctgttttcttattgttattttgtttttatttgtgaagtaacttcaaagggaatttgaattgaaaagctgacttctatatagttcttctaatgggttagatataactaaagtgtttctcatacttgtgattccttgaaatagcagataacttttcagaatttgagaaaatgtataaaaagaaagaaatgaccacataaaatgcaatgaaaatgaaaaaagtcatgaaccttttcagtgttaccattattaaaaatttattgtaaaatccaatttatcagctctaaatttcatactgtaattgttttagaaggattcacctgttagtaaaaatctgtagtttgacctacatgaaagatgacagctacgggatgaaaatttcagagatactaagcctaatacacatatatattcaacatggactattcaggaagcaatttaaatattaaattaccaagcacttaaaaagcgttatgcttagaactgttgtcagacacaaggtaatgatgcaaggggtaaaagtacttgttttggcttcccctccccaggtgacagtatgtggcagattttgaaatgtgttttcacactttcatagtggagagatttataatgaaaattctcatttgagtcttcatacttatgccatgtgatttagtgtcaaacaaggtgatgtgctggtgcaaaagattctttagttgcagtgagtaatacaaagcaagggacaggcagtacttactgagttgggagaaagttcagaaaattctggccttcccactaaaacttttcatccataactacttagttagtttgtttatttatttatttatttgagatggagtctggcttttgttgtccaggctggagtgcagtggcgccatcttggctcactgcaatccccgactcctgggttctagcagttctcctgcctcagcctcccgagtagccaggattacaggcgcataccaccacacttggctaatttttgtatttttagtagagacggggtttcaccacgttggccaggctggtctcaaactcctgacctcaagtgatttgctcaccccagtctcccaaagtgctgggattacaggcctgagccaccgtgcctggccccataactagtttatttagaatagggattccacatctattgttatctagactaatgacaattttttatactctctcaacactgaattattttaggcagtttggggagggtttgctgaatttctgttttctaatttacttcaagtgaacacagtcatctcaactttctttgtttggtgagggctagctggcactaacacatctcatccctgcattttgaaaactgcccccacaccatctggaggatctgaaatcttctcttgaccatactttgtgagcaactggcttaagagaggttgttggttcttgggtggtattcaaaaagccatctgatttgagctgagtttggtcttaaaagtggaaagttaattagtttacttattagttaagcctatcttactaaaccatggaaggattttttttctttctgttaacatttgggtaattaattttctgtgtacctggttttctgccacccaagaaaaagaccacagtagtagtttgcatttgtaatggttttaaattgcagaaatatgaagtaagccacagagagaaaattggtttccaatttgcaaataatagactcagccaatgatctaccgcatcatcattgcctttatcagatattatataggtacagtatgggtctgcctcactcatatattacagaaagaatcatattttgataagtataactaaaatttttatttagagtataggatgaaacccatacaaatttactgttgtggacaaagtgtattcaataaaaagttacttgaaaaagtctacttactggtttgttttcatttagcagttaactctgttgatcttgagagagatataagctgacagtattagaggacacttatatttagaaaaggattcctggaaagaagctgagatcctagaaggaccgagttcagaaaattcttataccatgtagagttccttgggaagatgttcagagaattaggtcaacgttagcagccactaatggtagtgtaccagggtttagggttggaataggtggttaaagtgtaatagatttgtgggattggaaagtcaatgccattttttcactgagggtaacaaatatgtaataatacaatatgactttgtgaatgtaactctaatatattggggccacttgtaggctggtcttaaaagaatcatcagttcaatatttttagaaatttaagtttaaatatttaccaaagtctattgaagatcccaacaatggaaacagaacagtgtcctaatttagagaacccctatactcacttttgcccaaagtttcactgttcacagcagtcacactcataaaaccactctcttctgtattccccttaatgattcttttttctttttacttgtcgtcctctcgttccactttggaagatgttacgttcctctgctagtaacatcaggttcttcaaaggtaataaatccagtcctggttctttccagttattcagctctacccatttcaaggattgatatttacaaaaaattaaccctggagccaaccaggcagacacagaaatcaccatagaagctgagcattggtggggtatgtgggagtgtgggcatagttatatgctaatattttccccttgtttaatgaagttaactgtataataaaattccctttctcctcctgtgcttgcccgctctctctctcgcattctctctctctctcgggtgtgtgtgtgtgtgtgtgtgtgtgtgtgtgtgtgtgtattcccaaaaggcagtaccatgtctaccgtgtgtgtgtgtgtgtgtgtgtgtgtgtgtgtgtgtattatccccaaaaggcagtaccatgtctaccatgctgggcactatagtaatgctcagtagatacttgtgaatgaaggtttactaatataggtggtacacctgagaagactgttgttttctttttttttcatattttaaactttttattttgaaatatagattcatgggaggttgtaaagaaatgtacagagtggtcccatgcacacccttcactcagcctcccctgacgttaccatccccaaaaaccagaatacaaaataaaaaccaggaaattggtgttggtacaatccacagagcttattcagatttctctagctttaagtgcattttcttttttaaagaaaaataaaatttttgttaaaaatttctttagggatttggtgtgactatgtcagcttcaactaatctttacaccttggtaaatattttgtggaacaggtgatagagatcaattttcatagtttttttttcaaattttataacttctgtggaagtttattcaaaattttaatccttacagatcttttgaaattgatttttagcttatgtttaatcctaaatatttgaaatattttttcctaaggaattctgaagcctttgcttcatgttgtaaggaatgatcttggacttttggcaatttctgtagaaccttgaagtttaccattttcatgtctggtattcttagtcctgagggacctgtatgttagaactagtctcccaagaagagagataattacttaaaataacatcttttgtagcctgaggcctccctctttttccctacattactatatacaaagtactggagacacttttctagaaataggagcattaactataaatcatccttatgttgggggagtttggcaagactggcagttgtctgcttctcctattcccttctctcctcctgaagtctatgtatttccattcatagtttatcccagccatgatttatacccttatggaccacactctcagtctgcagtatttatacatctctcaaaatatcaaaagtcatttactaatcataaatcctccactatatgcttaaagatggcttaaataacatcaaacatcaaggcttaatacttagtcttttttttctttgggccaggttcatgactatcaggtatacaacttctgttagctcccatgggtcaagatcattagccagaacacagaatacatggcaaaaacagaggctgcagtactgtagtaagcatcacttcttgcaggacatattcaaatcagactaacattttaggcttttattggttaagtacacttatgtacttatttattggtacagttcacttatgtatattgcccatgtgtaaatatagatagccttgttgatcaagacttgacagtatgcagggcatgtgaaaaattggttaacagtgtactgcaaagattcttaaacttcctggccttaaagattattggggctttaaagattattgaggactgcaaagagctttagtttatgtggtttatgtctattgatactgtattagaaattaaaagtgagaaaatttaaaagaatctattaatctgtttagaaacaaagcatccattacacattgacataaatgtttttatgacaagtaacatattttttccccaaagctgaataatattagtgagagaagtggcactttcacatttttgggaccttctttaatgtctggcttattagaagccagtctcctgtctgctttctcctgtctgctttcgcatctcatttattgtgatatcccatcttggtttggtgtaaaatgtgaagaatatctggtctcacactgatatatagtattttgacagcattttcagataattttggatattcatctttggtattctaccaaaacatgatatgcagtagtttcttaaagactggctgaaatgtggaaccagaaaccatatcagtgaacatttcctacttgttatattaaaatccactggtttatcttgtactttgagtggatcttttactcatgcatgagttttcataaatctatgcattgatcattggaaaatactggttctctttgttacacagatcttacaaatgttactgtattacattatataaatttaaaaattatgtttatcaatatgaccactgagatgatcagaacagtcttttaagtattatgaagctgctaagctcacaatgtcagatacaagttttccaaaattttgatattgcttgaattttatcattggccgcaaatgactgtcagttatttcacttgaagtgatgatctcattttgtacagttttgagaaaatgtctgctaaatatataagtttgaataaccatagtctgtgagttgttcattcaagtagatatgaaggaaagtgattagttccttcagccttgagctcaaataattgcaccaatgccttactttgggatgaccattttgcttcagtatgcagcataagtggttttatactacccattttgtcacacagaatattacaaaaggtcaagatttaatgaaattattgttattgcttcatcaaagacattctttaatgaaactggattttttttttaactgtgactacataatggcgaagactacagtgactactagtacagtcttaatgtcaaagccttgacctgtgttaaggtgccaacagtttcacccactactgcttttgtaccatcaatgcacatgttaacccagggaaaaaggcataaaactctactgttagtaagaaaagtagtttttactacatagactttccgaaagggtcttgggaatctgcatcagtccatggactgtacttgaaatgctggtatccgtaatagaatgttagattctcttttttttgaaattgctgtagagacaactagccagacaataaatctgtgctatatggggtggcattaaatggaatatacatgtgttattttaaaataaaaaatgaactcatttgaaattctttattttgtattataatttaaaaacatctaaaagtaacatattctagggtaaaaactcaatgaagaagtatttaagaagatttttaagaagaatttttgtatttttagtagagacggggtttcaccatgttggtcaggctggtctcgaactcctgaccttgtgatccgcccacctcggcctcccaaagtgctgggattacaggcatgagccaccatgcccagcctaatataggcatcttaccacatctgttacatggatctacctcattctttttaatggaagtttagtatttcatagcaagtatgccataatttttagctgtttctccattatgcacatttgtgttttctctgattttttgatattcataatgttttagtgatcatctttgtacatataccctatacatttgtatagatatttctgtggtctagcttgcccaaagtgcaattgtttggatgtacacatttaacatccggggagagaaaaaaagcattgtcgtaattcaaacccagtatgtctgactatacaaagcccatgtcagagttcatgggctttgtatagtcaaacatactggctttaaattatgactcatcatttctttgtcctatgactttgagaatgttatttaatgtcctgagcttgagtttttcttgtgaaatggagatggccttcttactgtgttgagaagtactaaattaaatgaaaactgttatctgtaaagtgtctagcatagtgcctgacatacagcaagtgctcagttagtggcagttactgttacaaggattgatcagtcccaatttttaagtcaggagatgagtctatttagggtgtgccactggagctgtggcctagggcatatcatgtaattctccaggcctgctttcatttgcaaaatgagggaattagactaggtaatctcttgttcttttccagttctataatcttgtgattctttgacatggtttccagtattgaaaatattcgtagtaagataaagtggagaaattatgtggctggttttaacatgtttgtaaaacttttcctaaaatagttacttgactttcctctctctctccccctcccaatataataaaatgttatagtaatttctatcctcagaattaaaactatctccatctgttgtagaaagattacaaaatgtcattcgaatatagtcttatttttaaaatttattttaaaattgattgctacttactttgacttaggctgtgtacatacctattttttctcttcaatcctttgtatcacggacaaatcttgtatgtgtcaggaaggggtcagttcaaagcaggctgtaagtatgacaatatcttctttttacctcaatcactgtattctaatcctttaacttgatttttatgatctttctctgcttttctctgataatgagctttctttgtctaagccaagcatagttgtctaaattttaactatactaggttatgtgataaatatagacattttactagtgttattattgattaaaagggacaagcttgtgagcttaaaaaaaaagcaagttttaggcagggatatagtgatacttaaactgaaagctatggaggagtatggttagggcacatcttaattttgattttatatcgttgattatatcatcaatagtgttgcctagctgttctttttttgcattttcaagagagaggttgtttttgcacaaagccaggtggtctctaaaatggatagaattagttacattgacaaaacttaaataattctgagattcataaactcactgcctagtattttatcttggtaagtagaatctgttttcaggtcattaaatttttcctgaaacaacctaccgataagagatggttcttgaattttgtattccaacatattaatagtaaaagaaatttaaacatgattcattttcgtgagaatattttctgaaattgtgacttttgatgctttctaatttgtgatttcgttgtcctcagaacaggacaagttttagttgcttgttgattaatatgtgtattcattctcggtcttaacatttgcatttctttgaacaaattaattgtgctcttatcctcccaaccccttactcccaccacagttattttgaatttagggagttatctttctcattaataagaaagtataatgttgtgagctacagggagctggacaagtaaggtctcttagagccctttaattccataatgtccttgatctgatgaagctgctcggtaaatctcttcacaatttccatgaccaagccatctgcctgcattaaaataaatcaaatctgcttactccttcagtgtctaacaaatattctataaactgatgatgatgaagaccatgaacacaaaaataatttgcagtcttcagcacttccttttgagttctcagctcagattctcttgacatagtgggggtcggcatgttagctttttcttcgacttgagtggagagtagtgaagtccattctcctagtccttttcattgtatttatcccaactgtggcaagtgaactaattcatgttcatgtttaggttaaacttcacaaaactttactttttcttctacttcatgtatgttaattagacaaatgcacttagatgtatctaattttatatgtggcagtttacatatgtgtaaactgggtgtggggggtgcgtacatgtgcatatgtgtttttaaatctctggcaggctgattttgtatctggttcaggcttctgatattgtccagactttaggaactatgtcaattgtagcagcactatgctgtaaaagtgcatgatcccatagtccatttgtaggcaaaaatagttattttttttaacatcttgaaaagcattgaatttttggagttatttcatcttcgtgatcttcttactatcctttctttcctcaccacattttttttttttttttttttttttttttttttgagacggagtctcgctctgtcgcccaggctggagtgcagtggtgcgatcttggctcactgcaacctccgcctcccagattcaagcaattctccttgcctcagccttccgagtagctgggattacaggcatcagccacaacgcctggctgatttatgtatttttagtagagacagggtttcgccatgttggccaggctggtctcatactcctgacatcaggtgatcctcctgcctcaacctcccaaagtgcgggggttacaggcatgagccaccgtgctcagccaaagacatttttttttttctagttttggcctacaatgaataatgctgctgcaaatgttcttgtgtgtgtcttttgatgcatatcagaatgcatttctgttgggtatatccctatgaaacaaattgcatatatttaactttagtaggtatggcccattttctgaagtggctgtgctgatctttctcccactagcagtgtatgagagtttcatttcctttacatccttgtcagtgaacactaggtattgtcaatctattttattacttcagccattctgataggtgcataatggcatctcattgtgtctgtgtgtgtatgtatgtaggtgttttgtacttccctgattactaatgaggttacgcaccttttcccctttttactagcatttaggtattgtcttttacaaattttctattcaagtcatttgccagttcttaaaacaactttattgagatataattcacaaaccatatggttcacccgtttaaagtatacagtccaatcatttttggtattttacattattttaaaaattgtggtaaaatatatataacataacatttaccattttaaccattttaagtatatgatttggtggcattaagtacattcacagtgttgtgcagctatcaccgctatttccaacacttttacattaccctaaacaaaatctataactattaggcaatacctccccgtttccacttaacccctggtaacctctaatctacttcttatctctataaatttacctattccagatacctcatataagtagaattatacaaaatttatcctttgtgtctggcttatttcacttagcataatgttttttcaaggttcattcatgttgtagcatataccagaacttcatttctttttattgctgaataatttttcattgtatgagtataccacattttatatgctcctctgttgacggatacttgggcttcttgccagtttttaaaattaaggagtccatgtcccctcccactcccttggtttcagtgggtttaaaaaacatgtttgtggaagtactggcacattattgtttatatgtgttgtaaaatctcttactctatgacttgcttttttactttctcactttgatgtcttttaaagaacagaagttcttaattgattcatttaagcaatttttttctcttttactagcattttttgtgtcttgactataaattttttgcctttctcaatgtcataaagatatttcctggtatcttctgtaagctatactgttttacctttcatatttcaacctacagcccatctagaattcattgtcttgtgtgcaatgagagtcgggggtaaggacaaaaatttatttttttgtgatggctggcttatttatttttagcctttttaggtagataagatgtggtcttacactttgttatggtcttacactttgttttacctatagagtctagtacagtgcctacatatggtgagtgatcaataaactcttattaataaataagtcatgaagactcatctcccaaaagacacatatggtcccaaacagaattctatatatgaatgctatataagcattattttttcctccttttgttgtctttttcctcttcctctgttgtcaccatcatctttatcactgtcatatccttttacttcattaacataatcttcatcatctggagttgaggttaagttttttaatctcatgatactaatttttctattatatagtaatttgttttaaaataatcattttagttttaaatgactttttacattgttgaatcctttgcatcgtataaccactgcctacatttgtattgtataagggattttaacctgtggccaaaagatggtttttgggaggtcacagaaattttattccaaattcagtgtcatatgccttgatatttttcttttccctagggagagtgtctcgtcaacttttaaaaatatgttatttcattttctaacaaactgttgagaacctatgctatatacaccactgtgagttataaagagatgttcaatatgatatctggtcttaagtaactttatacttacataactacagttggaattataactgtagttacagtttggagatgtatgtgaatcagaaaataagtaattgtggaatacttactgtcaggattgtgtggggaagcagaagtatagatatatcatagttaaaatgtcatgtggaggaagatatagccagatagttaataaacttgtgtattgcctgcctggtatttatcccagccagtgaggcatggcacatttgattcttatgtattcaatagtttgtaaggagaaaaggaacaactgagggtttattatgcttcaggcgtctgaggatagaaggatgacaaatgtgtatgatccagtcttcaagtttagactaaactaacatgatttgctctaaaagacaaacataacttagctcattatggtgtaatgtgttacattcgtggagtgagtgaagtgttatttcctgctcaattctcattcttgttctcaccaagccatttgattttccctggtagtatgtgttctttggagtgtggttctttggagtctgtatgctgtgcagctgtgcatgagtgtgtaagagtgatgacatcgaggcagtggcagaaaacaggtggagtctgaggcagtgctcctggttactcaggacttcctgaagtgtatgagagacctagtagtgtctgtgtgtccttgtgaggggattgatagaggcctatgttataatgtagaggtctgtgcagggatttcaagatcagcatcttcctctgtttgggccgtagtaacacaatacaatagactaggtggcttataaacaacagaaatttatttctcacagttttagaggctggggagtctaagcctgcagatttagtgtctagcaagagcttgcttcctggcatatgaacagctatcttcttgtggtgtcctcacatggtggaaggggcaaagagctccctggggcttcttttataatggcataaatctcatttgtgagagctccaccatcacgacctaatcatctcccaaagactctgccttcagatatcaccactttgggtttcaggtttcaacataggaattttgtggggtatacaaacattcagtctatagcaatcagagacaaatggccagggtcacagtacaggggtgggaacctgcacacacccaccactgttcctgttcaataacagcaacaatggaaagaataccctcacggaggagcatttatattttactggttaccagtctggcctagtctgtcaagatattctccagcagaggcaggtaaagaaaccagagaacttggtgtggctataggggcaactctttccttctctggctgggggtaatttgagcactctctccttcatgcaggaagatactgtcttgaagtaaagcaggacaaggggaaagaaatctgaaagaccaagagtttctctgagctgttgaaaagagaaatctagaggtttcttaggctgtgcaaattcttggatctgcctgaaataactaaattcagtccaatctaatcatcttcctgacccctgccacccatctagtatgggagtgagttgggggtgtgtgtgagtgagaagtggtaagataagatcagtttgagagaaaatagactctgtttctttgcatatgcctatttattaacaaaggaatgtaaatgtacttattgctgtccttttgataaaatttgctgtggatgtatggctaatcccacagaatcaaggatccttatctggccagatgcaccaattttgacctctgtcctagtttttaacttaagctgatataccaacagggcagcaaatatataagcagttgcaagaactgcactgcaatggtttattgaatctcaataaatgatactttcttttaagaaaaccctctttattcgcttcatcacttgaagtgctttttaaaaatacttggatttggcaggctttttctgatactgaggtgctcacagtaaactgaatgtggttaaacagcttggaacactggagttgaatagtttctgggcacatgtgccaaaggatggcaagccaagtcatccagccttcagtgccagctctgatgagcttcagttctgctgctgccagcacttctgcatgcctctctgagtctcacacatttcttcttttagtgtcacaagtgtccagtctggatgtcaaattttcattaagggcatagctgtcattattgggtaaccaccatgtgccatgtattgcctagacattttatgtatgtttattcattaatcattaagcccgtgagatagatgagtattagtcctatttccaagtgaagaaatagatgtttcagttgtagagcagaatgaattccagtacctatagttaagagcctggaatattaagtaagataataggtaaacataatatgtaacatgtaaaaataataaagtgcctaatactgtgtcaggcttaagtgatcagtaagtggattacattttctcttataagctgtatttacctttgtggtgattttgtctgcattctagggcctaactagagaatttgggaaacatttataggagttatgagcaaatcttataacagacctttagaaccctaaacattagaaacttaagcactatgaagctccaaacagtaaactgtaaagtataggtgagcaggtaacacagttctgagttttttatcctcaagaggacttctctctctttctcactcatttacctctatctctgccttgctgatgccttatttatttgtttggtgtgcctattgagtaataaagcactagctatgagagtttacaattttaatttgtatcaaataaatgtgttatcaaattcaaaggggaattattaaaaatcctgttttagagattaccagtcaataagaaattgtgctcgactcttgggttagacagtgtaggtgataggaaagaggtataaaactcagttcttaccaacatggagaaaccccatctctactaaaaatacaaaattagttgggcatggtggcgcatacctgtaatcccaggtactagggaggctgaggcaggagaaccgcctgaacccaggaggcagaggttgcagtgagccgagatcacaccattgcactccagcctgggcaacaagagtgaaactctgtctcaaaaaaaaaaaaaaaaaaaaaaagtaaaacaaacaaaaaactcagttcttgcctccactgagtttataattttagaggagaaaagggaaaaaaaaattttgaatgcctaactagtctttcagtgtgcatcatataattaatttttaccacaacctggcattgttttcattttataaacaagaaaaatgatcagaaagattaaataagatcacatggctcaattcctttggtttccaaaactcatcttcctggtttaagaaacagagaagaggaaaatacagttacagttgggagctgcatgatgatgttttggttaacaatggaccacacatacaatgactgtggtcctataagattataacaccgtatattctctgtaccttttctgtgttaaatatgtttagatacacatatttaccatcatgttataattgcctactctattcagtacagtgatatgctctacaggtttgtagtgtagatgctccaccatatagttcagatgtgtagtaggctgtataccatctagttttgtgtaagtacactcaatgatgttcacacaatgatgaaatcaccaatgatacatttctcagaaggtatccctgtcattaagtgaaacgtgactgtatttcaccttccaatttcgcttactcttcttttttctgggcttggaaaataatgcttatgctttagtacccagcttggatatcacctcccaagtgaagttggccccatagttggcttttttttttttttttttgtcctgcgtccatttaactttgctcatgctttagcccatatctgtttactgtaatttatgtacttatctatttgtttaatcttcttcctttcttagccagtgcttaatacatgtttatttcataaacaatacatgataattgtattgtcaggttagaagtacaaccagagtcagacactttatggaacaggtaggaactataagtgagtcttgcaggatctgagtgggatttagactagcacagaggtggcctggtacacaagactggggagggaggagggtgggagataatgttagaaatagtcgtgtggaaaggagcgttgctagttcctgttaggaagtaacgtgggttaaatttggatgccacgtttatcatttcagctctttgaaaactgcccctaatgatatgtcttttcttttgtttcctcaaaattaattatcctttggtagctatggtaactcatttgaagctctgttatgcatataatctgtacacattgaactatttgcttcagcattctaaatattttcttgcatagtcaataatcctatatttacaatgttctcttccttctggtgaaaattggcttttcctcttagatttctaaagattttttttaaaagaattaggaatgacagcatgaataataaattaccataaatgaccatcatctttgtcattcatgttcatgctgttatttgctggaatcgacatatttctgggcagtttttactttgagaacctttgaacacatgccatatgccacctggcttccccagcttcccagctcccaggacccttacagcctcgctcctgggggctgccacacctctctcccttcttttctgtgccccacagcccagtgtgacaccctttgtgcctccttcctggctctggcccagccagttacacctttgtgtttgtggctgttcttttcccatgctgcctcttactcaatccctaaccttcctagctcagcctttctgcctggtctactcagactggctttctctttatgtcctccctcactctttcagatgagttttgcacctgcacccccattcagtggttagactagatggttcatgttttcttctggttggtcagagtattgtttaacctttgaatcgtttttctctcatggaaagtgggacaggtaatgcctacccgcaccaagtggctagactagatgaagtgatggacgtcaggcaccaggtgcttagtgaataggagtttctaacttttcctttcccccagctcttaacattataaaacagtttttttttttttagcatttattcatatttggtaaatatttatctagtgcctgctttgtgttaggctatgttctaggtactgaagatatagcagaggcaaaaatagactaaagacatttgtaacaacatctaaggcagcaaaaaatgagatagtactaaattgttttttctcaagttcctgcctcttaaaatgtttacttacctctaaaatagaggcatgtgaagaatagcatgatacagaaaaaatattatgttaggtacttaggtgtccttaagtcgtggtaaatataccttttaaagcttttataacctttcagtttagttcgtgtcctccaggtttataacggattccttagtgaagtgacagggttgtagtgggttggagggtctctgtctctgacacccctgcagttaattgcgttaaataaggtagatcttgcacaagcattgttttcatttctaaataaatgctaagagcagtaacgaaactttaataattttgtctgaaacaatcattggccaatgtttcctataccacagtgccttacagagggaaggtatttaggaaagatgtgtggacccagcaaatgcttatttccggagatagttttatacttccgttttgggggctttatcaacaattacatgtgatgtttgtttgcagtaataaacatcatcctagataatgtctgtctcttatttgtatacttcagaaaagtaaaattgttctgtttgaactgtttattttaaaaatacttccaagttgttttagtactgctaaaaagacatttagcatactgtatatgactcatacactttttagatacataaaaaggtgtataggtatttactgatttgcttctgaaggtttaatgttgataattccaagccagaaggtgaagatttcttccgcttacagtggcttccttgtgaaattttatgtagctgtcatacagccctggaattgtagatctggaagatactttcagtcttctgggttctcctctatactcaactctttcctcctgcttctatccttgcatgtcatttaataaaaaaatctagagaggtaaagtgatctttttaaaaccacacagcatgtaagtggcaaagtttaggccagaatccatgttgatgctccttccaataacatgagtgaaataataaaactaagcaatatttcagttactttttctgtcttattcaaactaattttaacttctttagggtcaaaaatcatctcttcttggggcctttctgtctctgtctttccatctcaataaaatactacacaagaaaaatgtgtatgtcccatgaatgtacacagatatatttatgcactatgtataaatagtatatgtgcttgtgtaattgtggcagggttgtttaggtacaatggggatgttgtgtgatagagtaaaatatgtattggatacattgcctgtagctacctttttatgcctctgtcatgccattgtattccagactgggtaagatgtaacagaagaaaatactcaaatttcatttcagaatctgcagcagctggagtgaacgtcaaacagatgggcttttccaccctgattatcctaacttcctaaatttagaaatacatgctttaaaaaaatgtaaattacccgagggggtggtgtagcacatgccaggcagtgctaacgagtgcaaatagatgtcatctgctgacttagatgaagctcagcttccactgctgggtttctgttatttcatcccctttagatttgttttatgttgctgcttttctttctgtaaaagtagtgtcaagcctcttttcacatatagattaatattgttttaaactttgagatgtatatcgtatctgaaaccaaaagtagtgtttaatcttattactcaagattccttcagactggtaaaataggttggaaagagagagacattgaatgagaaaactcttgtatcttatctttgccattaactagatgagtgaatttgggcaagacacacgttgtccactgtaaaatgggtggatgggactccatggtctctaacgtatcttttgttgttaagttacaaagttctttgtttttataaatgaatatgtgtctataaattcttttgtatcctgttgtgtcgccagaatctaccacagtgcctggcccacatttattagtcgatgtctaataaacattgtcaaaagaatcgatactgtttgccttatgttttcaattaccaaaattcattgggaaacttatttaggagctaagtgtcggccaccactagaagacattacttctctttgttacagttaagttgaggagaccaaaaagggatccagggacataaaaaagcaataaccaaacaagtgaggaggtttgtatatgcagattgcctttcattggagtgtgagttttgtgaggaatcacattttatacaaatgaatatgttgatagaaccacttttattccaaagttccaagaggaaattgcagaaaccagtctgagtccatcaccaaaggaagtcttgcaagatgaggggcagaagaagtgagcctagaaggatggacttgctgaacttctgtttatcctccaagatgtgattagtcttcatagaactccatagaagttcaggaagcaaggaggtaatggggaaaggagagggcatgggagagctagcctttctgggcaaagagaatgggtaagcagagttacagaggcataaaatagcctgggagccgcaagtagttctacatgactggagagtagggtagggtttaaggggagcagaggctggagatggggccagaaggataggcaagcaccagatatttggactttatccgttgagcagtgggaaggcttccaagggttttaaatagaggaataacttgcttaaacttgcttttttagcaatttgactttagcagcagtgtggaggatggattggaagtggaccggaggagatcagttgaggctgtcgtggttgttaaagatcatgtgagattcctcataagtgctagtaaattaaatttaagaaaagggatggattttcaatagatctttaaaacacttgttataatttctgtttcaaagcaaaaataaaagtggatgggggaaatgtatgaagggaaaaaatgttgatgggagttttatttaagagatgagaaatgtgaaaaactgagaggttactggtgttgtattgagaccgaattatagccatttgtatccattttctacttcttgtgttgatgagccagccagatcttagaaatctagattgcatggtaaagtggaaatttagtttcagtttactaaacagtatacctctgagcacaaactaagccacctttttttggagggttggtatataaattacaaatatgttgactaaaacctgtaaaattatagtttagaacttatttgggaagctcacgaaaggtttggaaataccataatgaataattctgagaatagcagacctttgtagtttttttctcctgaatttgccttgagagactaatcactgatagtttgccagtttctccatatttctcagaggtccccaagaatctctggcaatctcttgtctttaagggtattttttgggatattgagttgcctgtgtctcacttttcttttctatcttatgcttcctgggaatggacccttgcaacgccattcctcaacttgccaccagtaattctttctagtgctctcgcactcacgctctctctctctctctgtgtgtgtgtacactatattgctagaggaaagaatatatacctatatatatgtgtgtatacacacacacacacacacacacacagaacactatatagcatctgttgattgtctttttctttgagaatgaatcagattttcttagcctttttttagaggattaattttagattatatgttcaacattttgaatgctgtgttgtaagattctggtttctgttatcttgatccaaagtatgttgaatattttcctttgtaagcaggcatttaacatggttagactcaagctgcagcctctgttatgcctgcaatagatggtgactcagatctaatttcaggccgccttgagtctggcctgtacatatatggctccttggttagccagatacttatatagtatttctataaaattttgggttctccttctgtggccctcttctttccagggttcctctttctctctctggtagcctatgttgccttgggccctggtttcttctgacagaaggatggcagatttttctactggagtttcagcctccacatgctgtggccacagtaggtggtggctcttctcacagattatactaattttggtctgtcccatgcacatgtgcttcaggggtctaaaacttgggcagactttttatatagaatttgatgttctccttctcttggtctctcttttccatggttttccctcactatccgggggctctggtttctgagttccttctgttggttctacaggccatttagatgttttatttttttaatgggagcttagctgcccagcaccacgatcaccatggtcctcagggaaaagctgcaaaaccctgaaatttgccccacgccagtcacttccacagttgagacttccctcccaaacatggccggttttggtcacttgccagagccctcaggtaattgtttttcatatgttgtccaacgttgttatttgtggaaggattaatttgttagaagcttatccttccatatgaaacctgcaatgattttttcttcaagtgctttttatctcagtaacttctaagtaggaggaatgaattgaatgacttcttagttcatttttaactagtatgattccttgagtctaaaattacatttactgaagagagccagatgtcctgttttggctgccattcttgagtacacaggtatttagagaagcatccttggtgtttgctaacctgggaaggtatatcattcatggttctccagagaaaggaaaccattagatatatatagatatgtagaaagagatttattatgagggattggcttacacagcattggaagttgagagtcccatgatctactgttggtcagttggaggcccaagaaagtgagtagtgtagctccagtccagtgggcctggaggattgagaattgggagtttatgtctgagggcaagaaagagggaagtcccagctacagaagagagtttaattcacccttcctctgccttttgtttttatttcggccctaaatggcccactcacataaggaagagccatcttctttactcagcttaccaattaaaatgctaatctcttccagaaacaccctcagagatacacccagaaataatgtttacccactttccggatatcccttactctagttaagttgacacatacaattaaccgtcgctctcatcttttcctacttttctccttcttgtggtatttctattttttattccttttaaacaagacagtggagtgagaaggttgctggggaataccagctgaatttcagtaacctcatgtacactgctttgccagaaggagtcctgttccatgggtatactctgtggttcctgcagggaatcttctcagctctgcaataggagtctgacggaaaggaaaacaaattgacacttcacagcgccccagaaggaggccaataggatgactcttctctgcatgactttctctacttttttcatctgtctttccatctcttttcccttttttgtttattatgcttctactcattctgattattaattttattaaattcatattcaaaatatcaaaatatcttactcttagcaaataaaacatgattttatgttttaaattgtttaatctgtaatctaggtatagtataattcaaggtagatgtcaaggtagatgtcaaggtagatgttacgttccttatagtaccttgccttttcccaatttgtatggtagttgaaagtagcatgacaaaacaggaataaataaagcaaaaagcctatgaaatttcccaactacttaacaatcaaaataatcaggcgaaatgataaggaaaataatctttttatctgttaattcctgttgatcattgtattcgttctcacactgctattaagatactacctgaggctgggtaatttataaagaaagaaggtttatttgactgacagttccacattgcttgggaggcctcaggaaacttatagtcatggtggaaggtgagggaaaagcaagtaccttcttcacaaagcagcaggagagagagagaatgcaggggaaactgccacctttaaaactatcagatctcatgagaactccctcactatgagaacagcatgggggaaactgcccccatgatccaatcacctcccaccaggtccctcccttgacacgtggggattacaattctaggtaagatttgggtggagacacagccaaaccatatcaattatttataggttctttgtttttggtcttcattttgctcttttttttggtaacatggatgttgcaaagggctttatgcaagatgggaaagcttgggtaacagaatttcaaatgttttactctaagattattagttggcctctaaaatttagtctgaaagggtgaacattgaaggaaatagactaaagaatgtgtactttttcatgctcagatggtgtattaagattctccagagaaatttgtgtgtgtgtatgtgtgtgtgtatgtatgtataaataaatttattacaagtaataggcttctgtgtatatggaggctggcaagtccagtatctgcagaggcagtatcctagtttgactctgaaggctggaagctgcttatagaaccaggaagaagtgatgttgcagttggcaggagaattctctcttgcttttcggaggtcagtctttcattcttttcaggctttcacctgattggatggggcccacctgcacatggaagacaatctgctgtactcagtccaatgacttaaatgttaatctcattaaaaaacaccctcacagaaatgcccagaataatgtttgaccaaatatctgggtacctcatagcccagtcaagttggcacattaaccctcataggtgatgggcatgtttctttgtagaagagattataccctaattcaggaacactctgtggacttattcagaatcaccaaaaatgttgtggaggtgtataggggagaagatgtgaaaaattagcttttagcactgttgattgcttcctcctcctaaaaacttcctcctccttgtttccctgattctctttctacctctctgaatactccctaggtttctgtacaggatcttttaatatccagatttagactgtgtactatagtgcatggcagatagaggagtagagaaaaaattgactttcctgaaaagcttccacagtggaactttattatttggtttggagattttggaattcaaaaagtgcaaggaaggccatattccaaagacaattggaatgggttttggatgatctcttggtatattcccgttgacttctattttagacaaatgtggctttttcttttgtggagatttctgaaataatctggagtttttatttacgttttttttgttgttgttgttcatttcttaaccaagaaaagtctattcttctggatggaaggttgttgagatttcaaccctcaagagtcactataatattggtaaaaataatctctcataggtctcagcttccttgtctgtagaggggagtgaatggagtagattaacatggaagttgctttcacttttgagtcgatgattaggaggacattagggaactttgataaggctattttagtagaggatttgaagccgaagcatatattttctgagggaagaaggaggaggcaatggaagtgaactacatatttaggcagcttgactagaaaaaggaaagaaatatgataaaggaggaagcatgatcaagatacattcttcaaaatatcagaagatctttgcttttttgaaggcataaagcaagggaccaaagaaaagggaaaacttgaaatgtcgagttgtaggatgattgagcaaacaagatcttggtagaggttgggagatgggttaaagcaaggatggggcttaccctgctttctgtggtgttggagagaaggggaaaggataggtgaaaaagtggatactctgagatggttgggggagaattccttcaatttagtctaataaagataaaaaatgaggtgtttgccaaaggttggaagggtgtgataggagttcagtttaagaataatgaatctgggggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgagtgcgcgcaccgtgcgcgagccgaagcagggcgaggcattgcctcacctgggaagcgcaaggggtcagggagttctctttccgagtcaaagaaaggggtgacggacgcacctggaaaatcgggtcactcccacccgaatattgcgcttttcagaccggcttaaaaaacggcgcaccacgagactatatcccacacctggctcggagggtcctacgcccacggagtctcgctgattgctagcacagcagtctgagatcaaactgcaaggcggcagcgaggctgggggaggggcgcccaccattgcccaggcttgcttaggtaaacaaagcagccgggaagctccaactgggtggagcccaccacagctcaaggaggcctgcctgcctctgtaggctccacctctgggggcagggcacagacaaacaaaaagacagcagtaacctctgcacacttaaatgtccctgtctgacagctttgaagagagcagtggttctcccagcacgcagctggagatctgagaacgggcagactgcctcctcaagtgggtccctgacccctgaaccccgagcagcctaactgggaggcaccccccagcaggggcacagtgacacctcacactgcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaatgcagagcgcctctcctcctccaaaggagcgcagttcctcagcagcaacggaacaaagctggatggagaatgattttgacgagctgagagaagaaggcttcagacgatcaaattactctgagctacgggaggacattcaaaccaaaggcaaagaagtggaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaaagaagcgagaagggaagtttagagaaaaaagaataaaaagaaacgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccaacgttcagattcaggaaatacagagaacgccacaaagatactcctcgagaagaacaactccaagacacataattgtcagattcaccaaagttgaaatgaaggaaaaagtgttaagggcagccagagagaaaggtcgggttaccctcaaagggaagcccatcagactaacagcggatctctcggcagaaaccctacaagccagaagagagtgggggccgatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaaccggtaccagccgctgcaaaatcatgccaaaatgtaaagaccatcgagactaggaagaaactgcatcaactaacgagcaaaatcaccagctaacatcataatgacaggattaaattcacacataacactattaactttaaatgtaaatggactaaatgctccaattaaaagacacagactggcgagttggataaagagtcaagacccatcagtgtgctgtattcaggaaacccatctcacgtgcagagacacacataggctcaaaataaaagggtggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaacatatatgcacccaatacaggagcaccctgattcataaagcaagtcctgagtgacctacaaagagacttagactcccaaacattaataatgggagactttaacaccccactgtcaacattggacagatcaacgagacaggaagtcaacaaggatacccaggaattgaactcagctctgcaccaagcgcacctaatagacatctacagaactctccaccccaaatcaacagaatatacatttttttcagcaccacaccacacctattccaaaattgaccacatagttggaagtaaaactctcctcagcaaatgtgacagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagtaaacacattcaaaagctagcagaaggcaagaaataactaaaatcagagcagaactgaaggaaatagtgacacacaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggtatcaccaccgatcccacagaaatacaaactaccatcagagaatactacaaacacctctacacaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaacctattccaatcaataaaaaaagagggaatcctccctaactcattttatgaggccaacatcattctgataccaaagccgggcagagacacaaccaaaaaagagaatattagaccaatatccttgatgaatatcgatgcaaaaatcctcaataaaatactggcaaactgaatccagcagcacatcaaaaagcttatccaccatgatcaagtgggcttcatccctgggatgcaaggctggttcaatatacgcaaatcaataaatgtaatccagcatataaagagagccaaagacaaaaaccacatgattatctcaatagatgcagaaaaagcctttgacaaaattcaacaacccttcatgctaaaaactctcaataaattaagtattgatgggacatatttcaaaataataagagctatctataacaaacccacagccaatatcatactgaatgggcaaaaactggaagcattccctttgaaaacagggatgccctctcttaccgctcctattcaacatagtgttggaagttctggccagggcaatcaggcaggagaaggaaataaaaggtattcaattaggaaaagaggaagtcaaattgtccctgtttgcagacgacatgattgtttatctggaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctctttgaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgagaaaaacaagcaatggggaaaggattccctatttaataaatggtgctgggaaaactggctagccatatgtagaaagctgaaactggatcccttccttacaccttatagaaaaatcaattcaagatggattaaagatttaaatgttagacctaaaaccataaaaaccctagaagaaaacctaggcattaccattcaggacataggcgtgggcaaggacttcatgtccaaaacaccaaaagcaatggcaacaaaagccaaaattgacaaatgggacctaattaaactaaagagcttctgcacagcaaaagaaagtaccatcagagtgaacaggcaacctacaacatgggagaaaattttcacaacctactcatctgacaaagggctaatatccagaatctacaaagaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagttaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacttatgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaactggaaaccatcattctcagtaaactatcacaagaacaaaaaaccaaacactgcatattctcactcatagatgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaaaaaagaaaacctggggccagaaaaaaacaaaaactaaagcaaaaaacaaatatcttttgagttaccactgcgtgccaggttctgttctgggctcaggaagtacactagaagccaagcaaaaagaagttccctgcccatgtggaatttacattctattggcaaaagacagaaaataaatataagtaagtaaattatataaaatattagaggacggcaagtactatgaaaaaaattaaaacagaaagaaatatggagaggaaagggattattataatttaacataacatgacaagggtaggcttaaatgactaagtgccaattgaaggatataggcgaattgaaggatgcagccatgcagacatctaggggaaggacatttcagacagagagacagccagtacaaaggtcctgaggtggaagcatgcttggcatgattgaagaacagcaaaaacactgctggagaaacagtcagaataggcaaggaatattatagaaaatatggttgctgggcaatgaaagagcagacagcacagaaccttgtgaggattttggcttttactttgggtgaaacaaagggccattgaagagattacaaccgagtgatatgatctaaagctagatttgaacagaggcactctggctaatatattaggattcaacttcaaggggacaggaagatgagttaagagtgacctgtttgcccagaataattttgggcaatgtgtttcaatgcaattgttaatgcccttctccctttgagtcttcaaaattatcatcctgattaagaggacacactactggaataattcagatgagaaatgatgatggtatgacacagattaataatgatgaaagagaagtggtttgattcaaaatatatttggatgggagaacctacaggatttcttggtggatctgatgcatgccatacgaaaaaaaaaaaagaatagtcaaggatgactaagatatttgggtcctagcaactggaaggacagagttgccattaaatacgatagaatagactttgcagaagtcccagagtctcatttgaggcgtgcaaactctgagcaatctcttagatttcccagaagggtgtcaattaggcagttggaaatatgactggagttccaaagggagatctggcctggaggtataagtttgtgaatcaagagtgcacagatggaattaaaagctataagattagaaagaatcatcaaataatatgagtgtggaaagaggagaggtccaaggacagagtcctaaagagcctagatggtagaaaaagagtagaatccagcaaaggagattgagaagagcagccagagaggtaggaggacaaccaggcatttcttcatatttacaataaatgggttgcactacaccaccaaaaaaaaaaaaaaaaaaaaaagaataatgaatctttggaagagcttttaaagccaatctgtcaggaacttagtgagggatgaatagtgggagtatctatttgaatttagatggttaattgagaagccaaccatttttgttcatcttgttttacattgttgatttttgttttccaacaactctgggtgtcggttgctggtactctagtcatcttgctttgttctcaacttttttggacccaagaccttatttctgaagaatgctctatgaattattttttaaaaagcattctgtcattttgggtctataaaagataacgtgaataagatatggattttaaatggatattgtattattaagtagtgttatgaagtttattttaatatatgatttaatatagcattatgaatgaagagacattttgacttttcatttaacaagtgacatacagtgcaatgagaaaaattgaatattttcaaaattttttgctcagtcacttacaaggatatgtcaagaaccttatgtttgctgcctttttcctgtagtcctgaagagtgaaggaacccattgttgttgctgtttcaaccattgatggaacatctgaagggtttgggatgaaattaactctagaattttatatgtcatattactcaatggagtacatagtgagaagttttaagagaagacataattatagcagtttctttccacattggttttatctgtgtaattatatataacctagtcattgagcaatatgttttcgaaagtattcatttcttttcaagtactcttatacatggttcactttttaaaaatgttatttattttgaccatttctttcttagctaatatatttatatggctcaaatttcaaaaaaagtaagatatttattagtaagtttttctcatatcctggccccattcactcgatttgtttccccacagggcattagtattgtcagattttttttttaaagtataattctagagttatattacccatatacagtctaatatatttacatattccccagtgcacccccatttcctacacaagtagtagcacagttatacccatttccttattattaaaaaattttttcataacatttcattgtatggatgtaacataacttgcaccctgtattgatgaatacttagatggtttccactgttttactattataaacaatgccaaaatgaataactttgtacatactgttttacaatgtaaaggttgcttaatttaaccgcataaaatagataccatttgtcaacttttaaaatcacatgcttttgggaatgagcgtagattaaagggcaaattgaaatttaaggttatattgaggcatcaaaaataaataaaaaccttagtctgtcacccagcagttgaaagtcttgtattttctccttatttataaaaaatagttttggggctttcttttaaaatacagtaaaatatgacatatttgaaattgctatttgcaaactttttttttttttgcaaataatactttgtgggtgcagataatacttattcaccataaatgaaagaagtcagtttgatgttatgtttgctgcgttttcattttttcttttttttcccccccaatggattttgaagtattggagacatttttaagtcttaagaaatttgatcagataatgcaatatacagagctggtaaaagtcatcttgagttgaagtttcaggatttaacatttatgttccttattgacttcaacaattctaatatttcttgtatttaaccagtagtcctttatagatataaaacaattgatttaaaaccaagtgtaaatcagtgtaaaaccttaggattgacaaagttaccaggctgtcacctctgatcacctgaataataaaccaaacaattaggtcataagccaactcatctgacacttactgttgtacacattccctggatatgtaggcagaggttctcagaagctctgttttaaaagaaaatatattattattttatatattgacttaaaaatcaaaatagaagcgccattaccagcttactaaacttgaagtgtttgtatacagtagttaaacactgatgttggcagaaattaaggaggaaaagggatattggatattataatcagtgtctcttacatgtgtctttggaaaagtaatggttacttattagaaacctggaagttcttagcatttgccatgaacagtacattatattaaatatttttgtgtagtactgtaggaaatctgcaataaattacaattttattattgtttgaaagtcctcataacagtaacgtcctaagacagctatctagggtcagtagaagagaggaatgaaggtaacttttgcatatgttctctaaactgttaattttacccagactgagcaattgcctggtatagttgtcagaatacaggcttctaggcaccaccctagatgtgctgtctgagagtcaggtaagattcatgattaactaatagagaagtcatttggaaattggtgaggacatcagggagccgggggaggggggtggtgtggctgggggggggcagcagaggtgttgtgaaaatagtttgaagaaagtgagcaaatcacaggctttgctgccaaatggcttctgtaaagattccaccacaaatctagtgctaggtcactggtttctgtggtccttgaaatgctgacctagacctgacccagtgctgcagaattccagattagagagacactttaatctttctaagaagctgagcttgcttcaagctttgttaacttagtttatgattatctaaaatagtcttagtcctgtttaccgtagataactctacttatttagtcctgaaatagtgatgccaaatgtcagtttggattcaggcttctactactgtttagccctgaaatagtgaggccaaatgtcagtttggattcaggatcctattactgtttagtcctgaaatagtgaggccaaatgtcagtttggattcaggctcctactaccagttgccatagggtcaccccttgcacatcccatagacacctcaaatccaagaatcctgaaataaaactcatcatcttactctaggcctgatcctttcttttttgttcttttaaaaaatatttattgtctacagtgtattaggcactgagtgtcccaagatgaataaaacaagacatgttctcggccaggcgcggtggctcacgcctgtaatcccagcactttgggaggccgaggcaggcggatcacaaggtcaggagatcgagatcaccctggcttacacggtgaaaccccgtctctactaaaaatacaaaaaattagccaggcattgtggcaagcacctgtggtcccagctgctcaggaggctgaggcaggagaatgtcgtgaacccgggaggcagaggttgcagtgagccgagatcgcaccactgcactccagcctaggtgacagagcgagactcaaaaaaaacaaaaacaaaaacaaaaaaaaaacaagacatgttctttgtctttaaagtgcaatgggaatccacggaagggttttatggtttataaagctcattgttgtgtgtagaatggtttggagtgagtcaaggatagtagcaaggaaactggattaagaggctgttgtagaaatcaaggtataagatgatggtggcatggaagtagcgtggtagcagtggtgatggaagtggtggataaatgaaacaaattttgaaattagaatcagtgacacttggtgatggacttaatgtatggaatgtgtgggagtagctaccagaggtgattctgaggcttctgtctcaagcaccagcataatctggtgccatgtactgagatatgaaactgctaacactgctaacactaacaggtttgacaaggggcaagagagttcaattttgggaattactaagtttgaagtatctttagataagccaagtatccctgtccattttatcaaccgagtcatttcccttcacctaaaccataacctgcttgctgtccatgcgtggtggctcacgcctgtaatcccagcactttgggaggctgaggcaggtggattacctgagatcaggagtttgagagcagcttggctaatatggtgaaactctgtctctactaaaaatacaaaaaattagccaggtgcagtggctcacgcctgtcatcccagcgctttgggaggccgaggcgggcggatcacgaggtcagatcgagaccatcctggctaacacagtgaaaccctgtctactaaaaataaaaaaaaattagcggggcgtggtggcgggcacctgtagtcccagctactcaggaggctgaggcaggagaatcgcttgaacccaggaggtggaggtttcagtgagctgagatcatgccattgcactccagcttgggcaacagagcgagactctgtctcaaaaataaataaataaataaataaacaagcaaaccataagcccggaagtcatccttgattctgtcttcattcttatgctacatctagtcagtcttgaaattctgtcagttgtttttgtttggagctttctggactctcttttcttctttgttgttttaggtactgatcattttatcctggactattaaactagcttcttaattaatctccagtcttccgttattattaatacctctctttagttcaaaaatttccacaccatcttctgctgagctgtcagggttcttcagttgtgggggctaaacggtgatcattgcctgtacagggctccaggccttccagtgtttcaaccagaagtgatttgctttttgctttctttcgtctcgggttactatgtaacattgcatttgaaagcacatgaaaagtgattacttaggtgaataaaacctggagaacccttgttctagtgaatcgtcattctgcaaatgattggctagggtgatatttctaaaataaatctgataatttcattcacctgcttaaaacccttcaaagcctcactgttgccttaggagaaggtttgaaatttgtagcatatgcatagtctagcttaattccccaaactcatcttctgacattttttgcatgacgcttaattttgtttccaaatttctttcagcccttcaagccgcttttctattacataaccccttttcattgccttgactgtggcctgctttccttcctccacgttcttccctgtaccattcctctcctgtctaccaatcctttaaagccctgctcaggtattcttactcctgtgaaacctgtgtgggtcatactgagataaaattaactactcccttctctgtaatatttctctgccgccatgcttattcctgtagtttgcacatggtatactgaactggaaccatgggcatatgtatctgtcttagacttaacaagcagtgaactccttgggtattaggcccactattttcctcttctcgtctcatctcttctctcttgacaaggtctaggctggagtgcagtggtgcgatcttgaatcactgcaggctcaacctcccaggcttaagtgatcctcccatctcagcctcctgagtagctgggactatagttgtgtgccaccacacctggctaattttgtttatttctggtagagatgaggacttactatgttgccccagctggtctcaaactcctgggctcaagggattctcctgcctcagccacccaaagtgctagggttacaggcatgagccactgtgcccagccccactatttcttttgtctttgtattctagaggtagtccttagccaattatgggcctcaatcaatgtttactgaagtaaatggaaccaaaattggcagtaggtgctgctaggcttcggtaattcttaggaattcataatgtttaggatgtatacattgagttctctggtgcccccagagccagcccaactctagattaatgcttgagatatagacacaggttgataggagaataattgctctacttcatatgtgcctttccccatcagatatcaggtagcttgagggactgctttcagaagtgtgaaaaggtttgcagtttggcacaatgcaaaactattttattgacatataattcatataccacaacatttaccaatgtacagtgtacaatttgattgtttgcagtatgtttaaaaaatttatgcagcgagtaccattatctaatttgagaacatttccatcactctccagaaagaaaacttgtacccattagtattcacttcccacacccttgcaccctctctcagtccttggaaacctctaatctagtttctatctatatagacttgccttttctgaacatttcttatcaatgtagtcatgccacatgtggtcttttgtgactggcttctttcactttatataatgttttcaaggttcatccatgttttagcgtttatcactactttattgctttttattgctgaataatattacatgtatggatatataactttttattttttcattcatcagttgatggacatttgggttgttgctactttttggctatcatgctgtgaacacatattctataaatataggtaaaagtttttatgtgatatgtttttatttatcttgcatatataactaaaggtggaattgcttagtaattacagaattggcaactctgtttaatcgccaaactgttttccaaagtgactgcactcttttacattctccacagaattgtctgaaagctccagtttctccatatccttgttaacacttgttattgtcttttaattgtagccattctaatggatttgaaatagtatcttgtagttttgcatttttataatgattaatgatactggacatcatttcatgtctttgcctatttatttacttacttatttacttacttcattgggatcttgctctgttgcccaggctggagtgcagtggcaccatcaaagctcactgcatccttgaactcttgggctcaaatgatcctcccacatcagcctactgtgagtagctgggactacaggtatgtgccaccatgcccagctaatttttaaattttttgtagagacagggtcttgctattttccctaggctggtcttgaactcttggcttcaagcaattctcctgccttggcctcccaaggtgctggtattctagatgtgatgcacctgacctttatttgtatttttgttgctgaattttaagattatttatgctggatacaaatcccttgtgtatgacttccattctgttggctctcttttcactttttcggtagtgtcacatttggaacaccaaaattcttaattttcataaagttgaacctcaatttttttcttttatcacttgtgcttttgacattatatctaggaaataagtgctttaactccagtgaaatttcttttgcctatttccttgacatttgtgtttttcaacaccaaggtagccatggaataattgtaacttaattaagggcctgcaaacttctatagtcgcaggatcagattcataaaaccagatccataagtcagataggccataattgtgtgtgtgcttggggattggagtgaggttggtgattatgtgccctgctagtcttgaagagatatttgcaagaatctgttaatctggtgaataaacacttttaaaatgtagattcaaatgttgtataaacagactttgcactttttgctaaatgtttaaagaacgccatctaaattaactatgtgctgaaatcttggactacagtttaaactttatgtaataagaaatttacaaagggagagtagttggataaaatttatcagtataagttgataactgggagactcataacatccagacttaccttatgtctgctacgtgagtttttcaaaatgttaacaatagtcatctttcttatttgtttcatattttggaatataggttgtttgtgataatttttggtacatttctcttttcttcctttcagtgccagttaaaggaattactaattgtctattcttgctggaaagtactgatttccatttgaatataacagtctttttgctaaaactttcctatggttgattcgagcaaatacagaagccttctgtttgtggactgaatgttcagccagctgtgacgtagtcactattatcaatgaagcttattcatcactttccatgctggtgcattgtacgggactagcagaggatcttggagactgaatggagagcttctccttgcttacctccatacactggtggtattaagtgattctgttctctatcttttccagaccttgtggataattagatctttttgttttccattgattcccaatagtgtcttgcagatggtaggcactgattgagaatttgttcattttctaaattaaaaaaatggtagttaatgctcttaggagataattttatgttctgttctcttatacgtgagcatttatcttatatccattgtcattttacaaaggcagaggctaataatgtttttatgaaagaaaattaagtggcagttgatgattttatgttaaaagcttattactctttagggaaattaaactttttaatatttaattttgtatacttgttgaatatttagattaaattcacaggttaattgtggtatttcacttgaatagatgcagctgtggagtacaaaaaggcttatttatcccagttcatgactagaatacagtagatgttgttataaaactaagcctgttacatactttggtaaaatcatgtgccctgaaatatagtaggcacttatgagagcctcataagacacggtcagaccaccataacatagatattgggcctgcccacaacaatagtgttatgataagtggtgttccctgtatgtgttatggttagtggggatacagaatatctgtgatggaacaataattgaattgtttctgactccgtctaattttctgttgcattttaaaaaatactcccagaagaatggtgtatgtttgcccagtgcttccactctggtcctttctaagtgagttttatgggctccctaagcctgtgacctgtatttttaggagatgcaattctctggatctctgtggaatttatattggatttgagagggctgtgcattccttagagactaggtaattccagaggagctggttgattcaacggatttcattcaagggacttgtattttccttgggaacatttcaggaaatattcatttcttccaatcaaggaactctcccttcctacctacacatatatacatacccttgccctttagagattccctgaacccacaggatttctctgggttgaaaaaatgagtcttggtttgaaatctattgaaatacttcaggtttctgttgtccagaactaacttctaggtggagaccctcaagttgcccaggggttagaaacagtgaaagggactatattgtttccctttggattttccatagtgtctacaatactgctctgtacataaaatgtggaaaataaatgtgttggctataactctttatccatttttcttctccatttatatatatgtgaatctatgtaagattattaaaacccaagatttttctagaattttgtatttcattcccaggtctatctcctatctctcagttaacttacttagcatctttatgtttactgatctccccttcataacatcaggacacttaattgaattgagtgaacagaatctaattacagattctgacccatcttaagtaaggcacattatgcatccatactttcaaaacatttctctaagccattctttcttgcctgttttccttgatataatgcaggttctcttcacttcacatctaggttatttcagtatgttcacaactggtctgtatccctccctctattctctctccctttcaaatctgtctaccacactgctgtcagaacaatgaaaacataaatatatccttcttttgcttataaaactcttcagtggttccctattgcattttgggggagagtccaaagcctgaactgtaaaatcatgccagtctctgtgaatctctttgtaacctaactttctgcacttttactgtttattactgtgcctcaaagtttatttttataaaaataccatccactagtatgaccccgagcctttgcagatgctcttcctctgcctgatacttctccttaatatgtctggaaaacccctgcttatcctttgctgctaaaaagttatctcccctttagagcctctcttaaatccgaaaggccatttcttttcatctgtgtttgtatagtatagtatagaaaatagtacttctgttatgtcactctattcattgctccttaaactatttttgggctgatgattttgtaaaatgtaataaaaatgaaatactagaaaaatgaagtgtaaaaaacataagatagcctcatttaaaaaattgttagcttcaacagacctaaaattactattaaaatgctataaaggggctgggtgtggtggctcatgcctgtaatctcagcagtttgggaggccgaggcgggcagatcacgaggtcaggagttcgagaccatcctggctaacatggtgaaaccccgtgtcttctactaaaaatacaaaaattagctgggcgtggtggtgggcgcctgtagtcccagctactcaggagcctgaggcaggagaatggcgtgaacccgcgaggcggaggttgcagtgagctgagattgcgccactgcactccagcctgggtgacagagcgagactcagtctcaaaaaaaaaaaaatgctataaaggttttctatatatttactcttaacgtgtgtatttagccatcttcttgtggatcaacaaccaacaattcacaggtctgcactggtccagggccacattttgggtagcattgctttgtaacatttatcaaacaattttacagtcctttgcttgtgtatttgctcttgctttcctcactagacaagggttgtgtctgattgatcttgtgttttgtcttcccatcttttgttccctcctctcaaaatcttagttaaaatagttcatgacacagggttaatcagtaaatgtttgttgaatgaattaagggtagcattggtcttattaccctataatcacaactggcctgcatttctttgggtagggttttcttttagtttatatgggacttagaacttcatgatgtcatagtgaaagtctactggagaaagagctttctaactcagtctgaagtagagatattaatgttgtaacgtgcttcagttttgctgatctctgagaaacctcacagttcaggaaggagacatttccatattattagcacaagtgataaaacagttctttgctgtaggagaggagaatagaactcgtagtgccattgaagcaagtttttttttaagcaaatagttgctttgagttacaaatgcaatgcttttttaagctttttgtttttactgacaaaccacatgcagatgccattctgtcctccaagtttcccaccccgaggacagccagctgccatgcacttcccccatcctcattcacagatcattaatcaaagatcgttaatcaatatgtctttagaatctgcagttttgaaagtcatattcccagcttcggaaggctgcaacttgcccaatttcctgtgattttggaaaagtgttctgctatggtggaaagcgctggaaacctgagttccagcctaggttttgcaactaactgtatgactctgggcaggtcatactccctttttaacatgtgtcctcatttgaattccagactgaattatctctagggtagctttttaactcttccttttagtcctcacaggggttaattgacatttgcttgctttgcttgtggtcttttaaccctggctagtgatcttcatacactatcatgtacatactgtgccagcaattaggatattatattgacattctctttgctttttttcctcctacagtatactgtactttcctcaaagataccttattcatctttgtattagctgctcttggcccagtgtcttaattcatgccctattaacgttggttgacttgagctgaactctgtcccttgcttttgcttcagacctttgtttagcagtctgcctatcaggtgagaaaacttggattggttgcatattgatatccaattaatatattacagaactgtttaaggttgtaaaagtaataaagcccagttggagtaatggtgatcagtcatatgcatgtgtaaaacagatgaaagttgtggttattcattcattgttctccttaggaaggtcttattgattattagcttgttgaaggatctgagttggtattcgtctgtctgtgccttcttggcttctggctgcaggaaaaaaatatgtgaattttctgcccacagactgtccagccctgccaaggcagcctgccaaatctcaagtcacatgcctagtgaattgctgctacattttttcttccttgtctttttcaaggctgctgatgttgggctctttgcctggtgtccctgaatcgtagcccttttaactctctgagtgatgagctccaaacattgtttagcagcagaagcaatttttattggtactagattacctccactgactaggccaggcttgtttttatggctccacactactaggcaggacttctagaagtgtcaggctttggacttggtttagtccttactcctgagcttgaagccctgattcataccacctcatagttctcaatgtccaccatttgttcccagtgtccctaaacctagaatatatgtgggtgtcgtgtgagaggcagtttgtcctcacccatttcctggaggagaggtgttctcatcctctgggatgaacacaagaaataaccctcacacttatctggcctcacttttctagttaggcattctattttgcattccattcgcagagctgagccttgtacctctttatagtatctttcaaataccaaaatgtggaagcaccattaggaaggttagtacttccagttgtatttgtaaggatggtgatggatttaacctgagcttccacacgttttcctggtccatgtgtttgtgagataggttgcaagggtttagtggacagatgtctagataaatgaatctaattagtgcctaaccttatggaactgctaaccataactctcctttaccgctgtgttctaagcaacagccatggtcttagagtgacctcattacccagagtcacatattctgctgagggatgtggagaaaagaggaagttgtgagactggaggagaacttagaaaattttcttttatttattctttgtattgccttttctttttgctcaatttctgtgttcttctctttcttacctgagaagcactagtgtatacatgtaaaacctatatttcaatatgaacccatcctttccagctagaaaatcctggaagggtttactatcccctctaagctgtagtttccttctctgtgaaaacagactatagccactgcttaacatgcatggctatattacatattaaataacatggtgaaagtatgtacttggcaccatgcactgctgacctggagaacactttagtaaaagctcctttccattttcctgttaaattgagcatacaaattattatttactataaattccccacttgtgcctatattagaaactaacagaaaatgttacagatagtataaagcagaaattgaggcacttaatgaataaaattcagttcagttcaatgaacatttattgcataccaggcactgtgagtggagaaggcagcttcttttagaaatttacagtctaatgaggaaaacagatgagtgaatagacatttaaatggggtgcgatgggtgctttagaggcatgactggttcctctgcacgtaaggtagagggcacttgctctcattcagcgggagaggagtgaggggtggcacaaagtcagggaggtaaagcaatggatttttgaactgtggctccttgaagagagggcgcacattccaggcagagggaagtacatgagggaagataaagtatgaagttgcctaacaagtgtaactgcaaattgttcaggcttgcttaattgcagtttgtgacatggcaagtggcaggaggggaagctgttaatggccagcccatggaagtcctttttgtcgtgctgagaaacttgacttatatcctataaagaatgggggccattcatttcaaggctctatactgaggttgtgacaagatcaaatttgcattttttaagaatcactctggtgctggtgctcaggaagacaagggagaaggaggaatagacatatcaagaagctggtgccaggggttcagaggagagatgataaggggctaaactgaaagagcaaatggcagagggataaagaggaggagactaattgaggagaccaatttaggaggtaaaatgagtgatagtttcattgtaaaggatgaaaaagtgtcaagggtgactcttaggttcttttgttgggtatatgtaattggaatggcaaataaagatcagatttggggaaaaagatgatcaattcagtttcagacaaattgaatttgttctgcttgtgggatgttatccaaggggagggaagaccggcagccagtttgataggtaggtctggggcttcacagaggtcaaggccagaaacacagcttttgaacattagtcttcactgatgacagtgacgttagaaacaacaagtagaatgatccccttgtctttgcattgtgacagagacagaaatttagaatatgtcacaaatgaagctgtcgttaaaaatatccagtagattccccccttccctcctacctcagttctctcattaatggagatagaatattgttatctcccttttctctttcaattcccatagtgccttttgatttgagatatagctttgaaattaaacaagattgaattttgaagggttttaaattttaatgtgatactttacataactccaagctgcattttaatgtggctcagcatatattctgatgcctctgggagtgctttaaagtaatttattattattattatttcattattagatctcagacagaagtttagagaaaattattagaaaaagtccggatgtattccttaggctgtggaagggataaatgtaaatgccttggtggcaatggcttcttatcttctcacatgactcatcctgccttttctttcctggaagggctctgtggttttagatcagaatcaaggtgtcactgagtggcagctttcagtcagtttttgcagcactgcatttttgggataatcttctacaccttcaccttgctcccttacctttccctcctcttgtctcagcgtggagggtacacttcattttatttcaggagatcttaggaaatcatattcttggatgttcttgatttattcctttactttctatacatatttttccttaattatcttcttgtcaatattgagatttatggtaacctgtctcttcctaccctctttcatttgaatttacatggaaaatcagccattctgttctggctcccttgaaattatgggtttgtctgtcttcctccttcccttctttctatttttttctatccattaaggtaaaacatcccagatccaatcactataccctactcccaattcatatgtatcttttaaacctctttaatgttctggctacatgaccagcagttcttttcttagatacattttgtattgactgggaggttcatgatctcatatagttcatttcattttcagcaacattaattgttgaagggccttccttacataacatggagatatcatgatacattaaccaatgtgctttgtgtccctgttattttctgcaaccttctgacggctttgctttttctggttataaggggaggggaaggatacttcagcaggatgtaaaaaagaggcaaatgtctgtttttttttttttgaatttcagaaattacaaagcctgaatctggctataagactgagtttgaaaaaacaaaagtcaagaaaaaagattttatagactagaagaggaaggagagctgggtagggggctgaatgaatctagatagtgggattgtatttgaaccccctaggaaggtttgataaattctagaggagagtggacttccccctaccatgacttaccccacccactgacggaagctaaaaaagcagaaagacctgagaggaaatgtgccaagattaagtttctgcctctcaactggggtcacaactgaaattgtttagacatagaaaaaaataaaaataattatattactttttttacccctgtgatttatggagtgggatttgcatctactatgtctatattgaataactaacagtgagatatagtggaaaattgcttaggctctgaagccagattgatttgggattaaatactggctctgtgtaataccctaggctagttacttagtctctctgagtctgttttctcatttgtgtaactggaataataatacccacctcatttgaagtgttttgatgcatggataggatatatgtacaatatctagaatggtgcctgggtgataggaggtactcagaaatactctgcttacattttaatctcagtattacgtctttattttgtgttcttaagacttatagactacatctaaacccttctttcatatgacagctctacacatatttgagggccagtgtccttaactgtgtcttgtatatttgagaagccgtatgccataatgtattctggagcacacttcttagatttgaatctcagctagcccacttacacacttaggtaagttacttaacttatttgaacctcagtttccttatttgtaaactggagatgatattaataatacctatctcttgggttagttgtgaatatcaaagatgttaatacagataaagacctacaggcacatgttagttaattatacatacagttaatatcttattgtgacagaggcagtgcttacatgttcacctagtcctgttttgttttcatctttagagccagacttaagctgtttttttctgccttccttgcaattatgttggggctatgtgcttattctaactggtagactaaaagtagaggtgatatgtgtcatttatgactcaaagccctttgccatgtggattgtggaggctgcatgttgagatgatggattcacaaggtgatactagactgaatttctaaatcaccatttggaattagcttctgaatgcatataggacattgtatgggcaagaaataaactttgtgtaaaactgctgcgagtttgtcattgtgctgtcaaggcataatctagcctatgtagattaatatgactaatattggtagatgaatactaaatgaaacaaactgtcgaggggtcatttttaggagaaggccttttcagtgaattaaggtattcattaagatatcctccttaatgatattaaggaggagggaggattttattgaagaaacagaaacaaggttaaaaaaggaacattaatttttctatttgaaatgggttttatgtaaatgcatgttttggtgataaaaccctttgtccttctttttattgtcccatatcctataatagaattttctttctttaaagcttcttaacatctttctaaatgggaaacagttatattctggagtggtcattaataattttattagtgaatgagtttatcagctcctttttttgggagaagattttatcaaagggtatggaggagaaaacgtaagagttccaattaagtttttgaggaaaggagggggctttaaatgcaggctaagaatgaagcacagtggatgttgtattttcctctaatttggtattgtggtctctctctggagagttgctagaaactctagctctgccctggtggagatccaagggagatggccttagatgcttacaaagtggctttacgtgatacttctttatcccggtggacagtctaacctaagtgtctaactcatgaccaggtttccctcttacagggaacttgaatatactggcaggtacctttgtggttcgtgcctgacttgtgtccagtgtatgagatagccactctctaggagagccatgactgggcagagagttaggtttggttgtgttggtcgggtgagacacagaggaggcatgaaataacaagcagtgtatgttatttacagacccagaaagaagagggcagcacacctcagggccagcaggaggaaggggagtcatccaggacatgtactctcaactggcggttgggaagaagacagaaagagatagacatgtgggtcgaagtctttactggggtccgtcgtgttacccaagtaagtttcccacagggagttctaattggtgggtttagaggaagcaggcacaagttctatgtaggcatgctgtgtctgagaggaggtcactgtggcatatctgcacagtatgtatggggtgtggaggtcagtggagcaagtctaataggctctgtttagctgtcccacagggaagtggtcaccaggaggcagttatataagggagatgtctggaacaatcacattgaggaacagggaagaggtgaagaactggaaactgtgtcagggatgacttacccttccttctgatatgaaagaaattcaacttatgtttaaaatgaatgccaaaagctgagcacagtggctgatgcctataatcccagaactttgggaggctaaggtgggcagatcacttgaggtcaggagtttgagccaacatggtgaaaccccatctctactacaaaaaatacaaaaattagccaggcatggtggcatgtgcctgtagtcccagctacttgggaggctgaagcaggagaattgcttaaacccaggaggtggaggttgcagtgaactgagatcacgccactgcactccagcctgggtgacgagtgagaacctgtttcaaaataaaaataaaataaaataaaatggatgccaaagcaacataaaataattataagaatttgctacagtggaagatgtagttagaactcagctcactcataaacacaagtgatccttgaggtgaaacttggtgagtggcaaagtgttgtaaaccactgtcccagatgttactctgcttccctcacataccacataaagtggtaaatgggtttgattcctgggaaatgagttttcaagtatctttaaccacttaacaagaaaatgtgacttcttaaaatgtacttcttaggttgactcattgtgaagataaaaaagaaataccagaataaagtgtgagaaaaaatacaaatcaaatatttaaaaattttttggatacattatatttgtacatattaatggagcatacatgaaattcggttacatgcatagatgtgtaatgattaagtcaggatatttagggtatccgtcatccaagtatttatcatttctgtgtgttgggcacgtttcatttcctctctactatttgtgttgaaaaatacaaccattgttgttaattgcagtcacactactctgctatcaaacattcgaacatattccttgtatctaatggtatgtttgtaccctgtaacaaacctctctttatctcacttccaccctctacccttacatccgtcccagtctctggtatctattgttccactctttacctccatatgatcaactttattagctcccatgtatgagtgagaacacataatactttttgtgcctggcttatttcccttaacataatgacttacagttccatctgtgttgtgacaaatgacatgatttcctttgtttttatggtcaatagatttccattgtataaatataaaatatttcctttattcatcatctgttgatgtacgcttaggttgattccatatctttgctactatgaatagtgctgcagtgaatgtgagggtacaggtgaccctttgaaagactgatttcttttcctttggataaatacctggtagtgggattgctggattgtatggtagttctgtttgtggttgttgttgttgttgttttttgaatgtccatattgttttccatagtggctgcactaatttacattacaaccaacagtgtgagagttcccttttctccacatcctcactaacatctgctatttcttgctttttttaattaatagacattccaactggagtaagatgatacttcattgtggttttgatttgtatttccctgatgattagttatgagcattttcttctgtatacctgttggccatttgtatgtcgtcttttgaaaatttctatgtacgtcttttgactctttttacatgctattaatattttactgttgattgcatattctggatattagtcccttgttggatgaatagtttgtaaatattttattccaatcaagaaattgcctcttcactcctttgattgtttcttttgttatgcagaagctgttaaatttaatatagtcccatttgtctatttttgtttttgttgcctgtgctttttaggtctcagccataaaatctttgcctacaccaatgtcctgaagagttttccgtaaattttcttcttgtagttttacagttttgggttttacttttaaatctttaatccatcttgagttgatttttgtatatggtgagagatagtgttctagtttcattcttttgcatgattatctagttttccagcaccatgtattaacgaggtatattgtttttacattgtacctatttggagatctctgaacttctgtatctggatgtcttaatctctttctagacttggcaagttttcatctgttattttattaaatagtttttctaactcattctcttttaggtcaccaataatttgaatatttggttgccttattgtgtccccatatgtcatgagggctttgctcttatttgtttattgatttatattgtgttattttaaaagacctgtcttcacgttctaatattctttcttttgtttagtctatcattaaaactttgaatgtattttgtatttcattccatgaattcttgagagtttctatttatatcttttttattatatctatctctttggttaatttcccagtcacatctgaattatttttctgatttctttgtattgtttttcagagttatcttatagctcagggaggttttcttttttaacattttcaacattttgaactctttttctgagatttcatgaatttctttttgattgggatttattgctggataacgtgttcccttgcaggtttcatatttccttgtatttttatgttttctgtgtccttacattggtatctgtgcatctggtgtaacagttgcttcttccaattttgtgattttgctttcataggggaggactttttcctgaagatgaatatatggtgtcggttgggtagggcactttggcttgattctgggtacatgcaatagtgcagtgtctgtatgatttctttgactataaacagcatcagtggtgtctgattttcttggcggcttagggtacagttgtcagagaaggctgtggtgaagttgtgctgagatccgggatgccagtcttcaggcttcagtggtggcagcagggagctgactgtgcctgcccttgggcccaaggtggcatacattggtaccagtgttagcgggtccaggcaggcttattctttgcctccaggtggattgttgaggtaccaggcatggatggcggtggtgggctgtgtgggtggaagagttcttgagcccctggcagtggatgtggcatgagcaatggcagtggcagcagtgagacaatcctctgaaacccaagtggtctgtgctagtgttggcagtggctgtgaccagttgggtgggctgaagacctgcaggtagcatgtgaggggtgggtgccggctctggtggtaatagcaggttgagtggacctgatcctagacactgggaggagtgctcaggtgccacgggcagtggactggatcaggcagtctccaagctcctggatggtgtgctcaggtggaagcagcaacatctgtgttgtggacctgctatcagagaaagcttggttgctttccctgggggcagccataggcaggcagctggagggtgtgggcttttcttgcacctcagcccacagcagtctgtagctgcagtggttgtgggcagtggaatttgtcctcaggatgcatgagaatgcatggccgcccctctgttgggctgggggtgggattgttgctctagactcttgacctgggcctggttgcagggcaggacgtagtccattgtgggctaggctcttaaaatggcactgtgctgcagctgcttaggactcgggtttgtgggactcgatgtgagctcccggtctggaacagtgccttcgtgtggtttctagggcacaccttatgttactttcaaggcctctgagggtcaaagggctctcccctggctaggattgttgtagtccatgatgggaatgtggaccactggggtctctcacccgttctccacactggggagttccaagatgatccctgctgagcaggctacctcatttccctctactttcttgctttagatgtttcctgtcactttgctgaatttcagtgttctctcttggatgatctatttgaagtgtgatttttctcctcactattttgtttcttcttagtggaggaggtgagtagacattaggagatgcctctaatcagccatcttgaagctgggacattgtctttttaaagaattaatacccaagaccaaactagaacatgcctcagaggttccagatatagtgtggggcactgaggaatgtggtcctgccccttagccacaagggccctgcaagctgttgctgcctgtctgagggcaacagaaatagacctcaaaaaataaacttatgcaaaccaaggtgctgggacctctgagctcaccctcccaggagtgtccaaatcaagtatttaggtggcttacttagagatccaagccagggcaacattaaaagaaaatctggggaatatgtgttttcttgctgccattttctcaaagcagacattatgataatataaagtgaaatatgggataaatgatcactgtcctaatgctgtggatcaaatattttttcacatatcaatttccattaataaatgaacatgccctggcttagacccctaagagcagctggtaaaattcagtatctctttttttcctacagaagtgggtgacaggaagttcacttcttagagaatttatgactatttttgaaaatatgattatgaaaagtaatttctgatattgaggttagaatgttacattatgggggttggcaaatgaaggaaggactctcctgttatctttcatatctctcctggtccactgtagattgccatggtagtaggaactttgatacatttgatacattaatatggtccacatggaaattatatgaggaatgaagcaagtggcttataacttcggggaagaagggttgcctatttccagttttcagaatgttcactatcttcagactagaataaaagtttgattctatctctagtctccctggtagcaggagttttgttctcctttcctgtactcgctgtagcagcatggaaacttccttggaaccccagatcatggcagcagtggtagattcctactttgagatactgggaagtaggtgaagagagctttgggcacttcaatgatgatggtggttttggggtcatgccttcgggatttcctatgtacaaggtgctatttgaaagtacagacaatagcatgagaactagaaaagatagcttcaaggtttgagcctgttaccattagccaaaaaagaacaagttgggaaaacaaactaatttttaaggagaagacattgacttcatttttggacattgactttgaagtgatgattattaaaatggtggctggaagtttgacacaccatcttttttttcttttttaaggttagaaagaggaatttactggggcatataaccaaaccatgaaatgcatacagcttaaactgcctttagggctgggctgggaacacataacttgaatttagttaaggctgtctcttctatttcatgtatcggtttcatgttctgttttttttaaaatttttattaatttcaacttttagattcagagggtacctgtgcaactttgttaaatggatatatcctgtgacactgaggtttggggtacaaatgatcctgtcacccaggtagtgagcatagtactcaataggtagtttttcagcccttgacttcctccccctgccccccagtagtccccagtgtctgttgttctcatctttttgtccatatgtacccaatgtttagctcccacttataaataagaacatgcaatatgtggttttatgttcttgcattaattcacttaggatgatggcctccagctgcgtccatgttgctgcaaaggacatgatatcattcttttttgtggctgcatagtattccatggtgtatgtgtaccacattttctttatccagtccactgttgatggccacctaggttgattccatgtctttgctattgtgaatagtgctgcagtgaacataagagttgatgcttcatcttttgtgaaaagctggggctaacagtgttttggatagagacttttaggctcaaattaaagaccccctcacaaattcgttatttgatagagcatatctttgagattatagttcaggtttgtggaagtatatgattcaatatataaactcctaacaactttctatgagcacatcttttttttttttttttaaatccagcagggctacaaatttatttgtcacatatggtaaaatctatatgaaatgagtaaatttttttaaggaaagatattattgaaggaaatagaaaagtggtgggataacattttaaaaaacatatatttggctttgtgaacaaaatgattttattttaatttttttgttcaaggcaaaatctcttcaataggaggagatagaggagaatttcttctccagaatataatctgtagccatctgctgctgtatctcattatgttcttcatgtaattagagcaattaggatgaggcttgcactgtatattggtcatggaaggagggttgagctatttctaggcttgttttgagagactggagattaatggcctaatctgttaggtaaattgatagaaactgagatatgtttaagctaggaaatggagaagggcaattttttttttttgttatctgttatgttgctttcttgtcaccatggtaactaggtgttttgacaaatatatttttaatgagattaactcatgataaagaagaaagtaatagtgataaagaaaatgataagagaaagattgtagaatgaaagaagatgggctctgtggtatagtgatatggtggaaacctcacaccagattttcaacgctaagaagtttggagaaaaggaggaaggagaatttaaaggagaagacaaaattagggatatacaaaactgtcttttgggaagccagtcatggaatgtggtttgtactgaagaagggccagaagattaggtactgcaaccacaaatgtgctaaaccactgtaggattcttaggatagattgcagtgccactcgactctcacgtaagattagcatgccattccaaatcctggaagaggcttctcgtaacatctgactgttcttcctaatcaccctctctgtgcccttttcttaattgcaattgccaacacattagtgatgattctcattgctaatactgaaccgttgccttttcttccaacggatctttctcaggtaaagattattatctacttcaattcaacttacttgtgtccaccaaatacatttttatgaaatactgctctatccccgtctcttttttattcaaatacttttagtaaaggctcacattgcctacaataccatgcttctatcttgacgttcaaggtcacctgaagagagaccaacccactttatctcctgtagctcttctgtatgaaccctattttcttttctttttttttttaattaaatttaatttaaagttctgggatacacgtgcaggatgtgcaggtttgttacataggtaaacgtatgccatggtggtttgctgcacctatcaacccatcacctaggcattaagccccacgtgcaatagctatttatcctgacgctctccttcccccggcccctctgacaagccccagtgtgtgttgttcccctccctgtgtgcgtgtgttctcattgttcagctcccacttataagtgagaacacgcggtgtttggttttctgatgagccctattttcaactagcctgtgtcctgcctgtctttaaaatgtgtcgtgttcatctctgccattgcttctttgcacatatgattgctcttgtttggaaacctccttggttctctaagtcttaaatcctttaaggtccaattcagtacctcaccatcttaattgtgttctaccacttattttctgttatatttttatttaagagatcttacattacttagcatagttttttatagtgtagcaatgctgagaagttgatgctagtgcttgaagcataggcctttaggagagatcaggatggcttaccccactttgtatttcaagttgctgtggcaccaggcctttgggaactcagacaagtcaggttagagaaatgagttgggtttttatttcactcctttgtttaatttcctttcaaagccctggtgtcaccaaattctacgcagcctaggcacttgacagaaaaaatgattttccctagttttgaggggacttatcctagatgcattgaatggattcagcttctgggtgcatgcccagtgccttatacatagaacagttaattctaggggatgtccatgctccattctgttctgatcaggactcatttatgtgtgccaagccactgctgagcttggcatgtgctaatgggcaagagaggcctggcttctgtatacatatgacaagctctgctccctgctgggcggggcatatccctggatgagagatcctgggtgagagagcagcagagagaacaaaacagtgggaatgagagactgcgagtaagcagttagaacagacataaaaggagatattaataatagaggaaattgatatccatgttgccggtggaaacagccacgtagagcagggttttgatgtccttcacagtacatgcatctttgtctagaatttacccaggttctggcattacctgaaggtcactgactccaactctattcatttatggtgtggcctatgctttatcccagtgttactgggagatgttaattctttattgaaaatgtctatattttagttcttcaggggctacttaactctttaattgctttttgtttatgcaagtgaaaccctgggctacatatctgaaaatgtttcacttatccttgaattatacctcccaagctttaagctatagcttctacaaatttagtaatggtgtctgccccgaataacgaggatctatctgtccagccctgtacccatgtgttgtgtgtcaggcacatggattttattgtttctaaatggcaaattaataggatgtcagaatttgcatagactatgcaaaatcatccattcagcaactattgagcagtattctctgatatactgaaaaaataggagatctttgcccctacggaacctgcagtttagccaggagagaagacaatagacatgaagcataataagtataatgctcctagtaagtgtgttaggaagtcataagtacattgcaaaatagaaaaagtggtaagagcatgagttgaaaatacataattatatgagattaattataggttagtattttccatttgctttttaggttacagtacttaaaggaaacaggcattcaaatccttgtatctgtctggatcctacaggaataattagccatttagttctcgccatttgggaattggagagaaggacaggaataaacccccaaatctcaagttcaggtcaagatgtagtgagagcaaccccctaaagaaaggatacacttgagttcttcctttctgttcttaggaacttgggaatttctccttaaagatagaaatgcattttgttctaatatttgtcttcaatgtaaagcaataataatttgaattttaggtggtttggttgaatatctttgtatttaatagatttaaatatgatgttgggaatatgttatcttaaacatgccattctttattcttaattataaactaaaattttcaggtatcagtcaacatttgagaaggcactggagcagaagtttcttctatccagcaactgtagtttcttctttttttttttttttttgagacggagtctccctctgtcttccaggctggagtgcagtggcgtgatctcagctcacttcaacctctgcctcccagggtcaagcaattctctgcctcagcctcctgagtagcagggattacaggtgcctgccaccacgcctggctaattttttgtatttttagtagagacggggtttcaccatcttggtcaggctggtcttgaacccctgacctcgtgatgcacccacctcggcctcccgaagttctgggattacaggtgtgagccactgcgcccggcccaactatactttcatatcgtttattttcccttttccttccagtcacttcttttcaggataattaatgttattgaaataaggaaacataccttaaaattaaaatcaaaccacattgattttaattttaaggtatgttttcttattttggcataatcctgaattttggtgttctgtttttcatgtttacacataaacctaaaatgttttcccctttggtatttattttctgttactagattgtcactctctgaagtttgctaatctgacagaagctgacctaataatgtagtatgtaaaaatgtctctctgctttctgcccctgtaaatacagcgtgccataaatgcccgttgtatgcttcagtcattctagtactttttgttctttaatagtataattgcctcttatatttcttcaggttatcatctgggcagagtgttagttcatgagggagcataaggcacatctgtgagctccagagctcagcaggattcacccctgggctttggcagggcatgtcaagctggggctggcacctcattattgccagctttattgttgcctgttctgcatcagctgccaatgctgctgtgacaccacacactatttttggtctttttagctaaacattttttttttcaaataattaacttaagtacctatttctacaaatgaaaagactatttaatagagaagtgggaatggaaaagcagattttaatgctttaagattttaaaaacttttaaaattagttgtggttttttttttttttttgtaaaactgtgtagctgtttgaaagctagtagtatttgaaaaccacagtaatgagtgtattactgagaatacaatagtaccaactcctagaatatatcctttttgctgctattttaaatcatcaccttaaatgacaaaagtatgtgaatataattcaaaaccaaattcaaaacctttccacttcaaactggcttctgttttgataatgccaggattctgataatcttaaaggcaggaaaccatgaatttattttattttcttgcttatgtagtatccttcactcccattgaacattcatgccagtttttccatttagcacctctaaatatacatatttatttcatttccaaagatcccctagttcaggtcctctttatgtctggtttatttttatgtggtaacaattggagttttaatcagtgtctctccctattattatttcctattataccttcccttttgtttggaaataggaattatttttttcaggaaaagacaaacgtagcatatctcttactgcagaagagttgaattcttgacttttgaattttatgtcaaattctaggcatgaagggagctgttctggaagaattagaatcagttatttctgtcctcagaaaagtagagctggggtggtggcatgcagatcccctgtgcccagtgtggctggagaatagtagagatggctgtctagttagagggacctgtggcaactttgcaaatttcccatggcaaggataacttagggggtgatgaggagatacctgtatgcgcagagggacatggatgtagccaacagaaagccagacttgacagaaggcttgtggcagagatgaggaggatgagggaaggagctaaggatctgggtagacctgcctgtaggagagctacagatgtttgtggataaatgctgatgacctccacccatccttccgttcctctaccacacaaatctagcattttataatcctttggaatttagatgcgcccatgaggaaggggaaaccagaaattgagattaccctgacttgactgaaatttaattttcaccattcagcagcataggagttttaaaacagagattaagttcagttgtacagaaataaactcccaattgcttgcacacctgagtttttgctttgccctagtacctgctgctctagttcatttgcagtgaagcctctctaatcttgcttttttcacgggggaagctaccatggctgttggtaatacatggcctggacatgttgattcttcatactctgtgtccgcttcattgttcccgctgttttccaacctgaacctgtcctttacgcagcccagtcccctcatagcctagtgtctactgggagacttctcagcttcccgcctaactgctctttctttgtgtatacttttcccacttacattcagacatcagctgtctccttcctctttttttgccagtctacctctttaccagttttcttggttcagccctgacagagctgtcattttatgacctttctttatttttatagtcactacagtgttggattattattatttttttttaatatttaccacttggcacttgcatagtgctttttgtttcttggtttttgttctatggctgttagtgttttttttctccaactcgatgataaacttcttaggaacatgggccataccctgtttttctcttgtgttctcttgaatgctagcatatggtgggcatagagcagatactgaaaaattactcattaattaatggggtggaagccattgctatttacattatgtgtatgagatgaattttatctttatctgttttattctttatgtatttctatgtctctaccacactagcagttaagttaaagaagcaagcagtgggtggatgcactgttcccgtctctgacaagtacaacaaagctgacttgcctatttttagaaaccttgatggtgttaatttttcaaatgtcacttaaaaataggtagctaaataagaactctgagtgtttttaatgcaatggtatacttttctaaaggggcctctggaatatgggcatcacagattgaacatctttagttaacacttgctcaaagttatcgaagagataaagagagagttattgctctgtcttgtgtaatattttttaattgctaagttatctgttgttaattaggatcccctttttgacatagcttcagaagaatgttttgccctaaattctagctcagtatttcatttatatgcttggataagtttccttccctgttctggactttattttctctgtcctgtactttattttttaattcgatattaaggaccttttcacagaagagtacttccccattgggttttagagaagctagatcttcttttctcatgtaatttctctggctattgtctataattccctggggacccaaagcaggcaagagacctaggaaagaaggaacagaaacctgagaggcttcaggcacacaggaatgtcactctgttctcgttcagcaccttcccctagtcgtgcgttggtttcccccagatccagaaaagaacataaaacccattttgcagaagcaggccatatgcctctctttagggatgacccataaaacatgtattatttttcacatataaaaatatataatgcatctgatgtttttaaaaatctcagatggcaccttacaaataatttgagctttacagtaccctacttgtaagtcacccttatctgaggtgctttttggttaagatctcaaaaattctctctctctctctctttcctactggagtgaactggaaactaccctgtgtcacattaaagttattggcaaatgtgtccttattgtgagaataaagaagaacatgcactgactttgggaggaatccccacctcattcagtggcactgcttgccaatgcatagtaaaaaaataagatagaaaagctcctacaaagaggaaaacaatacaactatatgtattcacttgctttctcatttgcttatttacttgacatgtttcaataagtgcagagaagaaaaggcacagggtactatgcgaaaaatggacaggaaagggtggtcctttatgagaagggttctttaagaaagtgatttctaagctgagacctactgaatttctaagttgaattcctactgactagtagaaattcctactgacaagtcagtaggaatttgaaggctagacaacatggcacagcaataaggggagaatagcaggagatggaggcagctccattagaaatgcttatgtttaatttttaaaagacgcgtcttgggctctcaattggcaaatagctgtggaaagtgaaatattttgttttgaagagttaatgtagttgaaacagcataatcttgtaaagttatatctaaatcgtaatagagaatgtaaagaaagattagagatttaaaatttaacgcagatcatgccatgtggtcagtggcttttataaacttttttactcaaattatgactgttatatctggacatttatttaaaagattatatatatatctctctccatacatatgtacatatatatatgtatgggtagatagtcttttggttttttttggcattaattcttgaagctgagtttatttagcatccccatatgtttaggaaccttttatagcttatctcacttgagaatataacaatatatttaaattagagccctccttcaaaattctgagtttactttggaaggtgtatctttttttctttcttctcctttccctttcttagcttatcttttgggtagaattacagaaagtggtaggaacagttgtctcttctaaatgtggtgctgtgttaccacctcctgtgcaggcagagccctgtgcattccaaagatgtcctgggaatggaaactagacaaagagagaggaagattggcttggctaagctacgtggacattcagtttgtgaaaggataaactagatataaagaataagaagtgacaaatggtttttcacttgactctcttaaacgtaaatccaaacctaacccttattaaagtgatctggctgctttttatttgggtaaatatataatctttgatatgctgtcgtaatgttgcctttgtgctaacccgaacctggcgatccttataattgtcactgaagatacataatatggaggtgaaagttacctttttaattctagtctgtagtaagcacattgttaaatgctcgaagggaaatgcaaatcagaaaggctagatgtcttttggtaaacttaccatacttttctgatatttagcttatgtagaatataattaagataaaccaaataaccaagcttgtaaaggtgctgtcgtgtagaaaaaaagcaacatggagccaggggccttttaacacctcagttctgccacaaaagagccatgtgactttatactgaaaacatataagctttctgagctgtttcttcatctatgaaatggagataatgcctattttattaggggcatttgtgaagatcacaatacatgtgaaagtgctccacacatttgtatggtccctaaccttcagatgagtttaattaagtaattgttgatcatacgtatattatgtgcagggttatgctggggaagacaatcctagcccctgccttttttattcactgacatgggttttgattacatttgcatcacactaggttcttggattaactactattgtagttttgttcacaacaattctttttactcttctgtttttttttttctcatttctgtggccttttcttacctttccttaatcttgcctggtcttttctgaacgctatgaactgctccatacccagaactcatccacccaactgctgaatataaaataagttgtcctttcgtcatctttctttcatccctctaaaatgacattttattactatgcagtaaacatgttttaataaatgcttccctaattccaaacataacatacattttgcagggattttagaagtggtagacaggtagaaagaagaaaattaaaattaccctaatgcttcgcactgagagctcacatctgctaaatttttaatgtatctgttctgtctcctaaaaaattatttaggaaatgtttggattttcagtgcagctcacatatatttgttagatttagaagatcagcaccacatttatgatctatgataatttggaactagttttcctcaagaattttaatgacttttttttttttacctctatctggcataagatgactgtgtttactaacattgattcattttcgagccaaaaaaaagcaacaaaacaaatcaggagagagaagagctcttttatttattaattcctgacacattttagatgctcatcacatagttaattttcttttcattgcttcttacttttccctccctttattttttatactccttatagctcacacatttagctaaggagtggcatcccactgggtctctttagggtgccgtatgtagctcatgttagaatttgagtatggtaccttagaagacatgctttatctaaattgaaggctcctgatctgggggttatttatattttctaaaattatatgctaaagtatatttttatatgtttatttttctgggaagataatcagcctatgagttttatcagatttttaaatgattctgtgtccagaaaaaacattcaggatctgaatctaagatctgcttgtggcctagcccttgaattcttgtcaactctgggcaaggtacataacctctcggcaaagaggagtcacttgtgcataaagtacgtggaagttatacaaaatttaaagacaattatgaaaattgggtttagtggttaggaaaaaagtcaagggacagtatatttccagtctgaaccatatcaactattgtattctgaggctaactatgagctatggaatgctgaagacaaaataaatactgctttaaattcttttatgttagatttggtagactatatgatagatttggtagacatttcctaataggaaattcaaacattagaatgagtttttttaatattctcctcataaattgggtaagatttttatttgaattaagtactttagaagtgatcttacttgaatttaaaacaattttcattacctgtgaaaatactccatacgctcagagtctaagaaatcctaataggtagttaaaagtgtaaaatgtcttcccttcttcctatctgtatctcctcccttctccatgcttttttcctgcaaataatttgtgtatttgctgtaaagtgtgtacttaccttaagctagtgttttcagaccctcttcttagcctgtgacatactggtgggaagtcttctgtcctgacccctttttttccctctttagctctgcccattcttcatcccatcctctgacttgcactcattgtctgcatgttggttaactgtctatggaacgctatgattagtacacatatacagatttaacccacccaactttcttgatttctttttcacttagttgctcttttattaaaaactctttgaaacaaatatacaaacccataatgtaatgtatacctgaataccagtttccccaaggtaatccaatgtataggatgctgtaggtgagtcaaaaggacataactgtgaaagaactcaggtgaagtgagcagatcctttagactttgggggtggggatgggtagatgtaatgattttagaaagtaaggtatagaaggttgaattaaatggtctctcaaggatctttctggctgtcatattctgagacctaaaaaacattgcttagacagagatcactaagaacaaaaggcttctcttcttcataatggagctcgttgtgattctcactcaggaagcttggcagaggggcccatcataagactgtcaccagtcaattaaagtcaatgtcaattagagaatattaattaaaattgtagcctccctaaggaaaaaaacattgattctctgtctctctatatagattagaaacattgactctttatttctatatatagataaatagaaatataattcttttcccaaccaaaagacaataactaagtatttctgaatacatctaacaataggaatctagtgcttttaggttctctgacttctttttagcacttcagtactactaaacagaactttttcttttttaattcttgtttcatagttttcctggcccagaatcctatctccatgagtctcttagctatctatgaacataattatcccctagggctatagcacctcaaccctcatcagaataaagatatcacatgatcaaaatgaattgatgtaaataaaaagtattatttctgccctcagtgcttctgattattgcatgtttatcatgtaattgctgacttctgcattgattttagtaatcatgatttcacatcctattgtcagagagagacaatccattgaagtccagaatatcagaggtagaatggaccttgaagaacatatactgcagtggtcctcaaattttagcatgcctaagaattacctgggtgcttaggatacatagtgttgagttttacctctgagattctgatttgagtatctgaagtagggtccttgaatcagcattttaagcgggtatgacagataatcctgatgcctgtggttcagggaccacattctatagttcaccagagcccagagatttccactatggctcacctagagtgggcagtgtgggcttctaattgtccaatcatctgtgtcagcaaagtggcactgctctttggcaattgcttttgtaaagactaccagagacctcctggtagccaaatctagtgttattggcttgcaggcttcatgataaactgacttacacatacaaattgatgtttatagctttttatacctgtaattactgttttcctccttatttctcccttgtctaggtgcttttcttgcccttccagttattccttcttattctcattctctagttctgcttcctttgcctaccactcatttgtaggtatgcccacagaattctagcctttattttttgtcttttacttggatgatctcttgttcagtttcactgccttgatggccgacttttttgtgatttccagatcttgctctttacctttatttatggctacatactggtcgttttcacctgtctgtccctcagaaccatcaaactcagtgtctaaaattgaacccaaagtcattttcccccaaatacttcttccacctgtatttttccattttattaaatggtcccaccagtgacctctccagagtgcttgacaaccagagtagattattttttaagactcacctttcctatatgacaaaattattttcactaataataatgaaatgaaacaaataatggcagaaaatttttttattgaaatctgtatgcatataatcatatcagcaacaaagtattatagtacaaaaaggaaaacttataaattatagtcatgtaattacaataatataataattgacaaaagaaaggggagaacttgtgaagaaacttccaatagagtgaactctacaaatttcagaaaataatttgcaggtagaagaacaaaatggaaatatctcaaattgtgtttctttctttcattgattatttagaatctaacctttaagcacaggaatatgtagttggagacatatatgggtcagagacagaaactacacctgaaatgagctccaagtctttccaacaaacatgtatcagagtccaggccatataattacctatctgtaaatcacatataattagtgttccttctgaaataactttcatggggcataccacatttattaaagtataagaaatgagaatgtgttggttcaacatttacacatatattacgtagctattgctaaaacttaacagtaaccatggcaattattgggcacatagaccaacacattttaacagggagtaatttattaattacattgtttaaaattgctatttcatagtgacaacaagaagcaaactgacttttagtgagctatactattatttttaagttgattgcaaacagtgcaccctattattgtctgaactcactcccatacccttagtatccactggatcttgccactggatcctgccatttatacactcaccttaggccaagaactgtaggatcattaaaaaattccttttctcctatgtttttagagtttatttttctatgcaatttctaacttattcactgtgtggttaattaatttattttgagacttttctttttgttaatgtgaacattttaaacaaattttcctttaccactgtaaaaaatagcttttttgaggtataatttttatataggaaaattgcccctttgtgtattatacagtgccctgagctttaaggaataagtatggtggggatgtatgaaagagcctgtgaacttgcagaagcctagttttggagcagagcaggctctatgcagggactttgttagcagagtcaactgtctacgaccacagtgcaggtgcccgcaagtttcttcaaagaagcctaggaccagccacatctcagcaggaactggccccaggaagagggtcactttgtagctgacaacagcaatgatgcctagggacatcagctggaccaaagccctccccctcaccagaaggctcttgtgagcttctttacagattgtgtcttttaatcttcctggatgggagtggagctctaagagactgtcttgaagcccatgagtcatccaaaggggatcatttaaaccagctgttttggcaggtcagatttcaaataaatgaatgtgtaaaccaaaggattgtctaagctggaaaagcttgaaatattgctgattagcaagtctgtttttccactacccactaggatggggttcccaaggatgattaaatcaactatataaatgaaagaagctgcattttctttatacagttgaatgtttcaaaagtaaatttgtaatatgttaccacaaaaattaacccctgccaaaaaatagatttgtagccttactatgtgattataaaagtaatacaataaatgcatgggaaaagattaggtgtatatatacaccaacagtcttcatctctgagtagtgatattataagtgatttttattttatttttttgtttttttccccttaaattgtctgaaataaattgtatatgttgtagctaggaggaataaatactattaagaataatcaaccggcaaaatagtaattttttattagctatatttgcattattaatacctgtataggatacattttatacatacgtatatgataaaatacattttatggaattttatatcttgcattttcatcacctaatacacaatcagtttcccttttccctaagtatttttcaaaagcagttagaaaaatagccgtataatagttttttgatgaacaatttctctgttgctggacatctaggttatttttaaaatttcaccatcttaagtaatgccatgctacacacatttctttgtaaatcttggcatatttgatttttttcttggtatatattctttgaaatggaattactgggctagataataggaacattttcaaagttctagatattaaacagttttaatttcagtgatcctttgagagccttaactttaaggactgagccacattattacctgggtgtataacctttttgttcgacacatttgttatttcttttttttttttttttgagacggagtctcgctgtgtcacccaggctgtagtgcagtggcgcgatctccgctcactgcaagctccgcctcccagcttcacgccattctcctgcctcagcctcccgagtagctggggctacaggcgcccgccaccacgcccagctaatttttttttatttttagaggcggggtttcaccattttagccaggatggtctcgatctcctgacctcgtgatctgcccgccttggcctcccaaagtgctggattacaggtgtgagctactgcgcccggcccacatttgttgtttcttaccaacaacagcagcagcagtaattaaacacacatgggtacacatacacagctattctctctaatcaagacttcctcaggccatgctcccctaaaaatttaggatacctattgtctgttttctttgcggaaaaccactaactattcatagtagttgctctctttctgtgaattcaacagtgacaactggctaagaatggctttggtagtcctttgtttggttgggtcacgttatccatgtatgttattactcacctattattccatcatgaataacccttgacataactctgtaaggcatttattggagtttcgtttgtctagagtatggtaccacttccttgctgtttattcttctccctgtttttccatatctcactactcaaactgtccacagtctttcccttttgagccaagccatgtctatctcttccttttctgacatccagtagcatatgtaatctcaatcaggaatgttacttagaggcttgtatcttgtctaagcggagacttgtggtccacaattcgtggcagggagcatcataatagactctctgtctaaagaaaactcttctacacacattgcagaatgggttttctatttgtactccttaccaaatccgtatggcacctctaaagtgcagctttaacatctaatatgatgtatccaacattatttaccagcaaaacagccttctctcccctacacgtattttgtaggtgcctctccagtccatagaattcagcaaaagtagaatttctgccagaaggaaatagggggagtctgcacttggaatttatgaaatgaaatgatgacttctattaatgttgagaatctcatttgctgctttcgtattctccacggttcctaactcaattctaagggcaaaactcacccttaataaatagctgttctctgtttgtctatacttctgtttcatcgtgttattataataatgtgtttggtgataattaagtgttgaagaacatctattataaaacacacttattaatccttaatgtcacagactgaccttgtcattatatcagctttttactcactgcaagtaaatctagcattcttcatttttgaattcattctagtggtggaaacaatcataactataaaatgtttatatttcttgaatttattatactgaatgtgcatgcatgctttgtaataatttttttatcttgctgcttataacattttcttgttttttttccactgactagggaaagttggagactaatgaaatgcatggctataagattcctggccatagtcctcatataagcatctctgaatacagcgtgataaggaaagggaaaaattaacaaatttagttacaaaatattctatgttccctgtccttttcactttaaagcataaatggtggtcagaataatggtaataacaatggtttctggattctagtttattgccaacatttgtcaactttcacgtatttctttcttcttttatggaaggacagtaatgatgttcatcattggcaaggctaattgtgaaatttacttaacctttcttttagtagactttgaattttttcctacctcctctgaaatactatacagaaatttggggaagtatctgtaattctgagaaacagaagaaaaaaggtgattttcaagtgattctagaataggcactgttaagtttaatatttcttttccttctgaacttccacttttgtattttagcacctttgattttatgaggagggcttttcagctattgtaaaactagcttattttgctaatgtcttcctagtcaaattggaaacatgtaataggcttagtagcccagagaaggtaagaaaggtagaagtttgtgggttgatgtcctttttggaggcaaagaaaggaatgctagttattttatccttggtcaagttggtaacaaaaccaggcgttcctttgtttagcctatagacagagcactttctgcttaagcctctgctggcagttgactgctctttcaaaataggaattactttctactttacctcaaaacagaggtaaagtggagactagtaattgcattgaaaaaattatgtttaaaatatgttgcttgtgaaataaatagtgattggagaaaataagctagcctacaaggaatggcgagtgtgatgagtaagagcatgcatgcactctgggagcagacttcttatattcaaaatttgattctgataagagaatactattaacaactctatgtcgacacatttgttaggtgaaatggaccaattccttaaaagacacaatttgccagaactcacatgagaggaaataatttaaacaagcctatgtctgttaaagaaattgaattaataattaactctgtttaattttatgtgtaaacttgagtgggctgtgggtacctagattaaacatttttttctgagtgtgtctgtggggtctttctagctgagattagcatttgagtagttggactaagtaaagtagattgccctccccagtgtgagtagacatcgtctagtcagttgagagcctgaatagaacaaaaaatgaaagaaggaggaattcacctttttttcttgccttactgtctgagttgacaagtctcatctcatcttctgcccttggacaaggatttgcatagtcaggtccactgcttcttagaccctcagatttggactgagttacacccaggctttcctgggactcctgcttgtagatggaaaatcatgggacttctcagcctctccaatctagtgagccaattcctcttaataaaccaccccctgccccacaacacactcacagaggcataccttgttttattgtgcttcagtgtattatgcttcacagatattacatttttcacacattgaaggtttaaggcaaccctgcatctagtgagtctatcagcactgttttcccaacaacatatgctcactttgtgtttctttgtcacactttggtaattttcacaatatctcaaactttctcattattctctgtctattatgatgatctgtggtcagtgatctcttttttcttaactctgcagctttgtagcaattagcaatctttgatattactgttgtaattgtttcggggtgccataaacagccatataagatggcaaacttagcaaatgctgtgtgtgttccgactgctccactgatcagctgtttgcctgtctttctcccctctgtcctgcctgttccctgagacaaaacaatattgaaattaggccagttgataaccctgtaatagcctcaaagtattcaagtgaaagggaagagctacacatctcttgctttaaatcaaaagctagacatgattaagcttagtgaggaaggcatgttgaaagcctagataggccaaaagctaagcttcttggtgttaaacactcaagttgtgaatgaaaaggaaaagtttttgaaggagattagaagtgatactccagtgaacacacaacttataagagagtgaaacagccttatggctgatatggagaaagttttgatggtctggataaaagataaaaccggccacaacatttctgtaagccaaaacctaatctagagcagtgccctaatttttttcaattctgtgaagacagagaggcaaggaaggcacagaaaaatgtttgaagctagcagaggttggttcatgaggtttcaggaaggaagttgtcttcataacatgaaagtacaagataaagcagcaagtgctgatttagaagctgcagcaagttatgcagaagttctagctaagatcattgatgaaggtacatatactaaacaacagattttcaatggagatgaaaaacagccttctgtttgaagaaaatgccatctaggactttcatagctagagagaagtcaatgactggatccaaaggttcaaaggacaggctgactctcctgttaggagctaatgcagctggtgactttaagtggaaaccagcacccatttaccatcctgaaaatccttgagcccttaagaattacactaaagctcctctacctgtgctttgtaaatggaataacaaagcctgggtgatagcacatctgtttatagcagggtttactgaaaattttaagccacctgtcgagacctactgcttggaaaaaaaaagattcttttcgaaatattaatgctcattgacaatgcatttggccagccaagagtgctgatggagctgtacaaggagattaatgttgttttcatgacagctaatgaaactggatcctcatctctcaccttatagaaaaatcaactcaagattgttcaaagactttaatacctgaaaccataaaaattatagatgataaccctcacagcttagctcccacctgtgagtaagaacacatgatatttggttttccattactgagttacttcacttagaataatggtctccggttccatctgggttgctgtgaatgctgttatttcattcctttatatggctgagtagtattccatggtgtgtgtgtgtatgtgtgtgtgtgtgtgtgtgtgtgtgtgtgtgtgtatgtacatatacatacatacataccacaatttctttatccactcattgattgatgggcatttgggctggttccatacttttgcaattgcaaattgtgctgctataaacatgcatgtgaaagtatctttttcatataatgacattttttcctctgggtagatacccagtagtgggattgctggatcaaatggtagttctacttttactagtagttctttagggaatctccacactgttttccatagtggttgtactagtttacattcccagcaggagtgtaaaattgttccctttctacctcatccatgccaatatctattttttttattatggccattcttgcaggagtaaggtggtatcgcattgtggttttgaagtgatttcaccatttgatagcatttacccacatttattcattctgtggtctatcaatcaaggaataacttcaactatcaagtcttcctatttaagaaatacatttcataagtattgaaggaaattaaaaatgctactccagtgaacacacaacttatccttttcattcacaatttggctgtttgatgcattttgtcactgccatagagagtgattcctctgatggatcagggcaaagtccactgaaaatcttctggaaaggatttacaattccagatgccattaagaacatttttgtcataggaggaagtcaaaatattagcattaacagaaatttgtaagaagttgattccaacccttgtgcatgaccttgaggggttcaaggaagtcactgcagatgtgttggaaatagcaaaataactagacttggaaatttatatggaaccccccaaaaaagccttcatagccaaacaaggctaagtaaaaagaacaaatctggaggcttcacattacttgacttcaaactacactataaggccatagtcaccaaaacagcatggtcctggcataaaaataggcacatggaccaatgaaacagaatagagaacccagaaataaagccaaatacttacaaccacctgatcttcaacaaagcaaagaaaaagataaagtaagtggggaaaggacaccctatttaacaaaggtgctgggataattggcaaggtacatgtaatagaagaatgaaatggaatcatctctcaccttatacaaaaatcaactcaagatgtatcaagttcttaaatctaagacctgaaaccataaaaattctagaagataacattggaataacctttctagacgttggcttagggaaggacctcatgaccaagaacccaaaagcaactgcaacaaaaacaatgataaatagatgggacttaattaaactaaaaagcttctgcacagcaaaagaaaccatcagcggagtaaactgacaacccacagagtgggaaaaaatcttcacagtctgtacatctgacaaaggactaatatccagaatctgcaaggaactcaaacaaattagcaagaaaaaaacaaactatccaaccaaaaagtgggctaaggccatgggacaatttgccaaagaagacatacaagtggccaacacacatatgaaaaaatgctcaacatcactaatgattggggaaatacaaatcaataccacaatgcgataccatgttacttctgcaagaatggccataataaaaaaaatcaaaaaataatagatgttggcatggatgaggtagaaagggaacaattttacacctctggtgggaatgtaaactagtacaaccactatggaaaacagtgtggagattccttaaataactattaataaaagtagaactaccatttgatccagcaatcctactgctgggtctctacccagaggaaaagaagtcattatacaaaaagatactttcacatgtgtgtttatagcagcacaatttgtaattgcaaatatatggaaccagcccaaatgtccatcaatcaacgagtggataaagaaattgtggtatatattcatgtgtaccatgaaataatagccataaaaagcgttgaaatcatggtatttacagcaacctggatggagctggagaccattattctgagtgaagtaactcaggaatagaaaaacatcatgtgttctcactcacaggcgggagctaagctgtgagggttcaaaggtataaaaataatacaatggactttgggaaagtggggaaaggttggaagggggatgcgggataaaagactacatactggatacagtgtatactgctcaggtgatgggtgcaccaaaatctcacaaatcaccactaaagcacttatccatgtaaccaaacaccacctgttccccaaaaacctatggaaataaaaaaaagttaaaaaataattttaagatctcaggaaaaataacaacataaaaacaggagttttccaaataaagtgatttcactatttgatcagtgcattcaaaactttattaatataattcctttaagtgcttgtgtcttatgggtcatatttcagttttaagatctaatttttacttctcatttttgtgtatctacaagttttctgaaaaaatcatgggaaattccagtaatatttataccctagtttgacaaatgctcaatcatctttatcttagaagcttattctatcttaaaaaaatggagcctgaagatgtgattgaattgttgcaatctcatgataaaactttaacagataagaagttgcttcttctggatgagcaaagaaaatggtttcttgagatggaatctactcctggtgaagatgtgaacaatgttgaactgacaacaaaggatttagaatatcatatcaacttagatgataatagcaggatttgagaggattgactccaattttgaaagagtttctgctgtaggtaaatgctatcaaacagcattgcctgctacagagaaatctttcatgaaaggagtgtcaaagtagcaaacttcactgttgccatattaccacagccacacaagctgtcagtaaccattaacctgatcattcagcagccatcaacattgaggcaagaccttctattagcaaaaagatgatgactcactgaaggctcagatgatcgttagcatttttagccatgaagtgttttttactttaagatatgtactgtttttatataatgctactgcatacttaatagactacagtatagtgtaaatacaacttatatgcactgggaaaccaaaaaatatgtatgacttgctttattgagatttttaccttattttggtggtctggaagcaaatctctaatatctctgaggtatgtctgtatgtatacagtcagtcctccatatttgtgggttatgcagccatggattcaaccaaccacagattgaaaatattttgggaaaaaattttaaaaaaacacaatgataaaacatacaaatagaaacaatactatatttacatagcatttacgttgtgttaggtattgtatgtaatctagagatgatttaaggtatttgagagaatatttgtaggttacatgcaaatgctgtaccatcttatataagagacttaagcatttggggattttggtgtctggggggtgtcctggaaccaatcccagtcgatactgatgggttgaactaatatgggtgaagaacttagaatggttcctaacacatagtaaataaccaataaagggatagatattattattagtctattattatttttaaaagaaatatcacttgaagctttcttgaagtgatgttttgtgaaaaagaatctgaaaaataatattaccacattttgtaggatagaaaaatcaaatgcttatgtgtgtgtgtagttgtatctgtgtgatggagaattagaaaatgttaagatacagtggccaactggggagtaccctgtctataagtttcaatttagattaaaagccaaaatactatgatcaccaaaccatactcatttgtcagccagctttggtctatgaatcaccagttgcagtccctgatataaggtatacatgcatcaagcatagcttagttctataaaaagactgagtatttaaagctgtgctatctgtcatgctagccattagccccatgtggacatctaaattaaaattcagttcctcagtcacattaggtacaattcagatgctgaatagccacatgtggctgctactatgttgggtggtgcagatacaggacattttcatcattacagaaagttctattggatagagctgacctaatggcttgtaaatatattcattcattactgtctaccaacttacccattccttggtgagaaatcaccaagccagagccagcagacctgtaatacacagtactgtaagactggtcttatgctacttagctgttaatctgctcccaagcagcagcttacaagtttgtttttgaggttcccccaaccccatcaaagctcttggtttggtgactgtaggcctctggcattagttgattgtccaggttgaggagaaaattccataggggaacagagtaattcattttcccacatgaccttctgtcttgacttctaacaccatacttttagttttgcctattattaacttgatataaatggaatcatttatacattattataatgtattattataatgtatctattatatagatacattattaatagctttccaggcaagatggggaaaattgagttggggtatatatatgtttgcgtgtgtgtatttttttcacccactaggagaaatacatcagtgagaaaccttaaccttgaatattctctataaaatatataaaaggcatattaccttaggaattttttactgtgtcataatactgttgtatctcgtcgtggcaatcaacatttgctatcactagaataatgctttattgtttatgataggaaataacaaaattttaaccttaatggtgatttgaagaatttttactctgttagaacttaaccggagaaagcttgagctgggaggaggtgatataacggatcagatcccttagggctattcaggttagtggataggattgtttctcttttgccattcatgatggagcctgcatgttactccttaaacagagaaagtatagagtgagtgtgtatgtgctgtggtttctttagaaagagtggtagcatcaagtattatatggttaatgggaagtaaaaatttatacttccattcctgactcaataaatattagggataattctttatattttccctctttattgagggtttgcattggtaattgttccttcccctctccagcagaacctaatttattctaggccttgggcttgaggactaaggccaattttcattggtaaattaatttcaaacattaccctcccattagagtaaattcatcacttttccctaagggaaggtatgcagaggctttttgatctacctggaacagctgtttgcttaatcctttctcctggggctgtgtgttacagtagaaagaaagtgaacatcatgagacttgaattttagtcttggctttgataaattttttggattactttatgcaagctttggattactttattactccgttccttattttgtgtgtaaaatgaaggtaacagcagcaatgcccacctaatttgcaagaatgttgagaataatacatgcaaaagtgaaactgcttagagccctcaaaggaaagataacagatctcaggttgaggtttcatcacatttcagctatgcatgcttcattgttcaagcctcttagatgttaacaactatggagtgtttagatttcaggagaatcttattcttgaagtggtgtttgtgtggtttttgtgtctgtatatgttcatgtgttgtatttcttttcaataatgtgagtggtcagactacctatagggttttttaagcttctgggcaactctgaggcagagtataacttttttttttttttttttttcctcaggtggctaaagcaatcctagtgagacaatggcatgagtaatagtaacagaggagttaagcagttgtgattttctgctccaataatagaatggtaaaaatctttgttctttgttttggtttcttgggacagatggtcttggtggctgttgacattttctgtggactctctggtgcctcttgtgccctttgtcctctatgctaccctggttgaaccagggccgaagagtatccattttcctatcagttattttatgaagtttatcaggatgtctttgccttcgttatcattttatataaaaaaattgtgcctttaaatgtaatgtttgcttgctttttttttttttttttgagacggagtctcgctctgtcgcccaggctggagggcagtggcgcgatctcggctcactgcaagctccgcctcctgggttcacgccattctcctgcctgagcctcccgagtagctgggactacaggcgcccaccaccatgcccggctatttttttttattttttatttttagtagaaacggggtctcaccgttttagccaggatggtctctatctcctgacctcgtgatctgcctgccttggcctcccaaagtgctgggattacaggcgtgagccatcacgcccggcctaatgtttgctttttaaggttcttacaattttctcgtgaggaaccagggataaattccctgcgtttgagccatagaacaggacaacaaatggctgtatttactatgacatccaacactaatcctcctcattgactattaccaccctgtttaccagacccaaactttagcatgtagaccttttccccacttaacttgagtttctggtcaagttaaggattctgtaatctcccattttgtgggaacttcatttcttgtgttttggggctgagcatgctgctttcgtatccacttctttcagaagtctcaagttttcatgtagacacaagtccctgagacctgccgtgccccagcagatttcctgcagataagtactcctctgccttttcctcccacaaccgttgaattcttatagtaatttctgagcgcaacagtggcaatatcttattttcaatacaaaatacatttattatctgatatgtccaagaatctgtgttgcaagaaagacacagtgcgtttcagctctttggtaacattccttacattttacattttgccatttgcaaagcactttcacagcatgtttctgtgtatatatttaacatgtgtgtatatatacacatacacgggatagaattgctggttcatagaatttgcgtatgtttagaaaattgccaaaccagtcaacaatagaatggatgattaagttatggtgtattcctgaatccaagtatactgcatagtaatagaaataaatgaactatagctatatttaataatctgtataaaccttaccaacaaaagttggagcagaagaagccaaacacacacaaaatatacagtatcattctatttatatcaagttaacaataggcaaaactaaaagtgtggtgttagaagtcaagatagaagttaccttgaatgggggagggtagtgactaaaaaggggcacaaagaaggcttgtttaggaatctggtaatgttctgtttctggttttacaccatgtgctggttacaaaggtgtgttctttatcagaaatcattgagaagtatgcttgaggtgtgtgttttttatgtccacatacttcaaaacgctcacatgaaaatgtgaatttatagccagctttatcttatttataacaagtattggatttatttactgttgtaaataaattctttcttatttatccatcaatttaaagaacatttatttagttttacttctggattataacaaaatcatttcttgttgtcagtcttacttacataatccacacctcaacagccactttcttcatgaaactttataattactgctcttttgttgatatctaacctggataactgatttcatccctaaatcctcagattgtgcacgtatatgtttgttggatgcttctatgtttgttaattagttgcaagccattttgcacctagtcatatcgttgtcacaaaaccacagacaactttgaagagtaatgaattttctgaaggattaaattggaatgttgtgaggctccctctctagttcttagggggctggaggataggcgttgggttcagtatatcagagggtatgcactgtgcgaaggaaagttgtagttgatgtcgaggactgctgctgcttctggtctcaactggaagttgttttaggaggagagaaaagagaataattttaaaaattatttggaaggaaattactaatattgtttaagcagttgtagtaccttaaattcttaacaattttctcaaccctttagctaagaagttggtggaagcaactcctgacctcatgatccgcccgccttggcctcccaaagtgctgggattacaggcgtgagccactgcgcccggccatgtgcatttgttaagcagttaaaaacgttaagccaaaataaagaaacagtgatagcagagtagggagcgttgtgcccaaagagtgactgtactcttattgttttaccttgtcataaaaatgcttgttagtggtgaccctttctagattttctggttttaaactcaggagaatgactaatggggtaagaagtgcttttcaccagcagtatgacatacattggacacaaagtcataatcctataacatgactactatgtcagtcttattcaggaatagtaagggaggtgaaagcccattcttcaggactaagcattgagaaatctgtttgttgggcctcaaaagatttctttctttcctcctcttcttcttcttttttttttttaagtaaaataggctcattttagagattaaatctgttgtaaagtgctataaataggttgcaagtataagtgctatagaaaaattacaataatactatgctagcctagtgttttagtggttagtcttccatagcaatatgaaatttcggggggaagttgtgtgatttttttaaaaaaacattactgaattcatttttccggatttatatatatatatatgtttgtgtgtgtgtgtgtgtgtgtgcgtgtgtgtgtgtagccaatggttaataatgtacgtatattttttgtcttcccatctgtttcttgctactgcagttctgtggttgctatggagaaggttatgataaggaaaagcacaataaggttaaaagttcttctctgtatctgggacagaaataacagtctcctaccacaccatccttttttacgccctctgccctcatgtgatgatcttcaatactgcagtgcctgttgctgacgggaagatggtttgatgctatatttaaaaaaattacacagaggagctaattctcttcttttttgcttcttttaaggttgatgactttcatcattttaatctaggcacagaacagaaggagacaataagcatattaggatgaattgtcaacccaggacatttctggtttgtgtgggtggttttttcctttaatttcatttgtgtgtttaaaattttatttattttttatttgctgatatgaggtaagaaaagcttagagaaaggacctgatgtggaacagttgggatttagttaatctgcttagaaataacactaatctctagatcagatgctgtcaacaatacagtgccttctatccccattatcttcctctattctttccttgcttattcttccggcactctgtggtttcatttagtcttatcttttcatttcctaccaatttttgttttttaacatttctttcctacttctcatttacatttcatttttgaatttcaccacggcttcatcatgggaagttttttgactactctgaggtgacagggtggaaagcatagatatgtaataactcatgccaaaataagcttcttcctaatatatgcttaagagtaactttgtattacttttaataatcacagttgtaggtctctgtcaaaataagagtatgaccacaattttcttgagaagtttgatgctactgggacgattatatgactaggtgaatacatgctattttctttcctctgttttctggttttttttccctgcttatttgtatgttaggttattttttgagatcaaattcaattgctatttattaaaaacctcctttgtgcaaggcatttaatgtatttttcttcaaagtgattttgtgaggcagatatttttatgccttttcttaaagatgtcaaaaaactaaagccaacaagttaaaataatgtgccccaggctacacaattagtcagtagctgtacctggattctatgtcctgtgctcttttcagcattcctcagaggctttaagtaggagttaggaaaggctctggagtcacactagacattgttttgaatcccagttccatctctgggtctcagtttcctcatctgtaaaatacgattaataatcatatcacctccaagtcttgtttgttactaagctttatataaaccgcctaaaacaatacttggcacataagttcttgatgaatagcatcaagtacattgaacatcaaatatattgaacatttactgtattatggtctctgtgtgctgagacccgagcatataggttctacttagaatcaaattgagaaaggcctctattaagagaatttaaagtgtcgtgactatatcaaggaagtacagggtgtcatgagggcatttaaaaaggaagggtagtctgttctggaggtcagcagaattttgaaatctgaaggatgggtagaaatgagagggatcgtgtgtgtgtgtgtgtgtgtgtgtgtgtgtgtgtgtgtgtgtgtgtgtgtatttcaagctaaggcaatagaccacataaatcttagatgggagagtgcagtgtgttgctgaacctgagaaaagcccactgtggaagaaagtactgtaagactggctggaagaacaggcaaaggtcagattaagcagagccttgaaggtcatagaaagtaaacctagatacattgtattagaacctaatgatgatgccatattacctctatctctattcctagacttcaagagaacttctaaaaggataaccaaactctttacttccacatttaaaatatttgtatgttaaaaactgaagaatgctttaaactagttagaagttaaattagtactaacacaaacatatctaaaaatcaagaaaaattttaaaaatagtgtttaatttggaaagaagcagtgttactggtgaacaagaataaaatatttcagttgagccatttttaaaaagaatttaattggtttcagaatgtaacatccttcctgatggtttcagatggctttatttgttcataaataactctacttgttgatttagccacttttgtcatatgaatgcttcattaaacaaatggagcttgctcattatagccaagtagagctatattcaaccaagtggtgaagttgagagtacatggttgtatttaacagcaaaggccctttatctggcctcttgccatctggaaactctagatagcatttcccaatataaatctcaatgtagtaaccagactgataaggacatgcaactatagcatcacaatgtcagagagtgttctgtatacaggaaagaaaaatacattcttctcaccctattcattatccaagttaaaagcctagattttcagaagtcctttagaaagctaagcagcaagaaattttattttctctgaaaaaggccagtcacatggaagttcagatttggctagagggttatcattgtaataaaagacaatcctgaaatagcgaaaaaatagcccctagattctgtcagttttctctgcccattccctgccttgtctttaaactatgatttctgaaatttttgaaagcacagagatcttttttaaagtccttatataatgcttagggcattaagatttatttttaaactttactcatcatttctaggctccacaaagttttgtaagaaatgtctatctgttttttaaaatgtcaagttgaattcaaatctgagacccctttttaaaaaaatcattgtgataattatcaattattgaggctcccctctatatgctgcagtctgtcttacagagccacaatgctgggaggacccctctggtcttctgtggagtaactgctttttgttcgagccccttgttcaagcccgcaggatcctttgtgttgctctgcagcttctgtgccttgtaggacacatggaatgttgtgatgaccagagctccagtctccaggacagccatactctttgaggcaccattatttcctttgtcctctgagcaaaggagagcatgcatctcctcttgtcaaggaacttggccaacttccattcccctcccagtagtattttttctcctttatcaggctcaaaggcagcccctcctacctcctctgccccactgtagcttcctcagtgagcataggcttcacaagagacaggaagcctgttggtcttcagtagtttcatcttttcaccctgcaaagccgacaagataaaggaatacacagacaacttgacaaagataggcttagaagaggtaggagagaagaaggagaaagacataattgttattgttttcatttgttgcttgctgtagtcagcatagtcgtattcatggctgacaaatcatattttgaatagtatttctatttggaggaattcccacattatgagtctacctccccagtgttagaaatgagaacttaaatttctggcctcttgtgtagcttggacttcggcccttcagtcagattcacatagagagtctctggccctgacttgaaagaagaaacttgaaagaagaaacgtgacagaacaagttctatgttgagcttctattgctagcacagatagcagcataagagtatggctttgcaggatggtagtgttgtagggttaagtgcctgatatagcactgggacatcattcgtagttgcagtaaagttttggcatttggggtttggtgacagggacagttgcagcaattttcttaagccagttttacagtatagttatggatgttttcctggaagattagcccttaatttgtttttcaagccatttccatgattctgtgagcttcccaacatacctttttctaaaaaaacatttttttaaagtataacttacatacaataaaatccctctgtctaggtatatagtttgctatgttttgacaaatgtctcgtcttgtgttcactaccataaccgtgatgtacactatttctgtaactccaaggacttcccttatgccctatgtagtattctctgccaaactttaaccctcagtcccagctccagcatctggcaactgctgctttgttttctgcctgtatagttttgctttctccgtagatttttttttaatggatacatgcagtatatagccatttgtttctggattatttcacttagcacaatagctttaacatttagtcattttgcatatatcagaagtttgaggttttttttgttcataagtaatatttcattaaatggctgtgtcacaattgttttatccatttgcaagttgatgggcatttgagttgtgtctggtattttggctattacaaataaagatgcagtgaacatttgcatataggtttttctgtagatctgtatctttacttgtcttgcataaatatctagaattggaattgctagattgtatagttaagtgtacatttaattctgtaataaaatatgaaaatgtttccaaatgactgtactacatttcatttccttcagaaatgtatgagagttagttgttctacattctcgtcaacacttagcattgtcgtgttaatataatatattctagttgatgttttgtattatctcaatgtggttttaagttccctgttgactaatgaagtggagcatcgtttcaggatgttattactcatttgtatactttctatgcatagtgaagtgtctgttcaaatcttttgtgcatttaaaaaattggactgtttgttttgttgaattttaagagtttttagatattataaatacaagaacttgtgttttgaaaatattttttcccaacctatggcttgtatttttattttcttaatagtgtcttttgaagacaagaaacttaccttgttttattattgttttattatcaaaacaataattttgatgaggtcttacccatttttaagtggttaatgcattttgtatcctattccagaaggctttttctaacccagagtcatagagaatttctcctgtgttttcttccagaagttttatagttttattgatatgtttaaattttttatctattttgagttaatttttatataaagtattaaataagggtagaggtgtttttttttttttttttggcatatggagattattttttcccccagtgcagtttttcaaaaagagtaaacttttccccctgaatggctttgacaactttgttggaaatcaattgcccatttatgtatgaatcaatttttggactctctatatgtccttattccaatgctactttatctatattactttataacttactttttttcttgaaaattattctattctaatattcacttttgtacatacatttcaggagcaatttgtctatacaaaacagctcactgaaaatttgatttgggttctattaaatctaaagataaatttgggttgacttgacctcctaacagtattgagtcttttgactaatggtcacagtttgtctctccaggcagtaaagtctttaaatttctctcaggaaaattttgtaattttcattgcacagatcttacagatattttctgaaggttatccctaagtatttcatgttttggatgctattataagtggtatcattttaaaattttaatttccaaatattcattgctactgtatagaaaaatcgttgctatttgtatattagccttgatttctgaaaccttgctaaactcatttattagaattagttggttttttgtagacttgtaagaatttttaatgtagatgtgttatctgcaaataaatacagttttactttgaaattttcaatctatatgtcttttaattcttattcttgccttattgcagtgactacaatctgcatgttaaatagaagtggcaagagcagacatctctccttgttccttactgtaggaggaaaatcttttaccattaaatttgttagctgtttgaattattggtactgataatatctctttgttcttcttttaatgtctgtaggatctgtaattatgtctcttctttcatatctgaattgataatttgtgacttttctctttattctttgtcagtctggttagagatttataaattttattgacctcagataactaaattttgattttattgatttaccctgttgtttttctgtctttattgaattctactctgtcttgatactttgcttctgtatgcctgcatttgatttaatttaaattaatttttaaaaagtttcttaaggtggaaacttaggtcattgattataaacctttcttcttttctaatatgcacatttagatgctgctgttacttttctctaagtaatgctttggttgcttccccataaattttgataagttgtgttttcatactcacataattaaaaatattttctaatcttccttgtgatttcttctttgacctgtgaattatttagaagtgatttttttttttttgagacggagtcttgctctgtcacccaggctagagtgcagtggcacgatcttggctcactgcaacctttgcctcctgggttcaagcaattctcctacctcagcctcccaagtagctgggactacaggcatatgccaccatacccggctaatttttatatttttagtagagatggggtttcgccatgttggccaggctggtcttgaactcctgacctcaggtgatccacctgccttggcgtcccaaagtgctgggattacaggcttgagccaccacacctggcccgaagtgatttaaaaaaaaaaatacatgatggttttctagatttcttcctattgagtttagtttaactcatgttctttgtataactttaattatttaaaaatttctgaagttcattttatagtccagaatatgttctgccttattggatgttccatgtctactttaaaataatatatattctatggtgttaggtagaacatcctaaagttttcatttatgttaagttcattgttcaggtcttctgtgtttttactgtttttgtctgttctataagttaatgattgagacgtgttgcagtcaccaaccataattgcaggtttttcactttttctccttttaattctgtcagtgtttccttcttgtactttgaagctctgttgtgaggtgcatacacaggactgttaggttcttgatgagtcagcacgccgttttatcattatgtaatatccctctctatgcctgttttagttatttgactcttctttcttcacatgctactgctttcccaaactctttgctttcccaaactatattatcttataagttacctcataattaggtgtccagcctctccttggtgaaatgctgatttctggtacaatcacttgtagccaggatgtaaataagatcctatgtcataaaccatagtgactcatgttcaaggaattgcttctttctcctttctctgaagtcagttttgagtgtggtagcaatcatagtagcatgtccatcataacactgcaaagcctggttctgcttttgtgccttggttctttatggctaattataatcacattacttgcttagttttaaataaggggttgcaaacataaatgcccacaggagtcagacaggtaacatgatggagtaaagtgggttatatcgtggaataacaggaagtgggtggggatcctggcagtgtggaaagctcctgctttgtctaaaggggcagcactaatcaatggccatgcgaaatgcaggcctggtgttactaaatgccccccaaaaggggattcctaaatggagtagaatacgtaagctgatagccagatatgaagtcaggaggaagtgataataggaaacttgctgaagagaattctgataaagttcacaccaagtttttggagatactgctgagttaatgctacccacgtaatatatatgccatgacatgtaggaatcaagtaagcatgtatacacacacatatgtatatacacatatgcatatgtacacacacacacacacacacattttatatatatatatatgagagagagagagagatatcttttggaaagtgacaaagaggagtgataatctaaagagtgtgcattagttcagtataaggcatgctctttgcccttgggatggtctctgagcaatgtttgtggttgaaggggagaagtcaatgagaaagcactgaaattatatctaaagggaaactgtagtaccatagaaatagaatacaattacatattacagccagactattacatgttacatagactgtgtaatgaatgtttaatgcttcagccagaaaatgaagatatataattttatggtagcttgccgttgtacaccaaccataaaatatattgtgatatggcataaaatgaagtagaagcttggcagtgatcctgtaaattgattaatgtagatgaccaatatgtaatagagccatctatattgataaattagtcagctattactcttcatttcacttagcactgagtagatggccaaaatataattgaatttcagctaacacaaacttttttttttagttgagatggcagtttgtaaaaagattatatggtaagtataaaggtagattatttcatctaattaaaatttggttaaaatatgaagggagaatgatttgtttaaaaaactactacaacactagagaattgtggtattccttagtttccttcagaaaacaaggaggatagtgtacaatttttattttttgaactcatgtcagtctgataaactataaaacttaatttgataggttatataaatttgtattacatgtatttatgtgagaaatacttgtgagatcatatgggatgatataaactaataagcattttgtgaccactgatattgacattttaggcagaaggataacataggcctcccaaagtgccataaaggtctttttgatgctttgctgattatattcccagagggaagtgttctggcagttgggctaatcctgaaacatgagcacttgcttcatagtcatcagagaacactgttgtgaaatctccattggattgcttgggccagtccccattgtgaacatccaacgttcaatctctgatgagtttgcaggggggatttcatgtcatttgactctagtagtaggcagatcacagtaaaatgtccattgtctgttctcttggctgtgtagtgtggatggtacctcctaggatttttaaagattctttgttgccagcttcatttcccctaacatgtaccaagaggtttgaaataatgtgaatgcctttctgctttaaatcttgggaaacaggagtctaaagaaagattatagacaactgtatttatgactttaactcctcagaggaaatatgaccatgcactttatatcctttttatgtaattgctgagagtcattcagaattcatggagttgactgaagtgaaagtacaaagaaaagattcaagtgcaaaatgctgtcactttggctcttaaattatgcattttacatgtaaatattgcaaattgtaagatgttttaaatttttttttttttttttgagatgaaatctcactttgtcgcccaggttggattgcagtagtgcaatcttggctcactgcaacttctacctcccaggttaaagcgactctcctgcctcagcctcccaagtagctgggactacaggcacctgccaccacgcctggctaatttttgtatttttggtagagatggagtttcaccatgttggccaggctggtctcgaactcccgacctcaagtgatctgcctgcctcagcctcccaaagtgctgggattacaagtgtgagccactgcacccagcctaagtggatttttaacctaatatttagcattcaagtttaaattcttgcctagaatttcaaacatggaaatatcctttaagaggaaatagagtttttggtttttttaataggatagaaaaaattttagcatcaaaaatgcaaaaaaacacccatttccctccttcttactctaagaaactttttattactctaagaaactttttattacacatagttctatcaatatactaaagaggaaccatgagacacattcacagagtaacttaatttcgtcttctgcatacctttaaattcattcatgagtcagttctttccctagatgagaactaaagcaggttatacaacttttctgatcactttgaatttaaaaaatgaaacagaataagaaaatcttaatttatatacagaattataagtatgactccctgatggccagtgagataccctctaggagtctagatatccggcttcaactttcctctactgaggtcccatcagcgagccctcttgttaggcctaagaagaccctgcaccagctttcatgtgtgttcacctccaaggtgggaatagagcgagtgagtcttttagtgtaccgcagccctaatttaaaagttctctccacaaagcctctttacagactttcacccctgactcatttattccctttgtgtagtcctcaaagttatataaccaattttcagccatcttccttgtgcaaattcttcagggcagtttgtcttaaaagtctcttttggcatctgatatatatatgtacacacacacatatacatacgtatatgtatatacgtatgtatatgtgtgtgtgtatgtgtgtgtgtgtgtgtgtgtatatatctcagggtgtatatacatgtatatatatatatatctcagggtgtatatacatatatatatatatatatgtatatacaccctgatatttcctcagggtgtgtgtatatatttatatatatatacatatatatatgtatatacaccctgatatttcatgtggaaattgaagtaattggattagatcaatttagcaacatgtatgtattgagttcccatggtgtgctttcttagaccatacagtatactaatgaggatttgttatataatcgcaaggtatgattaaaagcttggtggtgttctgacactactttgtgagactctgacctagactgagaggtcagggcttttcttgtgagaaggtatcacttgagctattgtaaatgatgagtaggttactaagtaaagaagctggggtttatgagtaggttactaagtaaagaagttgaggtttggaacaaagcaaaccagacagaggaaagacagaaaacagagcaaagactcagattccaggagtcaagagaaatttagttggtaaaatgtgccagatttgatcatggattgggtttgggagatgatgacagagttgacttgaaggtctctaaatgtctggcttgcccagcttggccctgttcgagccattcacaaccatagggaacatcaggaaggagccagagtatatttgggaggtgggcatgcaaaggaatagtttgatcttggacaagcacacttttgaggtgcctttgaggtagccacatggtgaagtctaggaggcaattggatataagaggagaggttttgagtagagatataaatttgaaagccattagcatttatatgagaattgaattcatgatggtaagtgaaattctgtagggagatagtttagaataaggcatcaaggcagtactttcagaaataccaacattcagtatccatgtggaaaagggtaaaacagcaagaggaagtgagaagtgtccagagagttgggaggaaaaccagaagtgaattatattaacatcactgaagctaagggaaaggtgtgttttaaggaagagggaagggtcatctctgtcagatgtttaccagagtccaagaatgattacaagtgtcatacagccacaaggaggtatctgggaagcctagggaaaattgtttttaagaaatgattggggcagaagtagattgaagactatggagcaggaatagattctgtggagagactatagagagtgctttcaaaaagattaacgtgaagtatcagagagctagggcctccctggtgaggactgtggggtgtagggaagtaggaattttgttttcagtttaaatacttgaggatgtttaaatgctatcaggaagtctccagtgcagagaaaggggttgaagttatgggagggggaagtctatgataaggtcactaagggggccaagcagatggtatttgaagctcacgtacagggttggtcctagataaactcctctaaactgacaggagagagggagatgagggtgaggcggactgaaactgattcgcagattgagaagcaggaagtagaaggagtttctaactcctttacgtaaaagtccattctagttttaaagtttgtcatcatataatattgtagtgataataataacagcaaacacatatggaatgatttctgtgtgttgagttatgtgtagtagtaagtgtgtgttccttatagactaaccgcctgggtttgaagccagaccttaccacttcctagctttgcgactgtgcgaccttgagctgtatttttaattctctgtttttctattcttctgtaaaatgaaaataatgtcagtaagtaccttataggattaaatgagtttgtgtatacatatgtgtgtgtgtgtgtatatatatatatatatataaaaaatacatgttatatgtagagagagcttaatgtggacttggtgtagtcagtgtgacctaaatattagctagcaatagtagtggtggtggtagtcatcctcagcgtctggtactgccctcatcataccccttgtatgatgtgatgataatatttagctctgttttacagatgaagcaacagactcagagattaagttacttgtttggggacatgcagctaaatagatgaaagtaccacattttaaacccgatttgtacagtttcaaacctacacctttgcaagttctgaaagcagctcatctagaatatttcttcttcagatatttcagaatgtgagattttaggattgaccttatgtaaaaacatgaagtaagtgaagttggcctttcacaacttctgctgccccagaggcttgctctgtgccaaccgtcctgttgccttcctggcttccagccctgtcccacacagctccttgtcctctgctcaccctgttgcggttgctttctctttctctttcattcttagttcatattggtcattttaaaaaatttgtatcaaagattgtttgagttaagcttgaaattagtgaattgctggtggagggtacttacaatcccgtgtagtttaagttggcattatatttcctttacctcttccttgaagtattgtctcaagaaggcagtgatggaggttcggcaccagtttggcttccacacttattcttaaaaacatctctatcagcatttattttaaatttatcatatcactataacaaatacattctctaacccatttctaccttatgaggtagctcattctgttcattgcctgctccatgatcaagtaaccttccctttctgtcactaattgttgaggttctttcaacttcttttttaaaatttagagacttcccctaatgttatttatcttagaaacttttcctgatgtcatcaaatgctttatgttctatcacagacagtttatgaaacattttattctgcaaatttaactcctgagaacatcatcagactatacgtgaagaacatgacgttctgtacagggaaggtgttatgcatgtttattttttaaactaattgtaatcataacagtatgttattctgttacttttttgagagaattgagatactatcacttcaaagtaaaacagtttgagatactgtcatagactgaatgtatttttcatgatctaaaataacttctttgtagggtctccatggcctattttgatctactgttatttccatactgtttcatcatcccagggaggagcctttgcagaagagaaaacagttattttgacttcccatgagttggctctggtgaatcagttttcttttttagaattttaagtgttgttgacatataatttatattccataaaattactcctttgaagtataaaattcagtgacttttggccaggtgcggtggctcacgcctgtaatcccaccactttgggaggccaaggtggccagatcacgaggtcaggagatcgagatcaccctggctaacacggtgaaaccccgtctctactaaaaatacaaaaaaattagctgggcatggtggcgggcgcctgtagtcccatctacttgggaggctgaggcaggagaatggcatgaacctgggaggcagagcttgcagtgagccaagattgtgccactgcactccagcctggcaacagagcgagactgtctcaaaaaaaaaaaaaaaatcagtgacttttaagcttgcagagttgtacaaccatcacaggaacctagttttccatcactaaaaagtcccagtaagtctatttacaagtccctatgcctgtgtatccccgggtggtactaatctattttctgtctctatagatttgccttttctagacattttatatgtgtggaatgcagtgttttgcatctggcttctttgagaaatatgttttgggaggctcgtgcatgttgtaagatgtatcagtactttgatggtttttgtttctgaacagtattctgttgtatggatagatcacattttgtttgtccattcaccagttgatggatatttgtattatttccttttcaggacatgatataaataatgctgttatgaacattcatggacaagtcgttgtgtggacatacattttcattttacttgagtagattcctagtaaacgaaattgctgactacttgtatgttacgatgatttaggtttatgaacattttctgttgatttttatttaggtctgtgatcattttctgttgattttatattcagaatatttaatttttggcatattactatcaaattatcccagcaccatttgttgaaaagactatttttgccccatgtagttgtcttgtacctttattgagaagcatttgaccataaatataaagatttatttcagtactctcaaccctgtgacatttatctatatgtctatccttaaaaagctagtaccatactgtcctactacagctatatagcaagttttaaaattgggtagtgtgaattcttcatctttgttcttatttttcagtattcttttggctattctagttctttgtctttctatattttttagaatttgtcaacatttgcaaaaagactactgggattttgactgggctagctctgaatctatagatcaatttagggacaattggcatcttaagattgactctcccagttcatgaacgttacatatctctgcatttatttagtcttactgatttcttttattagcattgtatactcttcttgtatgggtgctgtacatattttgttagatttatgtgatttgttagatttatatgtaagcatttaattttgcagtgtgcttatgtaacaacactttgaaaattcagtttatttttaatctttcatcaaaccccatcagttgaattcatctgtgtcgtatttgaatctggccacatatcagatagcatcttccaaaagatagtaaagagcttctaatatttttctattgtagttttcaggaggtaaagggatgaaccatttttattattttgactcagtgactggtcagcagttgttaagactatcatgtcagtctgttcacataatcaataataatgtgataacataaaacacgcaaaccttcctgaaggagtttggactgttgggaaagggcgagcatataacctccctgttccttcttctgtaggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtatttctgttgcatcctgtgctacctctaaaaggttaatcttttcagaggaggttggtagggaagcatcatgagtacatctttggtttcgagaataaggtggcattgtcaatgtgcgtgtactcttttaaggcctactcctctgccctatcagtcacttatcagaagaggctatcctctttttaaaaaggtaacagatgttaagaatatccttctgagaggtttatgtaggaacctgtaattttatcaacaacattgctaataggcaattttgaccagaagggactggcaccatcacagattgttgagagcatacttttaaaagatagtgataatagtaaggaagtaacattaggttgtagtacttgattttttttaagttaatttcactagtattttaaagtaaaacatgactagccatgttagtgagctcaaagagtctcatataaattattaatagaatgtgtacgtgaaagaatgtacatgaaaatggaagctactccccagtaagctgtatcaattacaggaaaaagacacataatttgtagaactcactgcagaaaataatgctcaggaagttaatgaattgtgataatgattacacctttatttacaatgttaatggagcttttctccttcagtaagattattattacctcaaaatatttgataagctaaattttctgatatgaaattaaatagaagcttcttttgtttcttcatagaatttttgtagttagactccgccttcaagatcattttgttcaaccttattattttaggaatcaaggatggagtttaagtaaagagcttgagtagagttactaaacacatttacaggtagagcttgaatagaactgagtccctcactcgcagcccaaagggctttttgttatgtcattctaagtcttccatgaagacttaactttgatagtagaggctgacataagaacagtaatcatggacttgtaactctacttcccttctgtgacatttatttacattcagtctgtacctatgatctatcattgtgtgacctaataagcatgagaatggcagtgctaatattttttaatttttgttttggaatcagttttttgaactggtaagaatatttatgaactgatagtagggtgggcagcagcaaagactttttttatgttctgatgtgttaggtaaggaaaaaatattattctaatttgttatgtgagaatttaaaaccccaagatacctatgaacaaatactgtaaaaaaaaagttgatgataattatcatattagaaataaaattttccaatgtttggtgcagcatttggtactgtctaccaaatagttattgttttgtgtctaggagaggatagagtggccagtttatttattttgctttcttttccaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttaggtgagtgacacaagagtccttggctgttcgggctttactcacgaagctactctcaagcatacttgcttctgcccttgtttctacaccttcagtctgcttatgttctttttctgtcttctctcagttccatctcttctctccttctccatgcttcttacagatagtctccccctcctttcttcatttccggcggtctctaaaacttacttatttaatgactttcttctgaaggtgaagaaagatggtatcaaataccatcagaagtggtctctcacttttcttaagcttctacagtacagaacttattgttgagagcaaattaaatcaagaatgacttattttagtacagagcagaagttttagcatgtgtgagaataatactattacttcatatctgtgtaacaccgagtaggatcaccacagttcttggcttgcacgtgttgtcctggcataattgtaataatacctccttttactcccccaagtatccttgtttgaagaataaatcatattatcaccttaatactgagaccaaatagatttaggttttttttccccagattgcatagaaaataaacaacaacgtttagattaaaatttagatctccttactcaaaccagcactctttccattacaccatgttgttagactgtctcacactaatatccattataagcatgttttatttttcaattcttctgtctctaatataaaatactgctttctaaatgaatacttgtggtagaggtggctaaactcagttcatctggggagatggaagacgttttgagaaggttgatgttcttgattctcctccatcctactcaagtctcagaatctactcccgcagtccttgtcaaactccacccccgctttctttttccttcgttgttgttgagtcacttaagaatacaggtgttgggaattcttgtcattttccctcggcctttggtgcctttttctcccagccttcaaacagaataaaaaaactgatgaccaagtcggggatttctattctcaaaaccatattcattgtattatattaaaaattgtatagattataaaatactctgagtaccgagtatagtgtactaatggaattaaatattctgatacttagacctgtaagttaggtgactggcttcccatattatccaaccttatttcttttttgtttgtccagacttaacttctcagcatcatttttaaaaagaagataaaaagcccttaatttattttataattaatgctacctccaaagaattattttgggtttctcttcctggcatcacagtggcaatgacaaaggcaaacaaagattagtttgccccaccgcagtagttaggattctctaagatttttactcttcctacctatatccttttattgttctctcttcccctacccacttttttttttcctgattcctgtgtatactctgcattcattttttcattcattcatttattcattttggaaagggtgaacatatttactgaaaagtcattagcattacaaataaatcataaattagacttaaactctaccatctgtattccccagcatgaaacttcaagccatgggcttagtttatggttttgttttgtttttttccttgttactatatatcaccaccttcttcctttagtgttctttttggtaatttttgttccatgttttttgtgtcctgccttaatgattgtgaaatgttcactacattattatccactctgcttttacctgaaccttagtttaactttctccaccataaagcagaatttggtataaagtgggtctgcccagtttttgtttgtaaagtaacaaagggccttgttaaagtggttttcgccagggcaggataatggttgtttttccctgaaatcttgaaaagtggcctctttcagcaatgtttttaaaagcaacatgttgatacaatggatcttaagaattcttctttagaggaagcagagtgaaaggaagatcttaagataccttggaactataatcaaagagtgaagcccctttgtacatatttgccccctgcttaccaaagctgcaggcctgctcctgtgcctaagcctcgtgaattggtacatgcctcccctgggttcaggcggtgagtctgtctcctggtatatgttcccaaaacagtgtaatctaagggtccaatgtactgaatgttgatgtctcctccatcatcacatggctcacagtaaaatgtgtactttattgcttattcttcctgttatagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcagggtatgtacagtgctgctttacccattttattagttatcatggacaattctaatattcaaaaagtaattaactttaataggttttgaaaaataacaccctataactgctgaaaaagctttctggatcattttgtgttttcaaatttaaagtgaataaaagattttctctctcttctctatattgcctttatgaaatgtatttcatccagtggtaactatatatggaaactgttcccattcacgtgaagatttaaagcacctaaatgatagcttctttgtgttaactgtaagataatccttgaaatttatatctgagaatacacttcctgcttgaggtagagctgcctattttactaggagaaacgtgagcatagtgtcaggagggttgatcctcctgctttcagcctcaaatctggttagaggaggaagataagaaagagtaaaggaaaaggcctcaggtcacaggagatccaggaattggtcacaccaaacaggtaataatggaggaagactgagggtcatggatgatttctacgtgtaaacccagctgcttaaatttagttttaaataggacatccttaaaaaattgaagagattttgtcaaataaaatgaggggaagatatagaattttattataaaatactctaggtcaagaaaatgaaatttagcagcttcgaatattacgtcatctctaatacagaaaatgtttcttgtagtattctcagggtagatttacaaatctgaaagttaaccataaagtgttggcagttaatggagaggccacaaacaaccttaattatgccttgtaagtctgaatcatgttgatagtccacacctgtcatggaaaaggaaagtcctaagttgtagtaaaattattcacattaaagagccagcgccacaagcctcttaagagcctataaatttccgctagtaatcccagcaaatgttgatggaccttacaatagtcttttaattaacctagcctcaaattcatcatttaaaaaaaacttcttttcaacataataacttttattactttaagagtgattcctgcaatactgttgttcattgctaaatgtttcagccacattgttggctaaatagctgcttttgtggaatgatttgtcaatctcaccattgtaagtgacatgattaaaatagcccttgtcttgacatactgaaaactatattcaaattttagattttccactgtttctgtaacagttcacttctctgggcccttgttgcttttttttaaacaaaaataaaggggtatcatcctcaaggtcctctgtggcagtattttctttttttatttataatatctctgtgaaatattggttggagtttggaattttaagtgaacaattgacagtggttatttgtatgtaagttgagaaatagctgtagaaagagccttccataacctctttatttctggatgagtgtatatcagtcagatttcttgatatcatatccttttttcaacttgaatactctttgcaactttaggtataaaagtgaacttgaatgagacggatgaaaactttgtcttctataaaatctggattgattatcaaagttactttggataaccatatctattaatcatgtacattaaatggtaatatttttaatctaaatttatctcttgatacccatattaataaagttgatctcaaaatagaatattgctccaaaataatttagatttttttcagaagatttactttactaattatgtttaaaattattaatataaactcatgatgcattttctgaaaaaagaatatttgacaccaggaaagtgaatcccggaagtctgattggtgacagaggaataatattttgagatttgaatttctcttatatgtagagactagcttgagggaactcgctctggccaaatctaggacaattcaaacattaaatatatagtccatagaataaaataagaatcaccaaatccctactgataaataaatggggtcaaagggcaagctgttttttttcacagtatgatgccaactaatgtgtatacaaggaatcatggagttagaaaatcatcattgaggtgaaaacagcaaaagtttgatgggaagcaggctatttagttacaaagtatgtccccacaaattgcttattaatgacaaaaaagtaacttcgtaagggagagacctgttggataccactttaaccaagtgatcaaagtaaacttcaccaatattgtgacaaactgctatcacgtacctcctaatatatgtactgagaaggacacatcatttctgtgatattgctgtcaaaaacacataacctaaatctcattatgaggaaacctcaaacaaacaaacgtgaaggcaaaactgttcaaattgaaaaagactagggagttaaccctgaggttgcaatttttttattttttgcaatcagaccttggcgatgaccttgagcagtaggatgtaaataactcccacatgcttagcgttccaataatggaacactgggcataagtgggttaagatgactagatgtaatgaagaatcttggcttagaatctgaacaggaaaagaaatagctataaaggacatggttgagataattgatgaaacaatataaactatagattagctaatactattagatcagagttaaatttctcgactttgatacgtgtactgtcattacataaaatgtgtctttgttcttaggaagtattcactaaagtacttagtggtaaaaaggcatgatgtcttcaaccttataaaagagactgagcgcactaactagttcctttcaccaagtaaggactgtgaagcaagtttactgtgcactggttacttgcccgagtctggtgagacagagcattcatacacaaaacaagtttcatgaagtggatttattatttaataggcagcaaaggacaacagaagcctagcattcattgaaagccagttccccaaggctcagaaaagcttcctggaacagatagagtctcttatgcacatgtccacttgcacgtcagctgagagaacccggaaagcagctcactctgagttttatacctgagtatcactgcattaaagtgtttaaggacatcctgtttctaggagggtctggaacagagcctgaggtgttccagtcagttccttcttaactcaggatgttgcattcccagcatgttctatagttattcttgagaacagcaagcaagaaagtgggaagaactgagttggtcccagaccacccaaagaactgtcctgaaagggcacagcaagaagacatcatcatctggaaaccaggaaatgggctcttaccagacactgaatctgctggggtcttaatcttggagctcccagccttccagaactatgagaaataaatttctgttgcttataaaatacccagttgatggtgttttgttatagcagcctaaacagataagacaatgaggagtctaaaatagttgaactggtagaaacagagaataaaatggtggtttccatgggctggggagtgggggaaatggggagatgtgggttaaagggtacaaagttgcagttattcaggatgaataaatcctggagatctaatgtacactatggtgcctatatttagcattactgtattgtatgctagaaatttgctgggaggagatcttaactgttcccagccacacacacacacacacacaaaggtagttatgtgatgtgattgacatgttaattagattggttgtggtaatcttttcacagtatatatgtatatcaaaatatataccataaatatatacaatttttgttagtcaattgtgcttcaataaagctggggaagaaagaaaaacaattgcataatgcacaaggaaagccctcgcaacaaataattatctgggaccaaatttcaataaataagttacacttaacgttttctattgctaaaacatccctgcatttatggaataaagtctttttgattgtgatttttaaaaataaattgttccattgggtttgccaatattataataaaatatttgcatcagtgatcaccagtgagaatggcctatgggttttttttttctgtcttctattgtcctggttcaattttagtatcatataataccaaataattttatgagtttggcagcttttccttttttctattctttgaaatagtatgaataagttgggcatcatgatgattctatagaatttgcctactaaaatttgccttgctcttatgttttttggtagatttttgactactgatttaatttctctaatggtacagattttctctaccctatttttctggaaaatgtgttttttgtccaagttatacatatcaccatcaagatgttcatagaattctctatacaaaaacagaataatgtatgtaagagtgtaagttctggagacagtggacatagttttgaaccctgaatccaggaatcactgggtatgtgcccttgtgtcttagttttcttatatgtaaaatggagacaatcatcgtgactaacttatggttggatgaagactgaatgaataagcatgtaagatgtgcagaacagcagctggcatgtgtaagtccctactaaatattaatatttaaattaccatcattattctcttatgaagttttaaactctgtatttagtctccttttcattcctaatactgtttatatgtgcctttcctctatttttaaaatctatcttgctaaactcagattttgattttatctaaccttttgtaacttgcataaatttccttcctccctcccgccaatgtttgttaagcacctatcaggtgccagaaactgttctaggtgctgaagatacattgctgaacaggatagatattcttccctttgtagagcttacattctaatggttggagatggaatataatcagcaaattgcagaatttgttacaaggtgaaaagttctgtggggaaaaattagatcagggtaagacagattagttaggggatgaggagcagcaattttgagtaaggtgcttagggtaagcctcattatattctaacaaatatttaaagataatgaaggaatgagccatgtgaatatggggactggagagcattccaggtagagggaatggacatatgaaggctttgaggcaggcgtgtgcccatgtacttgatgaatatcaaagaggccagtgtgtttggagtgcagccagcaaggtggagaatttaagagccattatattgcaggtgttagggtatttgtacatgcattgcataggaagcattataattgtattattcaatatgctatatctttagcaatattttacatgcttcagctatgttattatgagaaatatgtgtttaaaaatcacactgtaagactgtggatttgtcaatttgttcttataattatgccaattttctttacccattttgagtgtgtgtcattagatgcttacaagcttgttatatttcgtttttctctgtgtttaataagctttttgtgttatttttaattattaaaattaaaagatgcagtggctttctttggtcaattcttgttggtacgttactattgtatggttcattggcattcagttctccatgctttatgttttaggtgtattgcttataaacaacatatatctggatttagatgggttttcaatctgtcatctgagagcttctgtcctctgaaatcattgattatgggtatggttcaatgtctaatattttattggaggttttctatttatttatttatttatttatttaatttatttattttttgatatttaaagaggtcttttatttaaatcatcttgtatcatgtctgacacattattgtttttttttttatactttaagttttagggtacatgtgcacattgtgcaggttagttacatatgtatacatgtgccatgctggtgctctgcacccactaactcgtcatctagccttaggtatatctcccaatgctatccctcccccctccccccaccccaccacagtccccagagtgtggtattccccttcatgtgtccaggtgatctcattgttcaattcccacctatgagtgagaatatacggtgtttggttttttgttcttgcgatagtttactgagaatgatgatttccaatttcatccatgtccctacaaaggatatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatataccaagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaaactctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacatttaaatctttaatccatcttgaattgatttttctataaggtgtaaggaagggatccagtttcagctttctacatatggctagccagttttcccagccccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctctttttttgttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctcctcgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccttttatttccttctcctgcctgattgccctggccagaactcccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgggataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggcctaaaattctcttttttggttgtgtctctgcccggctttggtatcagaatgatgttggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgatggtagtttgtatttctgtgggatcggtggtgatacccctttatcattttttattgtgtctgtttgattcttctctctttttttctttattagtcttgctagtggtctatcaattttgttgatcctttcagaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctgctatgttgtgtctttgttctcattggtttcaaagaacatctttatttctgccttcatttccttatgtacccagtagtcatccaggagcaggttgttcagtttccatgtagctgagcagttttgagtgagattcttaatcctgagttctagtttgattgcactgtggtctgagagacagtttgttataatttctgttctttcacatttgctgaggagagctttacttccaactatgtggtcaattttggaataggtgtggtgtggtgctgaaaaaaatgtatattctgttgatttggggtggagagttctgtagatgtctattcggtccacttggtgcagagctgagttcaattcctgggtatccttgttgactttctgtctcgttgatctgtctaatgttgacagtggggtgttaaagtctcccattattaatgtttgggagtctaagtctctttgtaggtcactcaggacttgctttatgaatcagggtgctcctgtattgggtgcatatatatttaggatagttagctcctcttgttgaattgatccctttaccattatgtaatggccttcattgtctcttttgatctttgttggtttaaagtctgttttatcagagactaggattgcaacccctgccttttttagttttccatttgcttggtagatcttcctccatccttttattttgagcctatgtgtatctctgcacgtgagatgggtttcctgaatacagcacactgatgggtcttgactctttatccaactcgccagtctgtgtcttttaattggagcatttagtccatttacatttaaagttaatagtgttatgtgtgaatttgatcctgtcattatgatgttagctggtgattttgctcgttagttgatgcagtttcttcctagtctcgatggtctttacattttggcatgattttgcagcggctgctaccggttgttcctttccatgtttagcgcttccttcaggagctcttttagggcaggcttggtggtgacaaaatctctcagcatttgcttgtctgtaaagtattttatttctccttcacttatgaagcttagtttggctggatatgaaattctgggttgaaaattcttttctttaagaatgttgaatatcggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacattggcctgccttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatctttctccatccagctttgttccattgctggtgaggaactgtgttcctttggaggaggagaggcgctctgcattttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgcagtgtgaggtgtcactgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtgtgcagaggttactgctgtctttttgtttgtctgtgccctgcccccagaggtggagcctacagaggcaggcaggcctccttgagctgtggtgggctccacccagttggagcttcccggctgctttgtttacctaagcaagcctgggcaatggtgggcgcccctcccccagcctcgctgccgccttgcagtttgatctcagactgctgtgctagcaatcagcgagactccgtgggcgtaggaccctccgagccaggtgtgggatatagtctcgtggtgcgccgttttttaagccggtctgaaaagcgccatattcgggtgggagtgacccgattttccaggtgcgtccgtcacccctttctttgactcggaaagagaactccctgaccccttgcgcttcccaggtgaggcaatgcctcgccctgcttcggctcgcacacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccccgattttctatttattaagcttttttctttatgccccctcttcccatatcttctactgattatttgaatattctttataatattttttctcctctactttcagagttataagtgtatttctcttcgtgcttattcttaaagttctcaaatgcatacttgatttaatgtagtctagaagtaaaaaaaaactctactctctatccaaataataggaccatagaaagctgtctttcttccattttccctaatccttgtgaatatttcgtctcatcagttctttctcttctctcctattagccattttttggaccttttcattcagtccaccataactctcagcttctgtctgatatgtttaatttctgtgtttgtattgtctgcattttagttattttcttggctttagtatatttgttccaccttatttttaacttttctccttattaatcatccccattttcatcatcgtttacgtatacattacggttttatttagatttacccacaagtttgccattttttttgctccattgcttctttcatcacagtcattttttctgtgttccattttcttatagtaaagtacacacacccttcagtaggtattacattgatgatctatgagtgttgttgttctcatgtttgtttttctgaaaatatcttttttccctacactctttaatgcagtttagtgagtataaatgctaggttatcagttattgtttctcaagaatttgaaaatgtttcattttcttcccacctttcttgtttctgttgagaaatctgctggtagtctgtaggcatttgtgttttccttcctttgctttttgcagttgttttgtacttggtgttctgtagatcctagaatatattttaggtatgtgttaatttttattaatcctgctatgggcttgtggtgcttcttaaattgagagattgtattttttgtcacttctggaaaaatctctgtccttatatttttgaatatagccttttctcttctttctttattgtttcctgttagctcttggtttagtcttttaattctgtaaaccatgtttttttaatcctttgcttatccgtaaatgtctttaccttctttacctttctgtgtggcattctggttttttttttgtttttgttttttatttttccagatcacctgttctctcttctactctgatggctgttcagcttatccattgagttttgaatttattttcttcttttctttccttcttttaagagatggagtctcgttctgtcatccaggctgcagtgcagtggcacaatcactgctcactgcaacttcaaactcctggcccttaagcaatcctcctacctcagcctcccgagtagctgggattacagatgtgagccacagcacctggctatttctatgttgcctttgtctcttcatggcatcatcctcttttattatggtgactattctgtatatgtttaataattgtaagcatactaattttatagtgaccttcacataactttatgctctttgtatgctaatcctcctgtttgttgtgtagttaacttttcttcatggtgatattcctttcctgtttccctcatgtgaacgcttcacctggattgttctatagtttctctaagctgtaggttatgttttctatttgtttctgccaacagctctagaggttttgggaagatgaagggatgagcaaaacaggaaagggatgattgtccatacagtgagtgtggtcgggcggctgggccctgtactggtgagtgagatgattggagatgtgaggcaacacgggatttgtcctgcagcaattgaaaatccagggctggagctagctcacaggagctgcatatcaagccatggagtggaattccttcctggaatgacacccactctccaagtcctgcagcttcttggcaaccaaggatggagataagcacagttgtttctcacaatggtcagtaaaacttgaactcagaaaggaaagctgagggataattagaaaaaaaacacctcccttctgacttaaaggggagaataaccttcacactttaaagatgcacagagaactttaaaatgtgtttttaaaaattatatgcaaataatggcaattcattttctatccattcttttatcttggtaaatataaagtatagtgtatttattttcattattaatggttaacattttctgaaactagattatacgtttttctttcatggtttgtaagaaatcctctgttttcctcatcctttcataatttaatacagtgaagagagatgattatctctcgtgcttgcctgtgaactctgtgtagatctttagagatcatagctatagcaggagagtatcttaaatatcaccatggtcccactctcatgttacaagggagaagactgaggctcctagaagagaccaggtttgcccaaaactgataggaaggactaaaattcttttggcgtggttgtaacactcaggaatcttgatattctctctctctctctttctctctctctctctctgtgtctcctctcctctctctcactttctatctcttctctctcctctctcctctttgttctctctctctctcttctctcattttttagagacaaagtcttgctctgttacccacccaggctggagtgcagtggcatgatgacagcttactgtaacctcacactcctgggctcaagttatcttcctgccttagtgtcctgatggggccttgctatgttgaccaagctggtctcaaatgcgtcggcctcccaaagtgctgggactataggtgtgagccaccacacgcagcctgattctgtttcttgaactgacactgctgtttcccctcccagtaagagtggttccataatttttttcatggggagcagaaaattttcacccactaaaagtgctgaataaacaagtgcttatttctccttcatcaagatgttattctaactgaagttgagttttttctccctttttttttgccctctgacatgaagcaaaccccatatagtgttcagtacttcctcttttttaaaagattaaatgtcaacagttataactgtattaatttgtgtatatattcattcatttttacatatatgtgtgtgtgtgtgcacacacacataaacatacaccttactctgcaactgcttcagagttgagtgttggggcaggtggagaaatacaaggaaacatatctccatcctagagctcactgcctaatggaggagacagatataaagagaaaatcatagcactacatgttaatgctatgaaaatgtatgcagtgctataaaatttaaatgatagaaatattacttgttcctgaagagtccaggaagaactttgtagggaaaaggattcccaagcaggaaaaggttcttaaatgatggatagaagttttactggttaaaagtgggtattataaatacagggaactatgcttgcaaaatcttgcaagtgtaaaagtttgacatttttagtgagaagatctgtgaagctgacataaaggttcgtggggatttgaccagagaggagctggaaaaggtgaagtccagattgtgaaaggctttatataatatgcaaggagtttggatgttatctttaactgtagagatgcactgacatttataaacaagagatcaccagatacgcattttagaaactgtgtcagtaatcaggctgaaagattggcagccagtcataaatggaaggctttgttaatagccccatcaagaaatgacaaggacctgaactaagtccctagtgacaggggtggagaaggcacagtgggggagggtaagattcaagagagattgaggaaaatattacaatatatggggctcgattagatgtttaaactcagaagagtcagagttaactcagattcctgttgtggggcactgaatcaacagtaaccatcttaactcagaagagaaatttgtagaagtttgcttgaggaaagcagtgagttagtggtctcctgggacctctatatggggattgaaataatgataatggtaacatttcttgaacaccatgtgccattctttgagaattaaagagcaacagtcaacatagagatatactgattcagaagaatcttgatgtccagttaaacctaaaagcagagtcaacagaagtgggtaggagagaagcagtcaaaatctaattagttggtcttgcttgtagcttttgccatgtgataagtgtgtggtcatggccttcttgtatgttgctaatgatgaatcattcttgcaaagaaatactaatgtatttatacacactacattattcaaataatgctgagtaatgttcattggtattttcacaagtttgaatatttgctataagcttcagctccttgtgaatacttgaatggcagaaacacaaatagaagagggtgagaatgttgctctgcagtatactaacatgacatcagaaatgaatctaaaatctgatttggcaaaagcaatatctgtttcaatgccaaaccaaaatcagggcaaacagacaaaatatttttatcattgtctaaaggcactgagctgctgtgaagcaggatgtatcctaacatccatctggacggtgcccttggaaattctattaatgggaacaggttctttccctgtcccttctccatctatgccttaattcagccagcatcaacacaaaatgaaataaaattttctgtgtccaatgttatattttaaatttatctttaatagagtttgatattaagtatttgtgatgtcatctttaagtttttccacagatttttgacatttattttgtatttccctttatttacaatttttaaaaaattaaatatctttttcaggttaggatcatttttacatattattgaaatatataattttgatgtaacatattcattcaaataacaagtatacatccattattatatagcctacagaatacttctgaaacttttatataagaaatgttcagtttattatagttactcattatttaaaatatataagtcatatgaaaatatataattatgatttaagaattcttatctaactcttcaaatcctgaagatcaatatctattgggaattaatatccattgggagacactagacatttttcatatttcttgactgaatttttttatgattcggaaaaatatatcagttcccctagaagtaccaggaaggaattcccacatggaaacattaccatatactatactaacctttcatttagtcctcacagtaatctacagtttgtaggcactttggtagctccatattacagatgaggaaactaaaatatagatgaagaacagggaacacactcaagaccatatgaccagtagtaggtagaatagactcaaacttaggctgtctaactggaacatgctcttagcagatacatcagctactaggcagccagaggcagcattctggaactaaggagaaaggatggaactggaaatgtacactaacatttgtttttttctaattcagaagggccttctgtgccagatacgtagctggtgaaccaagtgcatagttgctatgaactaaaacagtggagtgtgaggtcctttgagttccccaaactatgtagtttcatgccattgaactttccctattctttaaaagaagctaaaaaatatatttattctctatttcagaaaaatacttccctgcctgagcagaccaagtgaaatgacagatggcagaattagcctgctagttttgggaagggctatgtgctttgtggctgcaaacagtctgctgtttgctggagttgctctcttctctattttgccttgtcacataaacagggctgttttgttctggttaatcttctgttatcaatgtacctgtctccttccctgattatattccaagttaaatctaccatggtatatcaacttcatttaataatattatcttacagaaacatggtcatagtattggcatctatagagacaaaaggaagacattgacttcaccttttaaaaataacttttcaaagcaagagtctttacagtttacctctttctacatgccagaatgctgcgtagaggagctgtttaaaatttcccaaattgtctctggaaatgtcaacaaaattaccagtttggtgtgagctcatcaaatttttagaattccagagcttaggggaaaacccaccaccaccactaccaacaacaacaacaaaaaccccaggaacacaaattatgtggttgattgcccagagattatggttttcttgcgttgatgatattagtacatgtgtacatgaagagggagataggcacattgcttagtttatattactaacagcattggaacatttattggtcaggaaatattctataggtgcatcctctagaataatgtggttttaaatgccttactagagtgccaagtgtatgtatggtgagtataagctttggacttggacaaacctcattttatagattgctgctacttgtgtactctgtgatcttggacaaatttcatagcttttttgagttatctttgaaaagtagggaatatagaacataagcttgttacgaacattaaatgaggcatatttaatgctgttagtgcagtgtatgtggtacacaacagacgctaaagagtaggcagcacttttatttattgatcacttttatttagcacctttctgtgtgcctggcaatttctgagacagcaattattttctcctcccctgtagtctatttgatttctcaatccctcattagatgtccctcctgtatgctcccctatccccctctgttctctagcactggctggcacttattccatatattgtaattgtgtgtatacttgtctcattagggtaagggactgggcctgtcttgttcattattttatcaccatcctcagaaaaccaagcacaaaggaagatgctcaataaatatttatttattaaatgaatgaattaataaatgctgcacactttactcagatctgcttttgctgactcctcgtgtctgcttctgcctttgatctagatagagatgatgattgccagcagaaaccagttaactaaatcttagttccatgtaaaaataagtaacccaggatggggatagctctaggtgttgccccaggcatacttggactttgtgtcagaatatttttttacttgtcctgttaggaggcttttccatttacttctaaatttgcagctattttgaatggttgagatgacagaatgtattctctttcctgcataaggagggcagtgaagcctagagcttagaggtgagacagccccttcatccaattgaatttcctaacaaccagctgtgtaatcttattaaacatctaaagcttcagtctccttgactgttcaatgagattaataataaaaatacctcagggtaattgtaaagattgaaataatacatataaaagcttacccaatgcctggaacatactaataactattaactttttaaagttattcctgtaagtcatttgtattttataggaataaataatcaaactatgctaatgttgatgaattactaaaatgtgaactattgaagcatttcttggcaataccagtgcagtggccttgaaaatttgttgttcaaactcctgatgtggggaacataattgactgaaagccatgctgcttcccctgtagatccaccactgctttgcaccaagaccaagcttcccctgggctgctcccagccagtgatgaggaattagggttagggttagggcctaatgcaggcctatttctgcaaagcatgggactcccttaacaggtgactttggctcagggactccccatctgcctggtggacacttccataaaactgtgttgcagcctgagactcttcctacccaatcttccttgcttccctgtccccttgacagtgagtggtgagatctacaccgaagtctgaggctctccctgccttctgcagcttcctctcacatttcctttactggtatttcctccaggcaacctcacacttgtcttggtgtctgcttcttggaggatctgagctaacacaaacaactgtaattgttgttgttagggagtaacagtctataccttagagcacagatttgatattttcttcatcaggtatgaagttaaagttattataagtttaacatgatctttatgttattgcagttcctcagaactagaatttggtgttaccttaaattccctaggataagtattagctaccatttcctcagggaagtctactaacatttaggactttacatgcttacctgcagattcagttttaagattgttctgatttaggacagcgctccaaagttccaggtctttaaagtgatatagtagttttagtctttaacattcatgaaccaataatttctcaccctacccccacaaaaaagaaatttattgatagctctccagtgttcgtctgtttttatggtcttccgctgatttctttggttttgctattagtcccgccaaatcctcactcggttattatttttgtgacagaccaggtccagggaacagtcaccatccggaacatcagtgccctgtcttcaggtttgtaccagtgcgtggcttctaatgctattggaaccagcacctgtcttctggatctccaggttatttcacgtaagcatatggaaattctgatgtcaaccatgggtctgaaactctaagatctttgttataccagaaaatgaagggttctgctgaattgtcttaaggttatctgaagattaaatagaaattgttttggttttaattattattgaaaattgtttataaatgttttagtatactttccagcctcagcaatatgataatctttatgaaaaaatatctttctcctcaggatcaataaagttggatagtttcttattgtataatgctatagacattataaaaatggtaataatcttatgagtatagtaagactttcttgtgttttttccttgtttcttttatctgcaaaattttggggtgtctaggttataaatggcagtgtagaaaacttctctttagttgagaattctgggatatttgaattccagttgcaaaagggagtgatctggctgggttgaggtagaaggatatcccctagtttccagcattcatgtagggtagaccaggcaagttagattggtgctgtctgttacctaatgtgggtattgttctcctaaaatgtgcaagtcatttaattgtttattcattcaaaatatgttcagagcctactatgtgttagtcctagccactgacaatatagaaagttaattgaggtttaactttatatagatgaaagattttagagagttttatacgttttaagcagattatttagtaagcttatgtgcttattacagttgcatgggtatatgctatttctctctttctcttttctttaaatatatcttaaatatattttgcagcccagcccaggaacattggactaatagctggagccattggcactggtgcagttattatcattttttgcattgcactaattttaggggcattcttttactggagaagcaaaaataaagaggaggaagaagaagaaattcctaatgaaataaggtttgtatgtcagatttttaaaatttgtcctgcatagccattgtgtacttctattcatttgtgtcagttaagatatatctactaatcataaaactctgatggccgagactattaaagtggctaaatggtattttcttgtatatcacttttcttcatggtactactcagctttattcactggatcatgaaggagggaaaggtccagcatgtgcccaactaggaggatacaaatgaagagttctccttatcttccgtgtctccagggtaggcagggttaggtggctgccacaatgggaaaggtagtgtctaaaacgtgtttactattgacatttataatagatgtgaacataaagcaagaaggaactccgtaagagcataccagtgcctgtacacagtcagaccacagcactatggctcagaaaggtagttcagacaagaatatgaacatcttaagaaaacaatgccaacatcatctttaaagaaaagtgactctagtcatactggggagatttgagggttcgggctcagtctcagatttcatcatggcatatctttattgaaaatgctgtaatgactccagtctccatagtgagacataccacagccttacaggatctgattcttgcctgcgtatcttctctctcatcactctcagctcactttgccttccagtctgtcctgcattttcccattgctcagggcttttgctcaagcctctgctctcttcctggaccatgcttttcatttgatccatctctttactaaattccttgatctgattctagattaggccaggcatcacctcctcacataagttgtctttagccccttgcctaacctttcagactcgtaaacattcttgcactgattactaccctcattgactataggtttcttaggtgtaggatttgtgtcttttttacatgaaacatattgtaaagtgtacccaataaatgttaaatgaattggttagcatcttaaattaaataaatgacttcttttagactgttgtaattcttaagcgtttgggccatatgcagggatagagtctaccccaggataagattactgaggaaaacctctcatcagcaccccacagtgatttctcaaactccaaagggtaatacaatcaggccaactctgattatttctttaagttctgcatacctatagtttgatttcccagctattttatggcacctagtttagtagatttcttcatggactaatttcctacttacagtaaatatttatgtgtgaataaatatttactatatatgaatactatatatataaagcaagatactaaatatttactatatatataaagcaagatttgttatatatttactatatgatatataaacatatttatgtgaatgttatttacatatatgtttaaaagttgtattggaagagacattctctgagagatctgagatttccttttctactgttggagactgagaagctgaggagagattttcttgaccgttgtctcaaagggaatggataccaaagctgaggccatccagggttgccatgcctgctttcacgatagagtagtctctcctggatttgttttttggatgtataagccctgacatgaaaagaaagattccagggtaggaggataggattaacttgaagtaaatcctaacaacgactttattttgttcctttcagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatataaaa

SEQ ID NO: 80 - DNA, 2909 bp, Homo sapiens
catattagtgtctaagccctgcaatcaggcatgtcagccacgtgatggaatgggagggctgcagggcagcactgtccagtagaaacgaaatgcaagccacatatgtcattttaagttttctttttttgagatggagtttcactctatcacccaggctggagtgcagtggcacgatctcgcctcactgcaacctccgcctcccaggttcatgtgattctcctgcctcagcctcctgagtagctgggattacaggcatatgccaccatgcctggctaatttttgtatttttagtagagatggggtttcaccatgttgatcaggctggtctggaactactgacctcaggccacccgccttggcctcccaaagtgctgggattacaggcatgagccaccgcgcccagctaatttttgtatttttattttatttatttatttattttttgggagacggagtcttgctctgtcacccaggctggagtgcagttgtgcgatcttggctcactgcaacctcagcctcccaagtagctgggattacaggcatgcaccatcatgcccagctaatttttgtatttttagtagagatggggtttcactgtgttggccaggctggtcttgaactcctgacctcaggtgatccaccggcctcagcctcccaaagtgctgggattataggcgtgagccactgcacccgtcctaatttttgtatttttagtagagatggggtttcaccatgttggctaagctggtctggaactcatggcctcaagttatctgcccacctcagcctcccaaagtgctgagtaagccaagttttctaatagccacattagacaagtaaaaggaaacaggttaaattcattttaacatgttttacttaacccaatgtatccaaaatagcatttcaacatgtcatcggttttttagttttttttttttttgagatagtgcttcgctttgttgcccaggctggagtgcagtggcacaatctcggctcactgcaacctccaccttccaggttcaagtgattctcctgcctcagcctcccgagtagctgggattacaggcacccgccaccatgcccactaatttttgtatttttggttagagatggggtttcgccatgttggccaggctagtctcaaactcctgacctcaggtgatccacccacctcggcctcccaaagtgctaggattacaggcgtgaggcaccgtgcctggcgtcatcggtattatttaaatgaattatgttacgttcttttgtgctgtcttcaaaatctgttatatattttacacttacaccaaatctcaattaccatggtacatttttatctgaaatgcttgacctttattttgatttcataaaattcatagttggagaagtagattcacatatccaagttgttccaattatataatagttttccaaaaactgagatgggtgtccattttttttttaagtaaagatgcaggtctggttatgttgaccaagttgctgggttgttttgttttgttttgagacagagtctcactttgtcacccaggctggagtgcagtggcatgacctcagctcactgcaacctctgcctcccaggttcaactgattctcttgcatcatcctcctgagtagctgggactacaggtgtatgccaccatgcctggctaattttggtatttttctcagagacggggtttcaccatgttgggcatgctggtcttgaactgctgacctcaggtgatccgcccacctcggcctcccaaagtgctggtattacaggcatgggccaccacacctggcctcagctgttcaattaaaagtaaatacaacttaaaattctatgtttcattggcagtagtgcaacattaatactgagtagccacatgtgattagtggctatggtattggacagggaaggtacagaatacttccatcaacatagaaaattctatcagtctatctctaggggcagatagtccttccactgacttgggcaagtcactctacaaatggcatctacctcacatggttatggtgagaattcagcgtatgtatgtacatgcaggcacacaatatgcacacagacacataacatagtacaccctttcctgaaaagcctgacacatggagctcaaacatgagtgccacccacccctgggcagcaccaagatggctctagtctgggtgcctttgtctcacccccatgcctttgctcggagtgtgctcctcatttttctgccactttgaccctgtctctgatttggtcctgtctgacatcactgctatatgctttgctcctctcaatttcctctgccctcatgccagcaggagtcatgccagagatcatatctgagaaagcaagacaattttgtgtgtgtgtctgtgcccatagaggagtgctggttgtgttgatatagttgtagattggttgtgtttacacagttgtatatattgacacccttgagtgttatgacttcttttgggggtggtcgccttttaaatcataacttttaatgggattccattttagtctttgtgaagacataaggttgttggcaggcatctgtccctgggagcatccaagcagaaaagactaagactcccttgtagacagatcactggccgccactgaagtgtgtctgcatggcaccacagggctggaagacccttgaaggcaggaattcaaggaaatgtatgatgaattttggcattgccatcaaaagcagaacaggcatggaaaacttgggtgagtgggcgagacaacctcctcaccacagcagagttccatccatgcctggataatgatggagggatttgtgtccactgcagtggggaaccatgaaggacacatcaagggtgtggttggcctgtggtgctctttggaggaatgaataaaaatgaatagaaatcct

SEQ ID NO: 81 - DNA, 7587 bp, Homo sapiens
acgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtggtgagtccggtgcccggggcggggcggagggagccaggggaggtgggtagagcccgaggccccccagtagccgaccctggcgtcgcgctgtctccccagggggagataatcgagggctgccgcctacccgtgctgcggcggaaccaggacaacgaagatgagtggcgtgagtgacgttggggggcgggactaaggaacctgagggcgaggggcgggagtcaactgaaatcccgggatggggaggggcgtctggaattatggggcgggcgaggcgcagatactttgatgaaggggcgtggctcttagctgctccgagaggtacagggcggggcctggaaaggggtggcacttgtgactgaaggaggcttaggagagacctaagtgctggagcttagggatccggcctgggggtggagttcaggtcgtggaagggtggagtctcatagcctggcctgtctaaggcccctgtctatgctattctcatagccctggccgagatcctgagcgtgaaggacatcagtggccggaagcttttctacgtccattacattgactgtgagttctgggcctgaggtggggcatcagggtagggttgggggacagtctttggcattctgtcctgagccatccccactgctacagtcaacaaacgtctggatgaatgggtgacgcatgagcggctggacctaaagaagatccagttccccaagaaagaggccaagacccccactaagaacggacttcctgggtcccgtcctggctctccagagagagaggtggtgagtaggtcccccacttcaccttttctctcctgcctcctatttctcttgtctgttggcattaggagctcctggatgggcaggaggcggctccctctcaccctgacttcatcttgcaaaggatgggggccaaattgcacatgtagctcccagagtccagtagctagtcctgtgtccttcagaaggcgagggtggggtttgataattttgaggtgagggacccctcttccccttccccatcccactgccatccccgccccaaaggaagaccctggacctatctctacagccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacggtaccctcagcaattccagggaccttgctttcttctcaggtcccaccttctctaccttctgacccacctttgttggtttctctctgcagaaacggaaggtggaggtggtttcaccagcaactccagtgcccagcgagacagccccggcctcggtttttccccaggtgagttccccaaaccatctcttgttctcttcctctcttctactctctggtggcttttttcaggctcatttcacagccatcccttcttttcctactatctcggcagaatggagccgcccgtagggcagtggcagcccagccaggacggaagcgaaaatcgaattgtttgggcactgatgaggtgggtctggggagcagcagaagggaactgggtgaaaaggaagggatgcaggcagggtggagagttatttagtgatgagtttaaaaataaagaaggggtggtgggcagagctagtgttggtgggattaggagacaggcagaacattgttcaaatgagtcattggggccgggcaccatggctcatacctgtaatcccagcactttgggagtccaaccaaggctggtggatcacctgaggtcaggagtttgagaccagcctggccaacatggtgaaaccttgtttctactagaaatacaaaaattagccaggcgtggtggcgggtgcctgtaatccagctcggaaagctgaggcaggagaactgcttgaaccccggaggtggagattgcagtgagccaagatcgcgctactgccctccagcctgggcgacagactgagactccatctaaaaaatggggtcattgggtgatcttttccacatcatcgatcctttagggtttcaggttttttatctggaaattggggatcatggtacctcccccttagggttgctgttaggcttgaaggaaacctgtcaaagggctgtgagctgtggtgtcctgctgagctgtctcttacaacctggtattttccactggccctgggcaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttggtatgaggggtccagggaggctgccttcccagcaccctccacgttgcccttgttcctgatcctcctctcttccccagaccaagtgtgacctacgacatcctccaggcaatgagatttaccgcaagggcaccatctccttctttgagattgatggacgtaagaacaaggttagtgcttgagaggcagtgaggcgctggggtgaatcaaatgacagcttcttcttgctcaggtaaacactgaccagtcaagccagcagatcagtccagcccatttttattgagttcctgctgtctggcaggtgctggtagccaggaatgagacagtctctgttctctgacagcttagtccatgggagagacagtcataccaatgacctctagctcccagtgtcctaagtgtcatgaaacagagggtaggttagcaggacccaaaggaggtggtcagcagagcttcatagagggttacctttcagccttggtggatgacaaagtggctgaggggatttcttgcagtggtgttctgaagagtaggcatggatgcacaaaggtggtctttgtgaaaggcagagatcattctggttgggaggcagaaaagggaggatgagggaaggctcgtacatgggacagagcttaggtgatgaagatgctgtgttaaccaccattttgtaattattaatgtggacctgggcatccaagtggcagtacccagcagcaggcggttaaaaagcaattcctgggctgggcacggtggctcacacctgtaatcccagcactttgggaggctgaggcgggcggatcacaaggtcaggagatcgagaccatcctggctaacacggttaaaccctgtctctactaaaaagtacaaaaaattagctgggcgtggtggcgggtgcctgtaatcccagctactcgggaggctgaggcaggagaatggcgtgaacccaggaggcagagtttgcagtgagccgagattgcaccactgcattccagcctgggagacagcaagacttcgtgtaaaaaaaataaataaataaaaagcaatttctggctgggcacagtggctcatacctgtaaccccagcactttgggaggccaaggtgggccaatcacttgagcccagaatttcgagaccagcctgggcaacatggagaaacccccaggtactcgggaggctgagttgggagaatcacctgagcctgggaagtcaaggctgcagtgacccacgattgcatgattgcaccactgcactccagcctgggtgacaggagtgagaccctgtgtcaaaaaaaaaaaaaaaaaacccacaatgtctgaaatgcaggagaaatcgtgtgcagaagtaaagcagcaggattcataattttgctggggtaaaccctaaggcagttattttgttaaattccagaattccttaactctgttgtagagtagcagatcagttcccaggaggtgtgactgtggatgtagaatgttaggttttttaacagctagactcccaagactgttagatagggagtcagtggtcagagtctcactttggacacattagtttgaggagccgtggtcagagtctcactttggacacattagttcgttggctgctgttaaaaaacattaaaaggcagtggtctctcctggtcaggcttagaatggaggtgtgcggagcaaggcgggaaacttgcctgactgagcagggaggcactcagacaccatcacacatctggcacacaggcttttcaacactgaggagcagccctgcctaagctgcgggctggtggagtgggtcaggcccagccagggaagaacactcatcacctagcagcctggggcatagcacgaacagtgaagctcctggttgaccctgaaccactggccaggctcaaggcgggatacccagagtggtgacaagccttttctcttgcagagttattcccagaacctgtgtcttttggccaagtgtttccttgaccataagacactgtactatgacacagaccctttcctcttctacgtcatgacagagtatgactgtaagggcttccacatcgtgggctacttctccaaggtcagtgcctgcccaagctgtccctgtgccctgtcctgagccagatcccttccctgacactcacctgtcccccttctccaggagaaagaatcaacggaagactacaatgtggcctgcatcctaaccctgcctccctaccagcgccggggctacggcaagctgctgatcgagttcagtgagtatgtgtgctgcggccagggggtagtggacccactatcggtgcctcacaggcagatgggccaggctactgtgattctcaaccctggctgtgcagcccagcctctaggggaaccagccagaaataacagtggcactctcccggggttctctccgttcaggctgactgccctgcttatctggggtaggttctcagccccccagtttgctccttggccagggttctaagtgccactcagctttccccaaatctgacttacgtgctcctgcctggagccatgggcagaaggttagtgagccgctggtgctgatgtatctggtaacgtgtgccatgatacgagtactggggcaaggaccagtggctaatgtccccagttgtcccctgagccttgcaggcaggtatccaaaatgctgtcagcagatagacataagcatgttgtccctcgctccttgtgtccagtgaggtcagtctcttaaagccagaagggactctgaacttcatcacacatgggctcttcagtgccctccccaaccctgaggccccttcttcccagcctcttactccccatcaccccccattctgtctgtctcaccactcacttggaataaccaagctctgacctgagaaacaaggaggaagttctagctgttgacctggtgaagacacagaggctttacctgatcaaggttatggtccattcgagaaattttattggttaaatgatgcccagatggggtcacatcctcagaacttctcagcctggtagcacaagtggatgcttgaagaaactcagtcttggaactcagacagcaatggagacgggatgtgagtgggaccagcaaggggctaaggtccattatgagggtgaggaagggcttctagaagtaacaaacatcccaggtccctgactggggagaatgaagacactgaccaagagatgtgaagccactcagggctgtgcagggtctgaggatctcactggggacggcctcccagcggccagctatcagcacgagttggagggaaagagccatggtgggggtcagtcacgtggctcccaggaatggtctccccgacttaggaagcaccttggtgcaccttttctccttgcatcctcacaaccacccagtcaggccactcaagtcttacagcaggtgacactcccaaggtcccagctaggaggactttgagaattcaagcattctcaggtctggattagagacaggaatctgtctccacttccttacatggctagacacagagcccgggatggcaaaggaaaattggaggccccttcttcccatgagccattttctctgcatcccctgcccataagccttcactggcctctgatcaccctcatggttgactgcagctgctcctctcagtgccctcatgccctccactgtgctcagcgcacggaaagagtgaatactcagttcttcctgagggaactgaggcacagagaagtggagggcatagaactgccaagtggcagggccatgataggaactaggcagcctgccttggcaacctgtgtttttaaatgttgcttatgttcatctgtgacctcttactcaccctctcctgctccattgctttaggctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaagtgagcctggcgctgtctacctgggggtacatggcatggcttgtctgttcctgggctttctctctcagggctcctggggacagataaaggtcctcagggaacctgacctgtgctctcccacagtgagattagtgaaatcaccagcatcaagaaggaggatgtcatctccactctgcagtacctcaatctcatcaactactacaaggtagggaggcaggcaggggagacaggtgtgtgggatgcagagtgcagtcctctgtgggctgaccacctgctgaacccatctcctctgcccagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgcca

SEQ ID NO: 82 - DNA, 5615 bp, Homo sapiens
agcatacgccgagccggtctttgagcgctaacgtctttctgtctccccgcggtggtgatgacggtgaaaactgaggctgctaagggcaccctcacttactccaggatgaggggcatggtggcaattctcatcggtgagtgcaggaatcttgcgggacttctgctccaggagacgcaaagtggaaattttttgaaagtcccggatcagattagtgtgtgtggcgccggacgttatgaagccgtctaaacgtttctttatttctcctccttcatccacagctttcatgaagcagaggaggatgggtctgaacgactttattcagaagattgccaataactcctatgcatgcaaacagtaagtttgaccggatttgaggaaataactagtatagtttgaatttgccagcggtaaacattctcatcacggcgtttatcgggaaggcgaagacttcttctggggtggggatctcatttctccttaaattctaatatatttgacacattttaaacattaaagttaatttgctgatttggcttgaactggagatgtaagataaatggttcgtgttggccgaattcacggcctttctccatgagcaacaatccttatttctgtatttaatggggtttattattttctttaactgactaatgtattggggtattttcagtttaaacagtgaattatccgggtagaagtcggtagagccagaaactcacttttgatgttggtgtgccccctagtggcgagctggattctaaatcgtgccctttattccctgcagccctgaagttcagtccatcttgaagatctcccaacctcaggagcctgagcttatgaatgccaacccttctcctccagtaagtttttgtatgtgccgtgcatctgtggagaactgtaagggagtcagttagtattcctacattaatggattaaaatagcatttctagaaattagtatcaaggcaggaatgcttcattatggcataacaagtgatataaatatttaagtattgagtcagagtattattttatttttttcctgggcatattttacctccaaagtggttattttaaaaggcatatttcataaaaaggttttatctgtctgaaacaacatgactgtgtgcagtttccatactcatttgaaatgtgatgaaatgtagttttgaatgtttatagatgtatggtcatttgcatcagtcatttgtagatgtaacattttctacatcgtttatgttatagatgtcttcctttgaagcaatggtattaaaagaaattctttttttttttttctagccaagtccttctcagcaaatcaaccttggcccgtcgtccaatcctcatgctaaaccatctgactttcacttcttgaaagtgatcggaaagggcagttttggaaaggtaatttcaaatctgaagatcttttggtacacttccttcatgtcctcttttgtattctccctggatgaggatagaaaaatgatttttttaaattgaaatttcaggttcttctagcaagacacaaggcagaagaagtgttctatgcagtcaaagttttacagaagaaagcaatcctgaaaaagaaagaggtatgagatgtgcttgatggggctggcattggcggtagacactccttgaataatcttgattctggaatgttggtgccaagttgaaacatgccactaaatctgaatcgtcattttcctaggagaagcatattatgtcggagcggaatgttctgttgaagaatgtgaagcaccctttcctggtgggccttcacttctctttccagactgctgacaaattgtactttgtcctagactacattaatggtggagaggtgagcaggggggatagaagtcaactcttagtgtctctgcacagcctgctttgttttagtttgagaaaaaagttttcaaagatttttggtggggagaatgttaccagaattagcatttccttcaacctgtcaggtttatagttaatagattacttggggccacttcctgcagttgttcttttgctgtgtatgtcaaaactaattaaattcatttgcaacccagaatgactttgttctgtctcctgcagttgttctaccatctccagagggaacgctgcttcctggaaccacgggctcgtttctatgctgctgaaatagccagtgccttgggctacctgcattcactgaacatcgtttataggtaagcctgagagctcttcaggctaccagttttggtataaaggagacgtagcactggctgtttcatagggccttaaaataatttgtgtttatttgcaacttggttgcctaaaaccagatcccctagcacgtgagctggcttgacttaagtgccaagggggaaccagccaagtaggattgtgcctaatccagaatagatgagcagaacaagggctcccttttttcttcactacacaactacagtgaacctaaaatgcctctaatacctttagcaattatctttaagaggatatcttatgaagtgaaattaacttgtgcaactacttttctattcacttttttacagagacttaaaaccagagaatattttgctagattcacagggacacattgtccttactgacttcggactctgcaaggagaacattgaacacaacagcacaacatccaccttctgtggcacgccggaggtaggcgctgtcttggtttggtgcctggtttacccccgccttccaagagagagatgtacaatcatgcacttaactaccaaaaagagtaaactcctctcagagacttcttaatacagttcagtgcaaataaaatacatttgctgtttgatgtagcatgagaaatcccaagtccttctgttcctttactgaaaagtagctgtttgtaagtaagatctgcatcataaaaactttctaaatccctaagtaagagatatcaagtgcccagcagtttcctaaatgtcagtacacataggtagccagtcaccctcaaaaagtccagcagttttatcaggaaggaatctaaagatatctatcttccaagctggctctgggtctctcagctttttcaaactaaatgtgtggtcgtgggattgcttgctttcgcaggttctaaacgctgtttccctggtctgtttttcagtatctcgcacctgaggtgcttcataagcagccttatgacaggactgtggactggtggtgcctgggagctgtcttgtatgagatgctgtatggcctggtgagtggcacattgggaaccatggaacactgcctgctccctacaatattgccttcacacagcccatgcttggccatggtgtcttgcccttaccagtacgcttatcaaaagcagctaagaggcatattggttattttatagttcataagaataatcacttacctggttcttttgtgcatttcacattttactagataggaccacattgaacctgtgtggtggtgaaaaactaccacttattaacatctaccccctcaccctccacacacacacacacaaacacacacacgggttgcaaagtagacacttaaatagcaagggaaaagaaagcattgaggtggggagagtttctcaaatcgagcctaatatttattgccgtttatatctttttctctactggtaatgtgtgccatatgaaacttccaattaagtctaaagtaattttccccttctttcagccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcgtgagtgatgttttcctgtcctcctgggccggccgggacgtgcactagacctccctgcccttattgaatgcacctgtctaaattaatcttgggtttcttatcaacagatggagattaagagtcatgtcttcttctccttaattaactgggatgatctcattaataagaagattactcccccttttaacccaaatgtggtgagtatctgtctctcttctaagtatagagaagcccaaagggcatttattttaattcagaattgtctgggggagggttggaaggaatacattggcagatgttttctccataaacctgttattttacctacataaaaagcacatttttgtgtcccaacaaggctcccataatttttagacacatttatcaattcgaagcaccaaaaggcaacaagtgaacattattcttatgtttaactgtgtgtagccttttgagattttgtgcttgaagtgggtgattatggaagttgatataagacttaaacttggtatttaaagcctggtcaagatttccctgtcctgtgtctagtgtgagttcttgacaagagtgtttttcccttcccgtcacagagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 83 - DNA, 65478 bp, Homo sapiens
tggagctgctgcctctgtctgctaagatgtgaagtccaagactgaaagtaacatagcagaaggagaaccaaaagatatgttgagtcttgatgctatttgttgaaccagtcctgaatccagctgtgtcgtaagtgaattattcctaacatgatgacagaagcctgacattaatttatcaaggcatgctgaagaatatttgattattggatatagtgcaataccaaaactatgtaaataataggcacatctggttcgtgtaatttaagaggggtaaaggtagggaatattccctagacaagttcattcatcagcaaatatatattttgcccttattacatgttaggtccaagggctattacatatagttgggcagtttgggcactgcacaaatgtacctactcaggagggtaagggaactgaaaccaagtcttccttatatttgccaaacatttgccctggtgtgggagtggtttcatcccaggagagagtgatgtttataacttgctaactggccagttgttcctctgctaagctgagtaggatggaaggagtgagcatggtagaaagatgtggctacaaagaggaacacacatgtggttcttgccctttaggagtttaattcaagtatggggttagttatgcaaactgaagatcatgataaaatgtcgtaaaggctaataacgattttggaacatatggttatggccttggaactataaattgaggagcatggtccacagacttttatctttctaatgcgtgaatagaatagaatatttgaaactggtacttgtggctttctggttgccataggcatgtatatagtgtaaagggaacaaaagggttcttgacaaatttgacttggggagtgaaaggaattagagaggatgtcaaagaagtggtatgttggatctggatcttgaaggtaaatagcaagtgcaaagattagtgaagtgaaagcacttggtccattataggaatggtaaataactgctatggcttgaacttggaatgtgtgagagagggcagaggatatgtaagattgaggttagagcaggagtagattaggaagaggcttctgggacaagctttggagtttcaatatccctttattcacagggagtcagcgcagcttttgaagctggagagcatcatattttagaaagatcaagcaatgtggatgaggacacattaaaaagagaagaccgagaggaggggacaccactcaggcttataacctccaggtaagagatgaccagtgtgaatcttggcattggcattggggttggaaaggatggaacttagatgtgagacagctcacagatacagtctacaggctggtctactgttagatgggtgttgtcttattctacttgggttctataccagaatatcttagcctgggtaactgataaacaacagaaatttatttcttacaattttagagcctgggaagtccaagatcaaagtgctagcagattcagtgcctgttcctatagctagtaccttctctctgtcctcacatggtggaaggggagggaagctgccttcccttgctctctctctcttttttttttttttttttttttttgagatagggttggctctcttgcccaggctggaacactggcactatcatagctcattgtagccttgaacttccaggttcaagcaatcctcccacctcagcccccaccagtatctgggattacaggtgggtgtcaccatgctcagctgattttgtactttttgtagaggcagggtttcaccatgttgcccagtctggtctcaaacatctgagctcaagtgatttgcccacctcaccctcccaaagtgctgggaatacaggtgtgagccagtgtgcctggcccaacatcttttataagggcactaattccattcatgaggacagagcactcatggtttaatcacctcctatattctatcacattggggattaagttccaacatatgaattttggggaaacaccaaaaattttggggagacagcaacatagcaggggtagagaaagaggtagggaagaaaggttaacagtgatgcttttgtgcaatagtgtcaaaaacgtctcactacagcacaaattgtgaaaaaaatagcatttttcttgtttactacttagttaatggtctttgatagctcttaacccaatggtaagagagaaagaaacataaagtgaaaaaacaaaaaacttggccgggcatggtggctgacatctgtaatcccagcactttgggaggctgaagtgggcggatcatgaggtcaggagattgagactattccagctaacacggtgaaaccccgtctctactaaaaatacaaaaaattagctgggtgtggtggcacgtgcctgtagtcccaactacttgggaggctgagacagaagaattccttgaacccaagaggcagaggttgcagtgagcagagatcgcgccactgcactccagtctgggcaatagaccgagactccatctcaaaaacaaaaacaaaaacaaaacaaaacaaacaaacatacaaaaacaaaaaaacaacaaaaaactttggtgctaactagagaaatatcagtctcttccaagttaaaatagttcctttcaggttaacaccactttcctggttacattcaggctttcagggtcttttctttttaccctgcccacgaatccccctgacccccttgtatgggtgcagagcaaagcttatctgtcatcaccgtgatgggaagggcctttccaggtcttggctggtcctattgtgagagccctggctgagctgggctggtccctgggcctgggggctttgtgctagtgtccctgttatgctcggtcatgcttggtccttggggtcacctgttgcttctgtgcaccatttcagccatatccttccagttcaaagtctttgcattcttcagtttctgtgtccagatcttaagtctcttctagactatggctgttcttagaacctctctgttcccccttgggataagcaggaacttctggaatccctgcatacattggtcagcccttgggaaactggaaacatattcttagtcccatatgcctgatcacctccctcattttttctaatctgtagctcaagtgccagatgaatgtggaattctctgtgaggctggtagcctcataaagggaagccgggccaaggtcctgtctattttggggtcctcaggagcttatctggatcttttattgcactttgcctcctgtttcttctttagtttttggctctggagttgagggtgtgtgtaggaactctatctcaactcctgcgccaacttttccagctcctcctttcaacactatctgcctggctagcaaggaaaggagctgggtcactaagaaatactcaaagaggtggttgggtgggtgggtagatgatggtaggaggtggcaaacgtttgggtggggatctaaagggacagttaattcagtctagacaggttgactttgaggtatctaagtattccaagacatcctgcatttgacagttgggagaaagagggtttggagatcaagagggattgtggccagagttactggttgtgggtgtttgagacaatgggaatggataagtttaaggaaggcacgtaggaagaggaaagtgggcaagagcagttagaggaaggagagctggaagaaatgtaggttaggagtgtttggagaggtaggaggagaaaacggagatcgcacttactctccagagtgaagcctgagctctagtcatatacagatcccacagaccttggagagcttcttgcaaggctcagctcacaaaacctcacttaaaaaacaattctctgaagttcatcttgccgttcaaataagagagaaatatattaggcaagctgagatgtaaactgaattattgatgcggtagctttttaaagggaaggcaacattagccttaggtttaaggacatctttggtttagggacagcaaatcctaccatgacctacctttgtaacattttaaatttcagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggtaaaagcaaaaggaaaatgaggttcttcagggcacagtgtgtgggaagcaacagcatgatggaatcattaggagagatgcccatgactcctgcgcccagcaggagttgtttctgcaggggtccctgcttccatctcctaagttgcaggcagagagggcagaagccaggatcatcaatacccaagagggagcatcgaagagtgcatgcttcctctactatgtcgtgatatagatggaggccaggatttgggagctttggaacacatctctcccaggcctgattgttaggagaggacttaggcaaggtgtgggcaatgctggtgcttcacctttccttgttgaccagacagacccagaagggtcatttgtcaaaacaaagaaaatctcttccaggggtgaggcaggtgtggctgcctgtatgtgaatgtgctgcacacctttcccatcagcaggtgtctgagaccctactctcctcctgactttgttggcccgagcatcagcctgtgaggtccagcacccagagcccaaatcttctggctcctaggctggcacacaacctaacaacaattcctgtgccttcatattttcatctctgcaaggaggatagtagaaatagctctcaagtagggaatgatgactgcatttgagaacagggcaaaaataaaatctgaaaattgaacatcttgtcactaggcagttgtaacacattttgaagattatgagctaatcaaaattacacaggtattctgctctggaaatgctcaacaaccggacaggatgtttttgaatgcggtaataaaaattatctctaggagcaaaacctactgaatcttaaacattcccgccagagaaggaacactctccaagtcctcctcagtttacaccaaagaattccacataattcatttctgttgtggtagttagtaaaaccttacgatatacacaggtcagagccaatccaaaaaaacagaagcaaaaacatgaggtagttttaaaaatgttctttaaagaagatgtagatgaatatatggaagaggtattatagctattatttactaaaaaaatgtgaagcttttctactttaatttcttttgagaactaggctttcaaaaaaaaaatcgtgagactttctagcacctatctttcttgttattaggatgacttacattacattgtatttttacactttaaaaaatattgtcatttagaaaaaaggcaactaattataaggtgaaatgataccaacttataatttttttgtagactatacaacagagcaataaacattgcataggtgtagttctatacgcatttcaattagtgataactttcccatttcaaaactatttcaaaaactaaaatatattttaataaatgtgatgcttaaaatttttgttttctactttttaggttattttttccacagatgaatttctaatcctaaataatcatttacatgaattcagatttttttgatccaggtaacttttttctccacatttcttgagtaatttatttaacttaaaatacttaacagaatgtagattcttttttatttcttatatgccaggcatgtgtctagattatttaagagacaaattacgaataatctttttcttttgtttctcttgaggagaagatatgtaagtggtggctctgtttggtgggaactcttaggaaaactgcttgtttctagttctaggacatacttgcgcaccttggcctgccatgcctaactggggtcataagccatgtgacactggtgtccacctcacatagtgccgccccccccactgccaccccacctaggactagatgccaaatgctgacatcagctgctgccgtgacgttattgatagtttgttgttgttgttgttgtttggtttgtttttgtttgtttttgagacagggtctcactctgtcacccaggctggagtgcagtggcaccatctcagcctactgcaacctctacctcctgggctcaagcaatccttttgccttagcaccccaagtagctgagactacaggcacatgccactatgcccagctaatttttttttttttttgtagagatggggtttcaccattggtacccaggctggtctctaactcttgagctcaagtgatccacctgcctcagcctcccaaagtgctgggattacaggtgtgagccaccacacctagcctatgttgtctatagttttatcaaggacagactaaggtatattggaattaaaaaaaaagtagattttaaccatgaaggtttatttcttgctcatctccatcatgggctgactgggggctctgctccatgctcctcatttggggatgtatacagaaggagcagctaccacctgagctgctctgcattaattagtctctaatgcagaactaaagatagctaaggaggcctcatttggccattaaagtttctagcctgatggtgacatgtgccacttctgctcactactcattgactgcaacaagtctcacagccccacccagccactaagagccaggaggtacaatcctatcatgtgccaggaaggtgggaattcagaaatgctgggtgaacagcattagtgatgatcacagtggcccatgcagtgtgcatctcctctttctttttcctaggagattgctgactttggttagttttctatctctcctccatgctgaccattaatttaggcaaagctaatcccattttctgacaccaggagtggactttgatgcacttaagccaaacaaaataatacaaactaactgtgattgtttcaggaaagaagacgagatacaattcaggctaatgagatgccatgcaaggtttgcagaagcttttgggaaactttcttttcatttttttaggatatgttctgggagtaactcccctgctttccctggatgtgtgcgagaaagcataggcatccactttctgaccaacaggagacccagtctcaggatggagcagacaccatgcatggtagagcagagagacagatacaacctaggtccttgatgaaatgattggccactggatcagccacagttaaagactgcctacctttggacttctggttatcttaggccaaaaatgtcctttttgtttaaggcactttgagccgggttttctaagacctagcagtctcaaccatccaaactaataagctgaattaactagatttcctgtcatgtccttcctgcctgattggtagcccttgactccaatttggcctcattttccgtaccttactggctgccttttcctctactcataggtcacttggaaataaaatatagatttacttcaaactcccactatcacatgcatttcttttcttactgacttcacggccttcaaatacggcctcataatcatttactctctgttaggttcctccaatgacttggatcactcctagcctgtcttgattggccacctccacactaatgccaaaaaggatgccagttctcgatatctctgcttcttaaaaaacatgtcctttgtcttgctaaattgtgtcttccctacacaatggttgaaaacaaaccagccccccggtcacacactctaaaatacaaaaggtcagtgaagcagtcctccactgtgtcagtgcacatgctgtcaccaggagcgttgtgacttcaggacctgcttcctcgagccctaacttggggctgcactattgaggcctcagcaagctgatttaaagctgctattgaaaaatcccatcacatcccatacgtgagctgaagagtgacagtggagacaatttctacagcacttgttacagcaaaaggcagaagccccggcactggggtgggcaggggtgggcttttagatccatatttcaatgggtatattttaggtgaattctaataggaacgaagttaacacactttgtatgtctcccatcctggctcatttgctgcctaaatgtaagaagctatgccaaagtaacttactcaagtagtttgggggaagtcagggacaaggcaaagctatgagtaatctaggaaaaggaaatattctaggggctgtttggagctagagggagtggtgttattgatgtgactggacatgtggagtttaaattggccttttctgaattattaagagtttctgatttataccacagaagacctgaactttttagatttactgtccttgtatccaacagggatgattccagagagatttctggcaggttctacaaaaatattctgagactgacagttgctttggggaataaaaagacaacgtgtgtctgcttctttcagcccctcttccttctctctggctcattttttcaagtcatgcaaagctttccctaatacaattgaggcatacaaactgttagaagaatcgctgtcttaatgaacatcatttaaggaagaggggaagaaagaaagaggcgagggacggggagagagaacagaagcctgttatcttgctggtttggcttcctctcatccagaaggctgactttccggcaatgggaaggaggatgggtcaaattatggtaattaggatcttgtgtggcagctcgtgatgtgcatttccttcatttcattgtttctcttcatgtttgctggaagaccaaataatacacttctatgtttgtgccaaaggattattcttgggattcagaagacgaatggccatcagagagcatgtctggcccatctttccggaaaggttttcagtgggatgaggcaggtggcttagtagaatcaggtgacttgtttctaggggactttagacgctttagaagaaaataaaaaggttttaagaacttctctgtggatctgttatccaggtgctaaccacctagttggattattattatttttccttcttcctgctacacatattttgtcttccaagaggctcaagttgtaggaaaagcacatagggagataagtatagctcattttcttatccaaaggaggttgcagtaatttctcctattagaacagcaaattccctccaacccagaccttggtcttttcccatccattgtgtgacgtgattggcaacttctaagtgacgacacagaggctgattctttctaactgccaatcagtcacggtgcaggtcacctttaaattcactttatattaaacaagaaaagaaaggaactgcttgaaacactgaactgcttgattagatggaaattcttgtagcctattttaatggaaccataatttccagcagctatttttgagaagaaactattaaagaaacattggctcttgaatttaatgtgatcgcacacatcactagctgtgtgatgaacatctgcttttaaagtagggctcacactgacagccaccgtaattctacttctttgctatcaacatcagccctgtggttccagttattcaacaccattccccatgtggcaaatttatatagctttcagttcatgccttttctgggaaggcctgtggcaactttgcccatgttttgattgttctttgagtcacaaatagcaggaataccaacgctatgcattcatcatgtgccaatgatgacagcaccaagaagtttcaggtctggggtcctctggtccactatctcattttgtgaaagaaactagggttcaagtgacctcctcaaaatttgttggctatttagagcagatttgttaagagaatgcagaggctttttactgtgttttattgaagtgtaatgtgtagtattatacttctatagtatataagaaaaagtgtgccgatcatacgtgtatgttcagtgaattcacaaagtgggaacatctgtcttgccagcacccagctcaagaaacagctccagttcctttatgctcccttcccatccacaccgagcctctctaagagtgattccatcttgacttctaacaccttagactaatgttgcttgtgtttaaacgttatattaatgggtctaaaaatccctaaaccagttcgctttccactaccacagtttctttgggcaccaccttctcctatgggagataccacaagagttcgagtttcaaaaatgagactgggaaggaaaaccacattcaattttgacatcagattttcatcataatcaagttggcagctctataatcttccatagttagagacaaggctactagagttaagttgctaaaaaaccaaaccaaaacaaacccagctcttgtctggtcagctgtcagtgcaggtccagctggttgctgctcggtcactctaatgactgtgagtgttagttcaaaccattctttagaaaaatgtgttacctttttgtggctgctattgatttttaccctgacatattattattcttgacaatattgcttttttaccactgacatcttagtaaacccagagtcagaaatatcactggactgcttttaaaatttcttcacaatgaaaaaccagctttctacatcttatttcctgtaacgcaaagctagcctttctgtttgcctgctttcatgttgatttaaacacttggttttctgttacaaatatttcccacctctcctctgtttttcccctcttttgtccaggaggtgatgtaaatgtacatgctttattaaccacccagttgcgcaaggatgttctgactgcatcttagaaatgctagcagggccaggcgcggtggctcacgcctgtaatcccatcactttgggaggccgaggtgggcagatcacctgaggtcaggagtttgagaacagcctagccaacaaggtggaaccccgtctctaccaaaaatacaaaaattagctgggtgtggtggcaggtgcctgtaatcccagctactcaagaggctcaggcaggagaatcacttgaaactgggaggtagaggttgcagtgagccaagatcatgccattgcactccagcctgggcgacaagagctagactccatctcaaaaaacaaaaaaaatgctagcaaatagcaggatccgatgcagactgatggtcagctcacaggaaacatcagatttccatcttttggtcacacatccttctttgcacagtcagatacttcccaaagcagtttttttatgtactgaaagaaagataagtagatgcagaattgagtttaccagctatccaaactcagcatatttgtggatcatctcatttttctgctctataagttaccgaatatgagaaaaccagaatatatcctccctgtctggtaagtgaagggggtaaagttatagtagcaaaaacaaggtacaggaacaaagtgcttgtgggagctctccaggaaacattatatacagcctcgtactctcttacccagaggcagcagtctcgaggaactgtaagagccaatagtgaaaaagctatttagtcatggatggtaccatgtcaaggtgaactaaaataagtagccatgacggagataattaattcatctgtaatagagtctggactcacggagaattctagcagtttttggattaaattgggtgagacacttgctatggcttccaggccagaagctggccagaaaggagtttgcttggaatttttgtttttatttttattggctgtcaacattctagctaacgaggaggctacaggcacacacttctattcattttccctcccaagacggcttcctgagtgtctctatccattggatgcttgtagggagcaagcctttgcctttgtggggtgagggaaaggagagaaagtgggaaagaaagcagggatgacactgctaggaaatctctgtacctttgatttcgaatgagaatgtgatgcttttctttcatcaccagtattgaaaccttgctgttttgaacttcttaaagatccaatatctctccataaccttatggagagactgggagtagggaagctccttcaggcaaactctcagatccctgagagcatgctatcccaagaacaaaaagcctgaaatcatcctgcagccacaagtaaagacctcttaaatgctgactgtcagcggcagttgtcctagtttgacaggccaggtgaaccaagacatagtcatcttggaatctaagaatacaaagaccctgcacccctgggggaacaatattttcaatcaggaaatgtatcccttagtttccctgaaaatccgaatctctcctgttctttgatctgtggaaatggaaatagctcaaagaagttgagattcccaagtatggccaggcaaccggcagttccagctggttctgggagatcttccacaaattttagtcgttaacattgtttttctagatacagaaaagcactatttttctagatccattgcttccaaagatccagaaaaacagatgggtgggaagacccctgaactacagtgatcatgtgatgtggttagaggctaaaaatatcaagaagtctgtgatgcaaaaggagaatgggcatctaagtaggggaccaataatctcagcccaagaatgtaaggctgccaggaatcctttctctatgcttaactccatgattaattaaactcttttaaattatgccagaattaaccctgtcaatagaaatgttgcccacaggctttgttctcagccttttgaatttccctttgtccttttgtgtttgttttatgagcaatcagaaagtactcctgaagccaaggaagtctgagccagtgacaacccctcctccccacagtccagaacacacaatggtgataacttggttactggagaggaatcagctcagaaaaacagttccaattataccaacaagaagctcaaaggaaaagagggcaggttatagaaataatactagaatattaaccatagaaaaacaatgttaaagactaaagtttgtggaagatctcccagaaagttcaagatgctctatctgtgcttttcatttaggtcaaccatgtggagaaagaccaaatgacttaataatacaaccgtacatttgaatagtatttcatagacacagatgacttttgcttgtcctgtcttatttgatgtccttacttgaacctgggaagcaggtatataaggtattcatttgtatgcaaggaaaatggggcttgaaaatgttatgtgacttgcccaaggtaaaaaatgacgaggattctggtcttctgacaactggttggatatgaatttcactgcactagaatgtccatctttcctgcttaacatatttcaggagggtgaattctagacgatgggcttggcatcctgacataaatcagatagcaattaagatgactaatggtctgctttaggaaccatgagtttcaaaaggaaaacaggatacaatgttgtacctaggtggtttatactctggttggggaaagtggtcctaaaataaagaataaacaagacactgccaaactggatggtaccaaaaaaaagtgcaagcaaattccagaaaggagacatacgtatggccaggcaaaggttttcagacaggagataggacctaggtgaactgcacattgtagacaagcaggctctgtctatgggagagcagcagggtgcatgaatcctccctggggagtgaaaaaggcaactctagaaacctcttgattttagcaggtataaggagattttggaatttttggggaaaattgccttgggtggtaaacagaaggtcaggctatgaggacccccatcccttaaagctttaatatcaatttcaacgcttggaattgcatttggaagcaaccaggtagctaggctagagtgcagagccctggtgaataaacacagtccatctggtttacactattcagcaaggtgacttcattggcttttttcttatcatgcaagacagttttgaatacagaaacctagcaggataaatcaggaaattcggaaacccagagacagatttgcttggctggcatattctacaatacataatgttaatttagtgccctcattgtatagtagatggaaaaaaccgctagaaaaaattagggctcataatcagtctcaatattgacaagagtcttgttaaagggatcactcttcattaagatgtgtgtgggaggaattctcttgaagggcatctaagtcaaccacagcttcctgaactcagggctgataatattaatgatcagtgctggagacttaacaatggagggaaaaacatagtttatgaatggatggctacattatgtaatttttctctgcttttctacctctttaagctgtgcaaatccacattaagatacatacaaatgtagtgtaaaattggggggagggggtgtgggagtcactgacactcgaaaataggagccaaaatttcttactcctagtaggctgggtaaagggacagaaagctggagtctatgctgttaatcttaattttgttttctgcatagtggctttccatgaagatagctgaagactgattggaacatggaaaagcccagaaatccaatccagttaaaaatgaccccttaacatttctctgaaccccaagagtctcttggagttaagagtcgttctaactcacttatttcctgaactctgtccccaagactgagttaggttctcttcttatactcaccaagaacaccatgtacttatcaagctatagttagagtgtatgtgtctgtgtgcgaaagagggagagaaagagaacatttaaacagttcaggctggctattggtcttccttcccatttatggaagatgagctattggtaagcatgtgaggagctgtgaattccacacttctctcaatcctcagttcccctgtgttttccatagcatgagcatcttgctgtattgtgtgttttggagtttaaagaaacacattttttaaaaaagcatagtccacaaatacaagaatgatgctctaccaagaagcagcaattgcttccatcatcagtggaaagataggcttgctgtgttggacttagggaaatggtggtgccttcttaaagagattttcaagggtaacttctgctatatattttgccttgcctactgactttagaccacaactcttgtttaaatgcagtcttgttgaggagtgagagagggaacgagtgaaggagaaaagaaagactgaagaagtgaccagtttgatttagataactctccttaacgctcaggaaaatatatccttgctcgcaaacggttacatgctccaattgttgatgtagcattttttagactccagcaattctcacagctttcacatgaggaagtcagggagaagacagctttgttctcattaaaaaaacaagaaagtcatggtaccaactggctttagtcagtgagaaagcattacacctggaattccagactcagtctatcttctcacatgtataatttaagcatgaaataggccactacatacttttccaacagtgtgagggcaaaagtaacagaaaagtttcttatagtctttttggaagaagctctacaatagattgaatagataaagtgtgaaatggtgtgtgaagactgtgctaagttaacagaggagtcagtctgagaggctgtcgctggcaggactcaggagggagcatctctgatgccttctggaaaacaccatcttgaagagccatttcagatccctggatacacgtgtgctgagcttcctactagttaggctgcaggtgattctgttctgtttattagactataaattagttgacctacatcatgtgtcagagattataagaacagaaccaggaaatcagctgagagtactcctcataaagaaattatgttttcccccacgcgtgagcagaaataaatggtttctattcttcctacggcaccacatagtttataaaagaaccactagggataggttgtgatgcacagggtttaaaaattcaacgagaaagaactcgacaaagataactgctatacactgaatgtttgtgtctctccaagcccctttaattcatttgttgaaaacctaacccccaacatgacggtattagggggtgggccttgggaggtgattaagtcataagggtggagcccccatgaatgggattagtgttcttataaaggagacaccaagcactggctctcacctgtaatcccagcactctgggaggctaaggcaggaggaacccaggagtttgataccagcctggcaacacaggaagaccctatcacatacacacacaaaaatagccaggtatggtggcgtgcacctgtactcccagctactcaggagactgaggtgggaagattgcttgagcccaagagctcaaggctgcagtgaactgtgattgtgccactgcactccagcttgggttacaaagcaagaccttgtcacaaaaaagagattttcgttatctctctggtccttatgctatgtgaggatgcaaggagaagaatgccatctatggaagcaggccttcctcagacaccatatctgttggtgccttaatcttggacttcccagcttgcagaactgtgagaaataagtttctgttgtttataagccactcagtgtatggtgttctgttacaggcgcctgaagaaagacaataaccaccccaaacctattgttttcatgctttctattgtttgaggccacattactgtactgggaatgagctaacattaattttcggcctcacagcttctatatttccacaaatcatctaaatgatactgaaagcaattgcaagactttcctatacttgaaggacagagtgcataagctgaataacatggggcttcagtaatgatgctgaatttttctgagaggttctcaatgcaactatgagaacagtcccttttagaaatggaaggatatttaccccaatgcccagtactgaaaatatctaaaaacaagaaaacagaacaaaacataaaagtaagtggcttgcaatagcaaagatgtactataataatttcagattgcaactaggcctacttatacagagggcacaatagaaggattttctagaattgtcggttcttaacaatgctgggcttttattaagtatatcactatgttattttaaaagttaattttttagtaatgaaattgcattcatgtgattttggtaattaaacttgtgtaattagaacaaatgagcagaattagattgcactagccatatgtaacaacattattgggtatataaatctttttttcaagttttatatagcacgtacacacacacacacacacacacacacacaccccacacacacacagtagtagtcttatttgacaggaccaggaactttcatcttagtgtgtttagaatggcacctattatttcaatccatcttactcctctgcctacagggaattataccggtggcactagagatgtaaatgagatctgttagtgagcagtgagaatgcatgggtaagtagcagattgagaaagttgattctatggtaacaataccttcaatttattaaacattacattataatagatatagggttaatcactttatatatcacctcatccaaagtttgacagtgctatgaggtaggtggtattcttattctcctttgacagatgaggaagctgagcaagtagctcctgaccattatgctagtttgataaaattaaagattataattctaaatattgccacagactccactctctgctttttcatctttccaagcgggtcgctgaattttatatagacatttcagtctttaaccagtggctaagctggttggaccactgtgctgatgagggaattttttaaagatgaaatggtttgcatcatagctgtgtggctccttggtaagtgtttattccttgttcatgaggcaccagttgcttctaggaagggaaggttgggaatagtggacggtctttccacacagagggtctgacatggacacagtgtacatggaggtacagaagggcattgtgcagagggcaagtgtgtttgcaatttggcaaatttgggggttcagggaagaaggactggtggaaccaatgggggccagaatagaggagatttgtaggccctatcaatgcttgtggaattaaccctgtaggagataggggcctatgatggtaccagtgtggtcaaggtttgagcagtaaagctgcataatgaaattttcccttcagaaagaaaaatctgacactagtgtggagaatgaacttcttggacgagcaaacagaggtgaggagaaagcagttgagaaatcatgaggacttgggagggagggaagtggccagagcctcaagacatttctaggttaagatccacagggtttggacagccagtgaaagcaggttgggagaatacttagggcaatattaaccaagatcaagaggagaagcctttttattcccattggagaacttaagtaaattaaattttggacatgttgaatttgagggacctatgggacagtcagctggaggtgttcagaaagtagttggaaatatggctcttgaagcttcgagttgggttggggctagagttctagatattcacttacttagcagaggtttattgagtgcctactaagctctaggctctattctggagaccggaagtagagcagtgaacgacagtcaactgcacctatggagatggctggcaaagctggagaagtggctgaagtccttgggagtgtgaagaggggatggccaaggatggagccctgaggaatctcaacaaccaaagggtaggtgagagaagagggggagggaatgaaggggactaagacagagtggcaagggagacaggaacacacactattagaagaaagaaagggagggaagcaggtccacttttttaaaaaaattaagaaatatttttgaatgatgataaaaatcacatagcctaaaatttaccatcttaatcatttttaagtatatacttccacagcattaattatattcacattgctgtgcaatggatttccagaactttttcatcttgtaaaactgaaactctagacctgttaagcaatggctccccacttccccttccctgcccttgacaatcatcattctactttctacttccatgagtttgacaactttagatccctcacataagtgggatcttatggggcttgtctttttgtgactggcttatttcacatagcacaatattctcaagattcttccatgtggcagcctatgacatgaaagtcatatgacattttgtttattcattcatctgtcaatggacatttaggttgcttctacctcctggctattgtgaatataatgctgcagtgaacatggatgtacaaatatctctttgagatctagctttgaattcttttggatatgtatccacaagtgggattgctggattacatggtatttctgtttttaattttttgaggaattgctgtgctgtttttcatagtctacttggtttttgacatcattttctaattctgtctggaaagaatagaaataataactatttggcatattagctgtgtgctgagcagagtatgtgcattattttatttaatcctcaaaacaacattctgaagaggtattattaccacattttgcaggcgaggtccagaaatgttaagtaggccacactgctggttgggatctgggacttgaattcagttctttcctggttttcagatgtagctgttttgatgttttgtttctgttgagaagagctcatttccccaagttcccaagtaatttatgaaatgtttttcataatttggagagtattttgtaaatcaacaaggttacatttaaagattgagagtcagtgattatactaccactctttggcaattccagccccaaattcttaaatagtcatagctctctatgcagaaaatagaagcagttcattcttacacatcaccagcagcactctgggttggcactacattgagcctctcatcctcagcttggtgtctgcattgtatccagttgctgttattgtgcagaattaatgaatagtttgcaaactagcgtcacttctgtgaaagttgatggacatgttaattacaccttatttagatttcacagttgcatgacccagattcttcttttctacaaaatttccaaaggtttagtggcattttagaaactccagtaaacatagcatactaaaatacaagcaatggaggaactggttgggcagaaatgggaagatgatgagcttggtttatctgacttcagggctagagtcaggtagtttattttcagggatttaggtagattcaacagtgtatatctttggggttttattacagtcttttgtagttaggtatcctgtacctcctcagaatctcctttctattatgcaagcatgaaagcatttatttgaagcctgatccaactgctgattacaaatatcgtcggtgcattacatttcttgtttttggcgtttgcagtctacctctctagaagattgtgatgtacacgtggatttgaatcttggcttcaaaatttcttattgaactactaacatgacaggcattatgtagatgctggggattcagcagtcaacacgatacagtccctgactgtgggaactaagagagagcccactggggttaaataagtatgtaggcatttgtactatactgtgagaagggttatggtcaggataaggatggggaactgtggaaacacacaggagcagtccctattccttgttgggtaaagagttaagttaaagaaagcttcctggaggaaatgctgtttaagccagtgattctgacttcaatgtgcaccagaagcaccttgtggggttgttaaaatattgatttctggttcccacatctagcatttctgattccctagtctgaagttgggcctgaggatttgcatttcgagttaagttcccagttgatgctgatgcctgttctgggattgcacaagtgatttgagaaccatttctttaagccaagatcttaaggagggataaaagaaggcaatgtatgtgtgcatgtgtgtgtgtgcgcgcgtgcgcacttgtgttcatccacaggaagtgggaaatgggggttgctgcatagaagcttactgcaaagggaacggaatgtacaaaggcttggagataagtgaaagcatggcatgcttgtggacatcaatattgtagagtgtagcgtataagaaagatgtggtgagaggtgaaggtggaggtatcagcaagggacaaatcacaaaggacctagttggctatgctaaggagttttggcttccccctaaaggcaatgggaagctgttaaagtggttcagtcagaagagtgatgtgctatgatgtgatatgcattacagaaaggttgttctggcttcactgtggataatggaatgcacacacatgggagcaggagaccagttaggaaggcattgcagtaagccaggagaaagatggtgaccatgacgaaagtgtctttttgttgaagagaagaaggttgttgaagagaagaaggttgttgcagaggataaattcttggtcccttcctcccactcagagttggggtctatatttactacccttgaatccggatgagcttatgaatagttgatcaatggaataaggcggaagtaatgatgtgtcagattgcaggttcagcctctaagagactgctagcttcttttcctttctcttggagcacttgttcttcaattgctaaactgcattgtgagaagattgacaactttgctgaagagaccatgtggagaagtcctgaggctgcatggaaaggaacggaatcccaattttctggttaccactaccaaggtgctaggcatgtgagtgaagccatcttagaacctccagcccagcccagtcattagctgaataccatgcatgatgccatgtggagctgaagaattgccctgcggagccctgcctgaattcctggtccatgatattataagcgtgatagaacggttgctgttttaggtaattaagttttggggtagtttgctgtatgataatagataactggaacaattttcagtaataaagtcacaaagaacatgaatatttaagtggcagacagaggaagcaaggccttcaaagcaaaataagtagtaaggaggaaaacaaggagagtgtggtgtcatggaagccaaaagaaaggagtacttcaagtaggaaggagtggttatcaatgtcaaattctgctgaaaagtagaaaagtatagggactgaacagtatcctttcgatttaatgccacagatgtcactggtgacattgaagaaagtctgataagttcagaagatggtttgcaatgagaaggtagaggcggaaggagaaagtaactatgtcaaggagcttcatgatgaagaaagagggtagatgcaggttgagaaaaggtttttattttacagttagtagatgcgcaaatttcagtgatgttgggaaaaatacaaaatgcaggagagggtgaagagaggcactgggcaaatagatacagtaagtattctgcagaaagcagaggggatgtcccagtgtgcaagcagaggaatttggctgacacagaaggagggacccctcttccactgtgacaggagagatgggaaaaatgatgagatagaggaagataaatatgtaaatgtgtagcagccataaggtgatgggctactttatctgatggtgcttatttctcctgtgaagtaggaaacaaggttgtgcactgactggttggggagttgttgagataggacatttaggagaagaaaaaagacctgaaatagccactgggtgggacagtaggggaccaagcagagaaacaaagaaaatttgtatccttgggaatggtacctatttctgtggttacgtgaatttttttttccctctgatattccttaacagtccaggtgtagactcaaagaggacagagagttggattaacctggggttggcatcctgatggacttcaacaaggcacatggcaaaggagttgaggatgttggcaaagaacgggttgaagtgagggcacactggtcagaaatcgagtgatgacaagggaagaaagtcaagtctgagggatcaaggtcttgatcaggttgaaggacagagaatggatatccagttttggtttttcagaggtggtaagtaactgcagagtctggggtctgcaggatgtggcttgcgtggagaagaaggcattgaaattgagaaaatcaaagaactgagaggtttcattcatgtggatggtcactgatgtggacaaaagaggtgtctgaaaaggtggcagggcttgagagtagaggcagactgtggaccagctgtcaaagtgtttagaaagtgagcaagggtgggcggttgtaagtgacagtggtgaggagaggctgtgagagaggtagcctggtgacacgaatctcaaagaatcttttccccccttgtctgtttttgaggtgccagggtgccaggatatgctctggaagcagcactagagaccaagaagtatactgtcaccggtgccttacaaagctgtgggagaaggagctgcgtcctctgggcagggctagagaagtggggtcttcagggcaggtttggattttagttaagggaaagaggcagagagaaagtttagggaggaggtgaggacttacggggatatgcttaccaaagaatggaggtgtcagggacttgctggcagcgggagtgggaatcctgtcggggtctctgctctggctccctttctttcaaggcttcttcgttcctgggaagcttctgcactagacctcactcacaagtgggaagtggccactggtatgtggggtggggccctatccttgtggatgagggagctctgcctgtagacaaaaccacatctgtacagatctgcacaagaggaggggccactgggggccaagggctggtgttaacaagcttgtggatgaagggagttcctcctggttgccttttgtaaatgattgtctctctggtcacatacttgtaaaattcaaacttccttccctcacttacaggcacattacaagccatcacatagattaaagtttagctaaaaaaaaaaccccactaatttatattgtttagaagagttccagctaggggctttagccatgaaactgctccggcgacggagtcttgcagatcaaccacagctctgataagaagactatggattatggtcgagtcagacctgcatctccatcaagttctatcatgttctatcaagtttggcagtggccagcgcatatcagtgctgaatcagtgttcatggacaaaggaagaaagcaaggaaacaaacactagagatcagaagtccaggagcttgatctcccacaaccttgtgcagaggtcactcatccagaatctgttgactatcagaacggctgagtcgcatggagttcagatcctgtgcctggtgcagggagaggggaaacacaccagccacagacttgaccactccagagatctaaccaagaggcatcctgggcgtcacagactcccatggaaggaataattgtcttgattcccaagtggaattaaaacccttcactctgtgtttctccagttatccaaactatattttggttatgaaacatacaaaaataaataagtcatttccctgccctcaggagcttgaagtctagtgaaagagacagacaaatgaatactcaatgatgagagtgattatgttatgggatgcttcctgtgcatcacacactgctgacatgctttacacctatgacctgcctaatcctcataaccaccctatgaggtgagtactattattaatcccgttcaatagataaagaaactaaggcatagagatcatacagctattaagtgtggcaggggcaagtcttgcaggtagtcagtcaggctgcaggggtgtgctctgcatcatgaagccacctgtgattataatacatgtgataatggctattgaaagcttatgtccagggagaaaagaggcaacgatgagatcctaaagagtatgtatggcatttgaattcagttttgaagaataataatggctcccatttatttagccaggcattatggcaagtacgccacataaaataattctgtttaactgaacccttctgacatctctctgacattagctctgttatcattatctccattttagagaagaggatgccgaaacacagaatggttgctgactatgacagtgtgtaagtgttgcagcctggattttaactgaggcagcctggtccagagctggggcacccacctgctgcactgcaagggcctctgcccaacagttccacgggcggagaagtggtagatgatagtgcgaggggaaagtgagccctaagtaggaggctggcctaagtaggaggagttgtgtttgggagatacagtggatgttagtgggctcaggaagttcctgcaggtacacatggttgctggaaaactggagaaacacagagtgaagggttttaattccacttgggaaccaagataatcattccttccatgggaatctggggagctcaggacgcctcttgggtaagtctctggagtggtcaaatctgtggctggtgtgttcctgcactaggcacaggatctgaactccatgtgactcagccattctgatagtcaactgattctggatgagtgagaccaaggtgggtagggtcaccgcctctgcacaaggttgtgggagatcaagctcccgcacagcaggaatgggtattaatcgactcaaggaggttagggaccattgagagcccacagcaatgacaaatctaaatcgcactcaatcttctggtttctaaaagcatatgaaagatatgatgagaaggatttgggacttaggatctccctggtcatagcacctataggtccacccttttaggacctgggtctacttcttcttcttccaaagcagggctcttgttccaggatgctgagcccagattgtcatggaaggagcttaggtgagcactgtttggggaaggagaacaagttcaatacatcccagatgtctctcttagacataaaatcttgcacaggccaataagaaactggtgaagtaaggctgcctaaatgacttacttaagttacaagagatccccacactcctttttcatgtcacttggaggaatttctcaaaaggacatggttcctgctgtgtttccattcaaactcttatcttcaggtgagtcactcagaaagggaacgaagggaaaaaaaaaaaagaagttcatcaatggcaactgaaccgagcattgtacagccagagaggacagtgaaatggtctccacagttttcttcagagtaattaagacaaatgatattctctgtagtgctggcaatcaggcactggggatttctgggaaggttgcctttggggatttgcatcaggccaagggaattctaactgcaaagggaaataagaaactgcagacatagcaaccaaaaggcatccttaggaatagccctgtggctccttagtccaatcagactctgggctgacagcattgcctgagagctgggtaccctagcagcatcagggtcagagctggtggggccacagcggggcatctcccagatgacttcagggcttattaatattccctggtaacttcttgaaccctgttttctaggagccctgggaagtaaaacaacaagcacttaagcacaatggctcaaacctatcacagaatgtgcagggacccatcaaaaaccatactggaaacactgccctttgagaagttgttggaagaataggatcataatatttccaaatttcaaggcagaaaatgaagacaagagagatgacttctttctcccaaggccacatattaatctccaaggccacataataatctatgggctatacttttgctccctgcatctctttcctgtgttccaggcatcttgaggctcccagaggtcatgacacttacttagagccagataggactgtgccctccagatgacactggaccatcttgctccttttgagtgagctggtctcaggagagagtttactaaattgagccccattttagttctcaagtgaggctttttgcagttgaatcaagggtgaagggttttcagccacaagtaggtatgtttgctcctctgttgtaaaagcccatgattgttttttacaatgtagagtttgttacccaacaagtacagtagcccagccctgcaatctgaatcctcacatcctgcgtgttgtaaaataggaaaccaaatacaggggaactgttgcagtgaaaaccaaacatctatatgccagtatgaatactttgggcattagaatggcaccttcttgtttgtttaaaatcagaggttctcaaagtatgttcttgggaccagcagattcacatccgctgggaatgtgttagaaaagcacattcttgggcctcacctccagacctgcagaatcagaaactttgggaggagggcccagtggaggtggaggcttccaagacttcaggtgattctgatgtgagaaccactggtaaaagaaggagaagctggctgtggggggtgcaattctggtgccttgactacaattttggggtgtttcagatagttgtgtcttccttagagcttgagaggaaagcctgaggaataaggctgtatgcaggtggggatggggagtcccatgggtgcctcggtagcatctggattgtgggtgtggtttctagaaattgctgtatttggcaataggccaaagtgttgtatttccaaatacatttttcttatcagtgtgggcatataatttcagtcggagcctggatgactttgggctcacagagtgacttgcttcctagccctttgtatctgtgatgttcaccacaatgaagcttcagtgttcttaggatacatttagattaaaacccactggcgttataccattctttggctttagtctggtaccaaccagtttacatgttaaacccaaactagaaagtacaaagataggatatgtttggaattagcttctttccttttaaacaatgcattccaagattctgatacaaatcagatgcattttagagagtacacatggaaaatcaagacttaagaaaaatgtgagcatgcattttttatgttctgataagctgagaaaaaaaaaaaagacagaaaagaactcccagggaacctagaagaagaaaccttaaagaataagcctttcagacaggaagaaagattgttagttgttgggtgtattcagaagatttgcatttttaaagttagtgactaatgtaataaaaggttccagttaaattattgcagtggctgcttgcttcagggcaagcaaagaatctttgaggttttaaatcattttcttcagtctggcatgagagggtatttttaagctcctacaaatgatttccatattctctatagtgtttctccatctggcccctaattttcacacacctggcaggaaaatgaaaaaaaaaatttgtacaaacaatgttggtatttgggcataaatgattaatattaagagaaagccaaggcttctttggaaatatagtttgattaatagactttaaaaattagtagctgtattgattgattgattgatggaaacagggtctcactctgttgcccaggctagagtgcagtggtgtgatcttggctcactgcaacctttgcctcctgggtttaagtgattctccttcctcagcctcctgagtagttggaattacaggcgcctgccacaatgcctggctaatttttgtttgcatttttagtagagacggggtttcaccatgttggccaggctggtcttgaactcctgacctcaagtgatctgcctgccttggcctcccaaagtgctagaattacaggcatgagccaccgtgcccagtcagctatatttaattgtcaaacatatactgtattatggttatcctatttttgaaacttggtgtgattcaaactctggcacgtattgacaatggtgcaggatctttgaattcaaacctgctccacaaaagccagcgatttgctgtaactgtaacaccagtgttgatggctcagcttgctttgcatcaaggaggcaggagaagtggaaattttacagtctatggttctgctctaatgtataaagatgctaaaactcatatgttttgcctcctgaatgaggcctttaatccagcatgctccttatactacaaacagagattctcagagcaaaactctgtaaaaggaacatgatcagaaagaactgaatatataaaaatacagtacttgaataaaatggaccatatcttgatgcccagcatataagtcatcaaagtactctttttctaaaaaagtccaagttctagaaaaacactggaacacagtgataagtttttgcttagaggctttactgagatttaaccactagaaaagctaaaggctgtgtttgaccttatgttgcaaagatcctttctctctgtattactggaatgaaggtgtatagccaaatggtgagaattgggttctggagactggctgcctggggccaaattctgaacccattgtttattagctgagtgataatgaaggagttatctaaaaatttcttgccgtagtttcttcatctgtactgtgaggtgaggatactagcagtatctaagtcattgctagggttatataatgtatgtagaagacttagaaccatgcctggaacagagcgagtgttagacaaatttagctatcattatgaatatcattttaatttcattaatgagggctctgtaagagaaggaagagaaaagagaaagagccactttcttcctgtcccttctcctttccttctgccacctttctctcttcccatccctatttctttgccagattccaaatgggatttgaagctgaggaatgaacattgagcatgattagaactattcagtgggcagagcactgttttaaaaggccaggaggcctgaattctcttcctggctttacattaactagatgtgtgactacacggaagttgtcctaccctttgtgttcgtctctagggctgttgtaacaaagtaccacaacccgggtggcttaaacaataggcatgtattgtctcacagttctggatgctagaagtcaaggatcacggtgtccgcagggttggttcctccttagggctgcaagggaacatctgtcccaggcctctcccctaccttctggtggtttgctggcaaactttggcattccttagcttgtggatgtgtcgcccgatctccaccttcatcttcacatggcattctccctgtgtgggagtctctgtccaggtttcttctctttgtaaggactgggccaggggcctgccctactgcagtgtgactgcatcttaactaatttcatatgcaacaaccctatttccaggtaagggacagattctgagatactggagttaaaacttcaacatatgaattttagggggatgcaattcaacccatagcacgagggatagttctcagaatctctatgcttctccaagaggggaataaaggatgcatggcatttctgaaatttatccaactagagagcacatttgctcaactgtggaggatcatcagggcctcacgctaacactcctgcctttttgggaacatctgcttcccaaatgaggtcattacttccccattacagagctgactgtaaccaggcacaggaagtccttcctccatctctgagcagaactcactgggcccacccccagaggcacactgcctgtccttggttagcttgccaggatggggggtgaagtccagccagtggcccctcactgccctgtcaggttctgggtgggtaagaagacccccaccaggggacttctctggctcagaggcagctaatgtggatgacaacgaggctgggccactgcatttacattcaagcagctgtgatcccataaatactacaggggaaagcccaccagggagaaaacaacttactcataaaattttaataaataggttaaaagaaaaacctgcctcagcttctctttgtgttgctgtcagcaagcacatctcttgcagcaagctgacattcttgttgacagcgctgttaacagcactccgaataaggtaattacccaataaagttaatgttagccaaattgcacagaacttgaattaaaaatttatctgattgaaggattgaagcctgagtcatgtgtcttccccattgagcatgcagtttgcctgcctcgagagtaggatacgtcacaggatggaggctggcatttacattctggaggtgaacccactctcagaggcaggagctgagaatgctttcttctctacctcgaggcagcaggggaatgagatttctgtgttcttctttatctctgtgtgatgtttccattcactttgcagagcagcagtgcagtctagcgcagcctgccctttcctggtgaggactgagctggggtggcatcagaataagaaagggcactgctgtgactgctgtgactgctgtgtaggatccggtgtccttgtagggctggtggaggaggcagtcggagcccattgtctgagcacaccgtaggggctgcatggctataagacagctcacaccaaggctattaggcttgagcagaaagagagcaggacttgagatcaaaagaattgggttctaataatcactgagccattaactaattaaaaggtttttggcaagtcacttcctttctttgtgcctcatttttctcatttgtcaaatggaggtaacgaaatttgttctatccctctgggttgggagaataagaataataaaagatgtggaaataccatgaatataagcagttattaataggctcaaatgaaggtatgattggccagcagagatattaaaaatgaggcaaaagggccgggcgttgtggctcattcctataatcccagcactttgggaggccgaggcaggcaatcacgaggtcaagagatcgagaccattcctggccaacatggtgaaacctcttttctactaaaaatacaaatttagctgggcgtggtggcacacacctatagtccagctacttgggaggctgaggcaggaggatcgcttgaacccgggaggcagaggttgcagtgagccgagatcacaccactgcactccagcctggcgacagagcgaaaccgtctcaaaaaaaaaaaaaaaaaaaaaaaaaagagaggcaaaagaaaaattaataagtattgaaaataaaactaagggtaacttctgggcttaaggagaaagagcctacagtctcttattttcactggagagggtagtaaacaaatcacacaggagtgaggattatgagtggcgtgagcagtatttattagcgactacaaaatagagccaaaatatcaatattcattgggctgtaaaatcaaattttctttaaaaaataccctgtgaaatactcaaaatgtaatttataaccacaataatataattagtatatatttccaaaaacctgtagaactggagaatatggctatattctcaactgaagcaaataatgtatcaaatggcagcattttccagtaaaaagagccctgagccctgagcagacagatgctgcttctgacatgaacaaatcatgagaaaatcacctctgtccccttgttcccttgcctacaaaatggaggtaattcctgccctattcaactcatggggctgaatgaaacgaaatgaaatgaaacacatatctgaacaagtgaaagtgccatacacctgtgaggtaagattatttcaattatttagtcaggtgtctgttcttattctaatttaattcaacaaacactgatttgttgagggggtctactggcagagcgtggtaagtttggcaagaagctgcccatactgtgtggctttgtgaagaggagaaagaactggaagggctgggaagggctcattacagaggtgttgagagagctgcccccaaaaagtgtgaacaaagtttctttcatccataaatatatgttgagctccaaccatgtgctgagcactggactaggggcttgcggggattcatcaatgagcagaatgaatatccccacacttaaaaaactgacatgctacaggggatgacgggcatgcggtggggcacaatatgcaagttgcaagggtgaggagggatcatcaaggatgagataactgagttaacaaaaacacagaaggagaacttacaggggttatgaggctgtggaaaataggcttcatatctggttttgcttcagatgacttggtagtggctgcctggaatctgtgttgaggaggattctgagatttccttttggctctggtggaagagtgccaggattgattactgatgtccacaatgggtgtgggaggggataattggatgagtgttagatattcaccattcccagagaggttctgtgtgacattccaatctctgctcttccagtcttctgagaatggtacgaagcttaataagcgagtatttaagtccagcatttgtgtgtacatgaaaaattatttggatattctcagagaaagctctgctatgtaaatgccagtgttaatggtatacttctccaatcttttaccttctctttattgagaccatgagcaggcaagtaactcagctatgttttatagaacctgtttctgtttgtgattccacttctttggctccctgcactccaaactcaaaatgagtgtcagcctcttagagcctcagaatttttagttgctcatatgctacacttgtcttctgtttggggtcatataatacatccctccatggcattcagaggaagtgatctacctttttcctttaagtctcctgaagtaactatgcaaccttccttgataactctgtaagagatacagtgtattgtagttccagaatatctcgtaccaggctgactctggctttctggctgagccttaaaggtaaatgggggtttgggagaaaccctttttcttagcccttgatatgttaaataaagaaattcagaaaatcctatattgcttataagcaattgtcttggtgcaaaattttgtatgtcaaaaataaaatgttaattttttcctgttagattgaaccatatgaaattgctattttttccaccttcaaccatgtccccgcaaatgacgtaaactcatcctttttttatggctgcatagtattccacggcatatatgtgccacattttctttatccagtctattattgatggacatttgggttggttccaagtctttgctattgtggaaaccatcattctcaacaaactatcacaagaacagaaaaccaaacaccgcatgttctcactcataagtgggagttgaacaatgagaacacatggacacagggaggggaacatcacacaccggggcctgtcgggggttgggggggctaaaagagggacagcattagcagaaatacctaatgtagatgacgggttgatgggtgcagcaaaccaccatggcacgtgtatacctatgtaacaaacctgcatgttctgcacatgtaccccagaacttaaagtataataataataaaaaaagaaattgctatttttataggtcaaaaagttttagtgttggcaattttctctggttcaacttaatagatgtatactttctttaacaatcctacacttgagaatttgggctttaggctgtttaaggagaatgccttgtactttgaaaggcaaaaaagaaatggacattaatgttttgctgaaatatgtctttttgtcttcaaaacttgctcttcctggtcccttcttaatgacagtaagaacagctgctcataggcctctctgctcaaacttgaagagtgcaattgaacacagctcaactgtgcttctatagataacatgaagccagaaggctgctggttctctgttgtattcactggttagatggaaaaagtaagtatttaatgagaaactcctgagatgtttgaaatgatagctacatctctatttctttccccaatgacagagggaaatctggtttctggattaactactgaatagcaactgcagtcaacagctgatggaatcttgcaggaagactaagctggtgttcagagaagttttgttcaggcatcccattttatttcactcatactatccaatggctgtgtttgcatgtggatatgaaagtatctgaatattctgattaacatttgtatgaaggatttctgtctactaaagagtgcaacagaatagaccatctggagagagggctgtttcattccgatggaaggtggcaacaaagttgtcatctaaaaggaggatgctgggagtggtattctgttcctggaaataaaagtcaacctaatcctttgtgccgagggctttgcttgctggatcgatttctcattgtctgaaaactgccagtcacagaaataatacaaccagctggctatctagcagggattctgctgctaggaagaggagcatctgtagatgacaaagggacactaagggtccttagaaattccctgcattgtcatctgataccacttagtcacacagcacccctaggtgtgtgggtgacagggcaggctcaagcccaactctgctgattccattaataaaaatggccatgccaagggtgattgcactccctggagatgggagtgtgatgtcggttcacaaaaggccaatgatacgttgccctctggtgtcaactttttcttactgaggcaagaaaaagtgttcccagcaacttctcagactccctcagcccactgaccaggtcactgtacttgcaaacgacatagaacatgaagataaaaactataaatctgagatatttccagtaagtcaaaggaaagcagaggcaatgttcttgctttttttttttttttttcacgagaataatcacaagggtgtttgggtatctgcttcagtctttcatgagtattttccatgaaggctgatggggaagaagtcagtagcttctttttctttgctgaaagagtcattatctcagagacttagggattagcaaatgggataccatgtgatgaggatgagaggatagaaaacagtctggaaatatttgcttttaggcaaagatgaaatcacaaggttcatttatttcctttgttctacaatttccttaaaggccaagtcacatgaagataatgtaaataaaaattaccttaggaatgggaaaaagaaaaagaaaccaagtctgatgggtgactgttgagaaagggagttggaagccactgaactctgggcttttgttctcaagccaacccgtggatttggtactatactttgattaatctatctaacttccacgtctttttcaataaaatttctccctacctcttgaggaagttgcaagattgggtttaattattgtttgtactttgagaggctcaaggaaagtacttcgagatacaaagcagtataagaaaggaagctaagaatacttttataaaagaagaaaagtgtacacagggtacctaaatttcattttggaggaatgaaaaatgtaaactttacccagaaactatataaataccagtcagagagatgcagattgccttctgtggatcacatgatatcggaggtggggtgattcctctggctgttccctgaattttcagatattctctctaggtcctctccaagacagaagcaatctgccagaggcacctctgggtttgcagatcctctagcattcacagtgtctttcggagctcattccctgattgcagggccaaatggcctctctcagctccatcttacccggagctgctctgatcgtgacagtttctatatgaccactgctagtcttctcaccaagggcactaacctagcagactacagagtctgtaaataatggttactttgagaaatgtcactcttcaggaagtcctaccttatcgcatttaatcagaactttaacttttattatgtttgtgataactttactcaaaatttgaagctattcagtgattctttcagctttttaaaaagaaaatcgaagttccttatgataaagacaagcaaattacaatgtttctcatgattataaactctgctaaatgcaaataataatggaaataaaatgcatgaatttggtgtgcaaaccaaggctaagctgttttgggtttggtgtccatcaaatttgaactttgccacagtttggcaaaataatagagcagaaaaacttaagagaataggaaattacgagaaaaataatgggagtgggaagtggtggagagaatgcaagcagaaaggaatgtttgctctctttctcatcctttgatgtcaaccttctgccactcatctgagggtcccagaatcagaagtttcttgcacaagattagaagtatggttttcaaactgtgtgccaaggaacccaagaggttctttttcaggggcttcctcatggttggggaggaagacgaaaatctccattcccttttccccagtaatttcatgggcttggcagtaaaatggaatcctaatgagagggccaattatagttttccaggtgaaatttagcccattaagtattttagttttaaagttaagatcattagaaaatgtacaaggtggagaaaatcagcatagatgagaaacaatccaagtgaaagatcctctttgctattggttcatgtccctagtggctggactttctaagaggatgtaagagccttgtcaaagatagtgctccttatattggcctctaccaaagccttgctcccatggcattcagactctcaagtcaatacgatttagtttttgatcattccactcattgctctctagataatctcccatatcaacaaagtttcttttgttctctagaaagccaagataccaacaaagctcgacattaccatccacagaaactactttagcattaggatcattccgtatcatcatatggatttctgtgccaactcaggaacaaatgatggtatagcagaaaagatattgaaacaagccatacagcagggtttagcaaattatgagagctgactacaaaacagggaagaacatggtgaagtttcaaaactattccatagtagtggtcaggagtgtggaggttggatgcatttgatgttgaccatgaaggattgccagaacttgtcctgaacacttctgcacaagtgtgtggagcctggacttccatcactgtgctacagtaatcagacatctgcattgcatataaactgtggggagcggaaatgcccactgaaagacctgttgggagagaattacaataatttagcctctatcatggggctctgctctgctgctacaaggtcatcatgggagaaacaacggagtatcttgcagaaagttagaatttggtcctttgccctttcagtattgcactttgtacatgtataagctcaataactattagttaaagatggtgcagaaaatgcctttgtaatttctcttgggaaatggctttctttgcaaaaggtaggttgaaaggaaagcacaatgacttctaaaagtgatgacaagaagcaaggatgaatcccttatgctaatactgtccctccccaatagaaataatttccaatgaatgttaaaactggaaggttatttaggtatctctttatagattagcaagacagtattgcaaggtctttggccaaatactgagcccagatgtattctgcagtccacactgatctttaaacttgaagaaagttatctattcttacttcagatgtgttttatcagctccttaggagcctgctagagtcataactttttcttttgtgctgaaaagggagtagaggagcattttccttgtagctagacaggagtctttcttccctcaaattgccatttttatttaggtttatcagaatgtaagagtccaacaaaatttttcccaattacttcatcaaacaacaaagtgtcatcttttgtttgcttcttttagaacacaagataagaaatggctttgatgtatcagatctgatgtcctaagagatttagctccatttacattttggcttccccaaccctcactccaacataaaatcctcttagaattagaagatggaaattgaaactttggcatgagcgctaatgaaatgtaagaccttgaacaagtcatctaatgtctgtgaacatcaattttcttgccaataaagtgggacagaaataatcgtaggactactgcaagggtcaaatgagatagaagatataaaaacatattgtaaattgtaaagcacttcaatatatagttataaatactaacaacacagtcatggcctagcgaaatgagcattgaatttgaggtcagtagataggcatgtaaatattgcattgtctgcttaacagttgtctgatttggggtaagtcatgtaaactgtataaggcgcagtttccataagtgtagatatggattattaagttactaaaaaaatcatagggtttttgtaactgaaataatagctgattgaaccacaatagacacctagctcaagctatgccaatcagactctctcccatgggaatctgggcttgggattaaaggactgtccattggctgggtgcggtggctcatgcctataatcctagcactttgggaggccaaggcgggtggatcacctgagatcaagagtttgagaccagcctgaccaacatagcaaaaccccatctctcctacaaatacagaaaaattcactgggcatggtggcgggagcctgtaatcccagctactcaggaggctgaggtaggagaattgctagaaacttgggggcggaggttgcagtgaaccgagatcacaccactgcactccggcctgggcaacagagtgagactctgtctcaataaaacaaaacaaaacaaacaaaaaaaggactgtccatcatttctgggcaagtgtgtgccagagagaggaaaattaaaaatgcattgtataaaaggctgattggtagagaaagtgggtactgcttctgagaagaaagaatgaagtaggttgaagagagctagagacacacatatacacacagattaagagccaaacagcattcccagatgtctttactcttccatttctaggtgatatttccatgtatccttattggaaatttccttctggattagttaacagaatctactttagctagtttaagcagaaagggatgtaatgcaggaattaggtactcataaaattgttggaagggagaagagcaggctctaggccaagctttcagggtaacttcccaaacaaccaaacaaccctacagaagtggtccaatgaggaagttactgccctttccaggaagctggggaagcaagaacctgctcccacagaatcacactgcttttgtcaagatccacaccaggaagattcttgatacctgtgaagctgagaagtagccactgagctatttgctgctgtcctccttccaccctcccatactctcaccaactgtggggcatggcctctgcctcttgtggaggctaagtggtgtgcagaggctgcactgcagggagtctgagtaacgcggtctctacttgcagcagacggcatgcagtaagccatgtataggaaaacaatatagttcagtgagttaatctgcatatctaccttgccttctttcttctgaaatcaagtcctgttcattgtaacagtgcagtacttaacacattaatgtgaatgacaggctcttgaataagctgcaagggagccactagttttcttggaacgagatatctggggattcccacctcagagaccaacacaaagaaataaagacaaggtctggcgaaggttgggacattgtgacctttacagtgtctctcctgccctctttccacgatttttgtgccaattacttgttgacaagccccagagcttaagacatgggtacttcgctgtgaaatgagatgattatagaatagttatcaaagaggttagactatttttggcatcatcacagttctgaattgtagcctcagtaaacaacaagtcattactctgtcacacaatgtctggtgccctgtcctttttgtccttgcatctttaattcagacttttgccaccacgaagggtcacatccttccttggttctggggcagactgcagagccttgggttagcatgcagactcctctgtccatgtgcttgctgccaggcttgcgtggggtcttggaaagagcatagaatttgagtcatttgcttagccaattattagcgagggcctttatgcaagatgtgaaatcttcttaaaccttagattcttcatctttaaaatggaatcaaaatgcctgccatacaaatttgtggggattaagtgaaataatgactacaaaggcctttgtaactaacagtgcctggcacacagatcaggcatattgaatattagcttctttagggctgagtcttcacagctctgggctcaatcacattctgaagcttcacttttggtgaatgaatccttgccttgtggcccttggtttcaactgtgtctcagttccccaccatcttgtccttgccaggatccacgttgccttacccctcctgcccttggtctcctcttccgtatttagttctatggccagatatttgctacttagtagagatttctcatctgcctgcctgcacagctatctaatttttgagattctccattgcacacaccaccctttcattggtcatgacattctagattgctattgcttgcctgaactatcacctgttatttgtcacattattgtccagatgctgagttcaactttcctttttctcgtcacttgtagttgagtccttcttttacttccttcctacctacatctgccatcttcccctcccactccagcaaatatctttgtctcgggtcctggatgttaaccctctcatgccaggtagtgtttttagacacgaaacagagtcctctatgtccctgctgctcaggtgacacactggcatcgctgggagcttattagatatgcagaatctactgaatcagaaactgcattttaacaagatcctgaggtgattcataggcacatgaaattttgagaatcactgtgctataagtaaggaaatgtgactaggttagaaaatactttggtggtatctggcaaaaatctgttcaccttcctcctggtgatgttctagagacacatggctgcctcccaatatggcttgctggcacttctattaaaaggatggcaatatggtattctgtgtcttttcatcccaaggatgggttttgtgttgtaaggatgaagttcaggcttgtgacaagctgcagtgaaatgaaaattccggcaggctatgtatttgaagaaattcactctacgactgttctacttgcttctgagtcaaatcaaatgaagggatcctgcgtttatgaactgtacggtaaagagagagaactctaggaatctactttttatttttgttttttccctttttctaccctagccttcccaaaccttcttccatcagttcctctgaaaccagcaccagagtacagagcagaacatggtgactgagggcaaacgacagggggaagctttgagaaatggcaggtatttttggtgacttactgaactggtggcttttcctcctattgtttttgctcaaaacatgtctttgtaatattggattattatgatttttttcatttattcaaatacacccacaccctaccttttccctacttagaaactccatccttgtgctacaaggatgaatttgtaaaaatgtaaaaaaacccaccaaatcaatcgatccatatatggataaagaaacaggcttcaggcatctattatgaaaagtataggctgtgagtgatgtcaagagacctagacggcttctgcagcctaacttcactttcacttatcttgtcattatatggccatgggaaaaacgcagcctgcctctctttgcagttttgaacacataaatgctcccatatttctgatggagcttctaatgaagatgacttttccatttttcatgctgatatcagtttgacctgctcctgtccagttagcacacctgggtctgctgtccttttgtgaatattatgggctccatgatatgcacaaagtaatgtttttttttttttctgatgtgatagggtttgggagttggggcagaagacagagtttaaaagctgtaaaaataaataagaggaatggaaaggcccctaccttgcaagaatggaaagggctagagatcaatgggtaggaagattgaaagtgccctcaggccacttaataaatcaagacgtgatggaacttgcagataggtagaaaggcaaataattgctcacttcttgagcatagcatcggtggttaaaatacaatcagttaaattttagactcaggatctttctaaattgtggtgaatgcacaataactatcacttggcttaaaaaaatgacactaggaaaatatttgatgatgtagccacttctttaaaaagatgccatatgaatttttcaaaagtaaatagtgatgacttcaaagtgtgtgtactttggaaaaggctactgtatgtttacatgatacgagacatccacatgtatcatttctgcttccttgcaagaactgagggaagaggtgaatgcttccctattacaataaaatgctatacttatgtttaataattaattaagaaggaataaaaaggttcataacaagtggacctatcccagtccatactacttggtagccatctttagctgactaaagaaataacaatagacaggtttataaatcaaagtttggtttctggcagccaagggaagcatcatcattagcttaagacagactcctactaatggcatcaaattcagtctatacagcaggggttcttaaagtgtggtccctggaccaatagcatcagcatctcctgggaacttggtagaagggcagattctcaggcctcactctgaatcgctgaatcggaacctctgggggtcaggcccagtgacaagtactttaatagtaagctctcccagtgattcggacactcactgatttgggaaccactgctacccagtggtatctgaggagcgacgataatacaatagaaagtgccagggctctgaggccaagcctgagttccttcccagccttgctatcactcactgcgtgaccttggcaagtctttggcatgcctgaaccttgattttctcctctgcaaaatcagaatcatctcctttcctcacaggtctgttgtggggaaagtcagatgatgtgagtccttgttcacacagtaagtgcccagaaaaccttggtgcttttcctcttcccttccctgaagctgaacttctgcggaaaaatccaagaggtaagagccatcaatatttgtggaaaattaagagggttttcataaactcatggacattactcggtgaaagttggtgtcttgtactgagtgaactgtctgctgtccaggcctgtgctgtccaacacaggagccaaatgtgaccattgagcactggaaatgtggcttgtgtgaatgagataaactgcaagtgtaaaagacacattggaattttaagacttaacatgaaaaaaatttaatttataattttttatattgattacatgctgaaataaaagtttgggtatattgggttaaatatattattaaaattaatttcacctttttttaaaaaaaaatttaaactgtggctacagggacatgtataagcacatatgtggctcacagagttaactctgagtaactcgggcttattaataatgtccactcctaagtaaagttctatgagggataagtccccattccatcttccagcactcccacactgctttcatacaggcagaatcaagagacttgcttagcccctcagacattcaaaaaagtcagcgttcaggaaatgggagttctttaagcatcagcccactcttatcttctcttgcttaacaacagacaataaaaggcagttctctcagatgtctatttgtcctcggcgtgacttaaaaatcagctcaggaagtcatctgtcagtcaagtatattacagagagaaacatttgtgaaattacctgagttgagatgtctcaaatgacaatttcttatttgcacaacttaaattattcaagacaacacagacctgctctaatctttaaaaagactttagggttacgaggatttggttctctgtgttttaaatatttcgtcttcttttaagaacccaaccctatgggagactcagagagcattctaatgacagaaagaagcccctccttgtgtgtacctaggactgattacatgcatctatctcgtagcttgtttgagtgacgcttccctgagaaaaacaactagtcacatgaggaatgggccagatggtagacagatgactctatgcctgaaaaattgcatgagtaatatcattctttcacttcagttttatttatttatatatttttggtggggtgcagaaagctcccagttaattacattcaaataaatataggacacctgcttgatgccaggcactatgctagccacagtgggtagaactgaaagagacacggtcctattccagcttgaactaaaattgctataaatgacaagcccctctatacagccatgattatgttttattgattttcatgtatagggctcattgctagctttatttttattttattttaataattgcaacttttattttagattcgggggtacatgtgcaggtttgttacatgggtatattatgtgatactgaggtttggggaacaaatgatccctactagcggattacccaggtagtgagtatagtacccaataagtagtttttcaaccctttgcctgccacttctttccctcctccaggagtccccagtgtccattgttcccatgtttatgtctatatatacctctcatttgcaagtgaggacatgtggtatttggttttttgttcctctgttaattcgcttaggatgatggcctccagctggatccatgttgctgcaaagaacatgatttcattcttctattatggctgtgtagtattccatggtgtatatgtaccacattttctttatccaattcactgctgacaggcacctaggttgatttcatgtctttgctattgtgaatagtgctgcaatgaacatacaagtgcacatgtcttttttgtagaacaatttattttcctctgggtatctaaccagtaatggaattgttgggtcatatggtagttctatttttagttctttgagaaatctccaaactgctttccacagtggctgaactaatttactttcccaccaaaagtgtataagtgttcctttttctccacagccttgccagcttctgttgttttttgtctttttattaatggccatttggactggtgtgagatgatatctcattatggtttagatttgcatttttctgatgattagtgatggtaagtatttttttcctatgttttttgtctacttgtatgtcttcttttgagaagtgtctgttcatgtctttttttaaatgaagttatttgttttttgtttgttgagttgtttaagtgccttatggattctggatattaaacctttgttggatgcatagtttgcaagtattttctcccattctgtaggttgtctgtttattctgttgatagtttcttttgctgtgcaaaagttctttagtttaattaggtctcacttgtcagtttttgttttttgttgcaattgcttttgaggacttagttataaattatgtcccaaggctgatgtccagatggtatttcctaggtttccttttaagattttatagtttgaggccttacaattaaatctttaatccaccttgcattaatttttgtatatggtggaagataagggtccagtttgattcttccgcatattgctagccagctatcccagcactatttattaaatagggagtcatttcttcattgcttatttttgtctactttgttgaagatcagatggttgtaggtgtgcagctttattttggggtaccctatcactttcttttttctcacttgtagggcaccattctaggtactaggcctatggtacaacaatgttacatttaaaaaatattaaaggcacatttaaatttaattttagcatcagtgaaagagatattttacgcacacagtagtgaaaaaagttgtcagaatctctgcttaatattcaaagcaaataatgcttttctgaatgaataaatgcttctttaaaaggtaacactgtgggctgggcatagtggctgatgcctgtaatcccagcattttgggaggccgaagtgggtggatcaattgaggtcaggagtttgagaccagcctagtcaacatggtgaaaccccatctctactaaaaatataaaaattagccaggtgtggtggagcatgcctgtaatcccatcttcttgggaggctgaggtacgagaatcacttgaacctgggaggtggaggttgcagtgagctgagagggcaccactgcacttcagcctgagtgacagagtgagactgtctaaaaataaataaataaataaaaataaaattgtcgtgcttaaaatgtaatatagatacacatttcagattgtttaagtatatcctcccccatcctaggagaaaagatttgtctaaaaagagactggatattaatttcatttcattgtaactgacaattttgtatttatattttatagatgccagactcttgctgttgatattagtatgaacatcaacattaggctataataataagctatcaaaggttcagtgcaaggtgtgtctagttaaaaattaggaacaagcttaataaaaacttgtaaactaatctcagtccttacttctcatttgctttggattgaagaaagtgtgtggagtgtgagtgtgtgcacgcatgtgtttttcaatgtccccaaacagcactatttatccagctgtctacttccttaaggacagatctccatccccactccccatcccaacccctggccccatagcaagacttatttatccttagttaccaactagcttattaaaactaatactaggctgggtgtggtggctcacacctgtaatcccagcactttgggaggccaaggcaggtggatcacctgaggtcaggaattcaagaccagcctgaccaacatggagaaaccctgtctctactaaaaatacaaaattaaccgggcgtggtggcgcatgcctataatcccagctactcaggaggttgaggcaggataatcgcttgaacccaggaggcagaggttgtggtgagccaagattgtgccattgcactccagcctgggcaacaagagtgaaactccatctcaaaacaaacaaacaaacaaacaaagaaacaaacaacaaacaaacaccaaaaaactaatactacactagtcactggggcttcttccattaatatatgtgggtgtttctctctgtgtgtgtgtgtgtgtgtggtggtgttgggggttgggggagagaaagagagacagagagagagacagacagacagacagagagacagagagaacttgcttagacctgctttttgcatcatccagcatttagtttccctgcttcctcagctaggctatgttcactttttctagtcaatcatgagaagtatgtgactccttgtgtgaattgcatgagtggccccaattctacacccttcccagtacccatgtcctttgttgtgtcattttgtggtgcttttcccctgtgtatggggtatatggtccagccatgacttactttggctgatgggatgttagcaaatgtgacatagcagagactccagaagtccttgtgctgctgggcttgactattctgtgccgtgtcatcacctggaagacattctagtctgctagttccaggaagaaaatgagagacatgtggggcaaagccacccccagacaaatctagcctagatgttctaatccctagacttgtgaggaataataaataattatctctttaagccactgaatattggggtggtttgtatacagaaatagtcaatggacccacttccttcttcctcctcatgcagaccccggatcctccccttctctactccttagatgaaccgcactctgccccctagcacctggtgacaaaaagtgagaacttctgtagcactaggaaaatagaagagaaaacaaggggaaaaaatgagagtaaaggagagaagactatgctgatgccatctgagagattcctatgggaaagatggaaaaattaaccatcaccatgctcctcctgttccttaatcagttctctcatatcctttctttttcccaacccttatttcctactctcaatgctttctgttcccactattgatctgcatcatgaggccagggttctttcgcaattattgctaacatttattgaatactaattatatattaagcactgagctaagtgccgtacttggattatgtgttttaaacctcactatggcactgtaagatggacaacatggtctatattttacacacgaagaagcttaagagtcatcaaatgatttgctcaggatccacagctagtaagcagtgaagctaaggctctaatccaggcaggctgacaacaaagcctgtgctcttccccctataccacactgtcctttcttgttgaatcctcttcatcctctcttccactgccattcttctccccttccataggcaaccattaacgtatatatttttatgtgaatattttttgcacagtgaagatggttgtttggtacacattgtttctaatttatctaagtgataattatttcttattttattctgtttcttttttttattaagcattctgtttttaagatccatacacttcgctatgtgttcatttaatttgttgcctcttacctgctacctagtactccatggtttctactcatcccaaattctttatccacccctccatagtgaacaaccagatttcctccaactccccaccacaagtaatgctctagtgaatatcctcatacatggtcccttaaggcccaagtgagaaatttcctgggtgtaaatccaggagcagaattggcatgtcacagggaatgtttatctgttggactaaattgctcctcataatggtctgcactcccactggcagcacgtgaaggcaaatctatgcctatgatcctgtctaaattctgccagcctgaaaggtgcaaaccgataactcactgttttaacttgcatttacctaattaccaattatttgggcatttctttacatgctggctctgtttttgagtttccttttctaaaaattacctattcataatctgctcattttgtaattgagcttttttttttcttattgattcagaggaatcctttgcttattctagatacattggctagaaacattccaaatagcttctcccaatctatcatctggtctttgtgtttgctgtctctcatgaacagaagtcctattttgatgttttcaattaatatatatttttgccttattgtttgtgccttttaagttttgtttaaaagaggcccctgacctctattctcaaatattgaatattgaaaaaaaattctcaaatattttcaaaacatttttgtccattatctttatgggtttacatttctattatttcccctttaaatatgactgttaaaataaccttataatattatgagtgaaataagctttaaagagtaggtccaagaacttgatcactgtatacatcaattgtttctgtgaaaagcctgtgatctgagttccaagacatcaatttagaagtggacttttggaatagagcctgtttatgcattcaaggttgccaggatatttatgaaaggaactctaaagttctattatagtggtctggccattgttgttggcctcagtatcgttacattataatcatagtgttaatgtgattataaatcaccaggggcagtgttgcttaaagtgtggtcctcaaattaattgcattgcatttacttaaatgtgcttgttaaaaataaagatttcatttgtcaaaacccatagaatgtacaacacaaagagtgacccctaatatttggttgataataatgtgtcaatatcagttcatcagttgtaataactggaccacactgatgtaagatattgatggtagagaggctgtgagctggtggagaagggagtatgtgggaactctctttactttgctcagttttgctgtacacctaaactgctctggtgcccaacgtggaggcttttctctagggtgaaggtacactcgagcgtggtcattgaggacaagtcgacgagagatcccgagtacgtctacagtcagccttacggtaagcttgtgcgctcggaagaagctagggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcgtttcagtttctgatgcccctggaagctgtttaatagattgtaatgaaaagacaaggaaaaaatcccagaaagaaacagaaggtttacattgcgaatatgtagcagagccggtaatggctcagtcaacgcaaaatgttgactataatcaattacaggaggtgatatatcctgaaacgttaaaattagaaggaaaaggtcccgaattagtggggccatcagagtctaaaccacgaggcacaagtcctcttccagcaggtcaggtgcctgtaacattacaacctcaaacgcaggttaaagaaaataagacccaaccgccagtagcctatcaatactggccgccggctgaacttcagtatcggccacccccagaaagttagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaacgttagaaccgatgccacctggagaaggagcccaagagggagagcctctcacagttgaggccagatacaagtctttttcgataaaaatgctaaaagatatgaaagagagagtaaaacagtatggacccaactccccttatatgaggacattattagattccattgctcatggacatagactcattccttatgattgggagattctggcaaaatcgtctctctcaccctctcaatttttacaatttaagacttggtggattgatggggttcaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtgcctgcccctcatttaatacagtaagacaaggttcaaaagagccctaccctgattttgtggcaaggctccaagatgttgctcaaaagtcaattgccgatgaaaaagcctgtaaggtcacagtggagttgatggcatatgaaaacgccaatcctgagtgtcaatcagccattaagccattaaaaggaaaggttcctgcaggatcagatgtaatctcagaatatgtaaaagcctggattgaatcggaggagctatgcataaagctatgcttatggctcaagcaataacagaagttgttttaggaggacaagttagaacatttggaggaaaatgttataattgtggtcaaattggtcacttaaaaaagaattgcccagtcttaaataaacagaatataactattcaagctactaccacaacaggtagagagccacctgacttatgtccaagatgtaaaaaaggaaaacattgggctagtcaatgtcgttctaaatttgataaaaatgggcaaccattgtcgggaaatgagcaaaggggccagcctcaggccccacaacaaactggggcattcccaattcagccatttgttcctcagggttttcagggacaacaaccccccctgtcccaagtgtttcagggaataagccagttaccacaatacaacaattgtctcccgccacaagcagcagtgcagcagtagatttatgtactatacaagcagtctctctgcttccaggggagcccccacaaaaaatccccacaggggtatatggcccactgcctgaggggactgtaggactaatcttgggaagatcaagtctaaatctaaaaggagttcaaattcatattggtgtggttgattcagactataaaggcgaaattcaattggttattagctcttcaattccttggagtgccagtctaggagacaagattgctcaattattactcctgccatacattaagggtggaaatagtgaaataaaaagaataggagggtttggaagcactgatccgacaggaaaggctgcatattgggcaagtcaggtctcagagaacagacctgtgtgtaaggccattatttgaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtactgagattttacattgcttagggccagataatcaagaaagtactgttcagctaatgattacttcaattcctcttaatctgtggggtcgagatttattacaacaatggggtgcggaaatcaccatgcccgctccattatatagccccatgagtcaaaaaatcatgaccaagatgggatatataccaggaaagggactagggaaaaatgaagatggcattaaaattccagttgaggctaaaataaatcaagaaagagaaggaatagggtatcctttttaggggcggccactgtagagcctcctaaacccataccattaacttggaaaacagaaaaactggtgtgggtaaatcagtggccactaccaaaacaaaaactggaggctttacatttattagcaaatgaacagttagaaaagggtcatattgagccttcattctcgccttggaattctcctgtgtttgtaattcagaagaaatcaggcaaatggcatatgttaactgacttaagggccgtaaacgccgtaattcaacccatggggcctctccaacccgggttgccctctccggccatgatcccaaaagattggcctttaattataattgatctaaaggattgcttttttaccatccctctggcggagcaggattgcgaaaaatttgcctttactataccagccataaataataaagaaccagccaccaggtttcagtggaaagtgttacctcagggaatgcttaatagtccaactatttgtcagacttttgtaggtcgagctcttcaaccagttagagacaagttttcagactgttatattattcattatattgatgatattttatgtgctacagaaacgagagataaattaattgactgttatacatttctgcaagcagaggttgccaatgcaggactggcaatagcatctgataagatccaaacctctactccttttcattatttagggatgcagatagaaaatagaaaaattaagccacaaaaaatagaaataagaaaagacacattaaaaacactaaatgattttcaaaaattgctgggagatattaattggattcggccaactctaggcattcctacttatgccatgtcaaatttgttctctatcttaagaggaaactcagacttaaatagtaaaagaatgttaaccccagaggcaacaaaagaaattaaattagtggaagaaaaaattcagtcagcgcaaataaatagaatagatcccttagccccacgttgggcgccagatgtaggggtgggttgcccctccacacctgtgggtgtttctcgtaaggtagaacgagagacttaggaaagaaaaagacacagagacaaagtatagagaaagaaataaggggacccggggaaccagcgttcagcatatggaggatcccaccagcctctgagttcccttagtatttattgatcatttgtgggtgtttctccaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcggttttcccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggctatatttcagactatcacatggggagaaaccttggacaatactggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccattcaactctgagttgacacagcacatgtttcagagagcacggggttgggggtaaggtcatagattaacagaatctcaaggcagaagaatttttcttagtacagaacaaaatggagtctcctatgtctacttctttctacacagacacagtaacaatctgatctctcttgcttttccccacactctaaaaatacaatttattaattgaagaaaaaaagattacagagctgttccttacaactactgaagtcagaatttgcatttaagataagtatcccaagtaaatattatgctcttagaagctccatagctactacctgaaaattattatttgcataataataatgataaggcttgctgtgggtgtcacttagtgggtgtgcattagctggtgaaggaagggattaattcagaatgcatcccaagagacagccaaagagaaatgagtttctgagtaatgggggaatagtctcccaagatttattttaacttctataataataaaaattgtattacttatatttgcttgacacttggcttttacttgctgtgtttatggtgaggaaagtaaagatatgttctggacaaaacacagggacctacaaacctactagcactaaattttcatcaccctgtgtatgaactaaagtgatcgtattttctacacgggggattcttgtctttattgtttcttctgcctgggcagaatctcttccctccgttacttctgaaggacacctcatcccaaattcacatagacatttttaaggcttggctttgttcctcatctgtctatcaatacaacgagggaattctcagccaggttgaaaatgtgtaacattctaagaagtcacatttccatcaggggaataagggctttctttggggactgtcatcgaacttgcagaaatagctacacagtttgagttccatggatggcaaatgtgataaaagaataaatgttgtaaaggaataaccttttagtctcttacctcataaatacaggtgtatgtggggagattataagaaacaaaacaaaaaccgaaaccaactgaccaactatgatcacccttatatttaaaaatatttgtaaagcaaccagatgaaaaaattaaatttaagcatgtggaggaagcaatctccagatcttcatgaggcctccttgatgattcagtgatattaggaacaaagggagacagcagggcaaggtagtgaggggcatgggctatgcaccccgttaatcaaacactatataaatgttggttaaattaaatcaaagcactaaaaatgacaatagttaacatgtgttagatattgtgaaagacagttttacatgcattatctctttttatttttataaaatctctatcaggcaggttctattaatgcccttatagatgaagacacttaagtttgcccaaactcacagagctagcaggtagcacaaatcagtttcccaaggctggcagagagctctgtttccaagaaaaggcaacaataaaattttatcagaaatgtgatttttttagcctgtgattgagtaaaactttctatgtcatgggttacttactgatttctaattataataaaacaaactggtgagatttcatttcctctctctgcgccttggctttttcatcagtaaaacaagggagttaagtgacttcattggtcctcaatactggctgtgcattggaacctcctggggagtttttcattcctagatctacttcataccaactgaatgagactctctggagtgggacccaatccctggaatacttttttttttgagatggagtctcgctctatttcctaggctggagtgcagtggcatgatcttggttcactgcaacctccaccttatgggtttaagcgattctcctgcctcagcctcccaagtatctgggactacaggcatccgccaccatacctggataattttttgtatttttagtagagatggggttttgccatattggccaaggtggtctcaaactcctgacctcaagtgacccatctgccttggcctccttaagtgctgggattacaggcataagccaccatgtccggcctggaatccttttaaatctcccccaggtgattgtgaagaaccagggcctctctgcctctgtcactgcatttcaatatttctttaccttgatccccaatatagatgagaggggacatttgttttatcacccctaagttactacacccccttagtagctgaagcatatgaattgttgacctaagtttttcaagaagacaaaatttctctgtctggaccaattcttgaaagcctcccccttttttcagacaagcttatggcatgcagcaccccaaataaaataatctgaactaatacaggactacacattttcaacccagggcagctctggattgggtacctgaatttggcttgggctagtgatttctgactgagaaaagtattcatccagcctctgaggaaatataatgaatgaagatgggattgggaatttgtgttctacaggcatctaggaagagtcttgaataatttgtcagtttttcctcctgttattgcattggttcttggtacatacttacagggttataccacaacaaatattcatttttgaaacatactatattaattaggaatgctttcagttgcaagtagcagcacattcaaccatagtggcttaaataagaagagttttgtttttctcatgtaaaattcctggaatttgttttaaaaacttcacagtgtgcaaatctctgtgattcccttctccatttcctcacagtcattggatggtggctgcagttcctgctatctcttttatgttcctttaggaagaaggagaaagaggaaggggcagcttctgtatcaggaaagcaaaagtttcccaggaaccctgcagccgactcctgcggacaatttgttggccagagaggaaagggagttgggaagtgtcagccaaccaccagggtctgctttggcttggatattttgtggggagtatcagaagctcagttttggaaatactaagtttgagaagctaattagatattcaaaaaagggtatcgggtaagctgttgggtatagagaccaaagttcattgaagggatgggaggaggcttacttaaacttgggagaaatcagaatatagatgttatttaaagttgtgacacctgatgagattacctaaggaagtgtgtgtagctagaaaggatacaccagttaaagagtggagccatgtgagaggaattggcaaaggagaccacatcagaagagcccagaaagaaaattaggcaaggtcagtgaccggaagccaactgaagagagggtttcaagatggggtcagtagttaactgtgaaaaggctactgacaggtcaatataaggattgaaagttgcgcatgagatttagcaattgggaggttggagtgaccttggtaagacagtgcctgtgaaattctgaggtgaaaacctgaatggaatgagttcatgaaaagagtgggaggagaggaattagaagcagcatgaatataagacaattctataagggcatctaaggtcagctccaactctcagattaacttgagcccttctgaaaatgtgacaggatatatgcagtttctttagaggcacattctgagatgctttgatgaccacaaggactttgttaaacacaaatcccatcaggaaacaggcagttcactatgaccttatgaaagttttaattcaaagcacttgaagatacttttttttctgggcttcctgatcttacttcagtaaggtttttataaagttaatatccaagtaagagtatagctttcaaaggctattcctcattcttaaatgcattaaactgttgattaataacattatctaaaagctgtcaaataaaaataagaccaaactctttacttgtacagagtggactgatcaagttgaaagcaacagaacaagcatctataagaattgattatatgtcccagcactttggaaggctgaggcaagtggatcccttgggcctaggacttcgcgagaccagttgggcaacatggtaaggcactgtttctaaaaaaaaaaaaaaaagtaccaaaaaaaatttgcagggtgtggtggtgtgtgcctgtggtcccagctactttaggaggctgtgggaggaatacctgaccccaggaggtcgaggctgcagtgagccgtgatcatgccactgtattccagcctgggtgacagcgtgagcgtgagaccctgtctcaaaaaaaaggaaaaaagaattgattacatgatactgtgtaaaacaaagaacttgaaattttgagtaaaatgatttgtgtttgagtcttgcatccaatccttcctagctgtgaaaatttagataaaatattaagcttttctgtagcttggtttttgatgtgtaaaatggggataatgataaacatctcacagggttattgcagagatcaatgaaaaggttatatgggaaaatgcttagtaatgagaataaataaagcctatgtagatattattgattataaattgctttcacacacatgcttttgttggactctctcaaatctatgtaggaggcagggatgggtattgttaaatatttttaaatattttaaagaaatactttaaagaaggtaaagcccaggctctaagatgttaaggggctaggccaaagtcacatgactaatacctgccagagttgagaccagaaatagttttctgtctatgatctggggctctgtccactattaaggtgttcacatggacaccacatggtatcagaatccagtgaggcaaggaggctcctctgccatggaccagagtttctaaattgcactcattctactcttggtggtatgagtgtatgggcctctgacagcatgggtccgtgggtgggtacacatctgaagcaggaaacattcagggcatcctagagccccttcccctttgacttttttgtttgtttgtttgttttttgagatggagtctctctctgtcgcccaggctggagtgcagtggcgtgatctctgctcactgcaacctctgcctcccaggttcaagagattctcctgcctcagcgtcctgagtagctggaactacaggtgcccaccaccatgcccagctaatttttttttgtatttttaatagagatggggtttcaccatattggccaggctggtctcaaactcctgtcccagtgatcatcctgactcggcctcccatcccctttgacttttacctatcccctcccctagtcaacactgcatactaacaagttcctaaaagagtatttaatgtgctcactgatatgaaggcaggagcatttactgccctcatgtcctctttttaaagaacacctctgaagatatccatagaattgaaatatattatagctagaaagaccctcagatgacatttggtcatgccctgcatttcacaggccaggaagcttaattttggaactattaagatattggcccaaggctcctcagctggtgtcagagacaggactagcactgggcagcttgatccaagtggacaatctttccactacaccacaccgccactcccagtgtggccatagcatggtgtgatacctaaaacaaaaattttgaaagatttctcaattagttgcttaaataaagtgaatttattctacctcctccactatagcattgaaaagagcttaaacccttaatatataaatggtggctggagtcacctcttgatggttaatcatgtattctcatttgtagtttaagtgctagaagacaaagtaactttaaaattgttcaggagaggacccaattatctgataagaaattccaaagaccatatacacaaatgcagaaacagacctctttatgaatggtgtctgacaaggaaagagatatttgtggcataggagctctggaaaatgtaattatttatcctttcataattaatgaaagaaattgaaaatgaagctttcatttcaaatcctttttatctggatgaaactttaattttacataattaaattgacttcacagttcagtgtgttaaaatatgcaattaagcagcatatcaaggttaaatgcctactgttattggctcatttagaaatcatgctgctgaactcccaaacaatacctgcctgtccatgatcagccccagagccagggatagcacacatcctgtagagctgctccccaaattcagagcaggcagttgagttttcttgcatgtgccagctcctatataaagttagttggcactggacattgcagctcacacttgtaatcctgctgctttgggaggccgaggcaggaggatcccttgaaaccgggagtttgaggccagcctgggtaccctgtctctacaaaaaacaacccccgccgccaatacacaaaaatgtagcaggatgtgatggcacacacttgtagtcctagctactccagaggctaaggcaggaggatcgcttgcacccaggggttcaaggctatagtgagctatgatcgtgtcactgctctctggcctgggcaacagagtgagactctgtctctaagaaaaaaaaaaaaaattaagttagttagatatttaaagaggtttcacttttctttgtttttcagtggggctttttttttttttttttttggcataaagaaatattctggcacttcactggagctccatggatgattcagtttatctcttataaaggttttctttaagacaacagttgtgtcttcaaacttgttgccttctgtttcatgaaagtacatttttaatgtactttttaagtatgttaaaattccttcattttaattttcccactttacaatttatgataaatcttagctgtgacttctttcaaatgatctcgtggaaaggagaaacttaggcatgtgggaggcattgaagggggacactgaaaagaggattggggctagttgactgaagtgtgtcaaggaaaaagcagtctgtagaagtggagacttttagctgtgtacacccctcccttgttttccttttgaatatcacctttgtgacgattaatttatggttcagcagcatcttgtattccctttcatctaaagactctgtgagtagagcatagttcaacaattagaattgagctttttcccttcccttacatattttagaattcatgtaacagtgattttttgtgtatccattaggtggaatgttgggaagcattcatggatctaagcaatatccttgctgcaatgacacttagaaagcctgaatctatatggtggctgatatggtttgcctgtgtccccacccaaatcccaccttgaattgtaataattcccacatgtcaaggccaggaccaggtggagattaattgaatcatgggggcggtttcccctatactgttctcgtgataatgagtaagtctcacaagatgtgatggttttataaatgggagttcccctgcataagctcttgcctgctgccctgtagatgtgactttgctcttcctttgccttccaccatgattgtgagacctccccagccatgtggaactgtgaatcaattaaacttctttcctttataaattacccagtctcaggtatgtctttattagcagcgtgagaacagactaatacagtggcctttccagataaatggggaagtgtgttgctgcattaattacaatagccacaaaaagaagacatcatcatgacatgaaagtgacactcaggaagaacttcacattaggggcatattctacaatttcaggctattctcactataatgctcttgttgttcattatgggatgtaagtgatataattggtagaccattgcatttgttcattttcatgctgctatgaagaacttcttgagactgtgtaatttataaaggaaagaggtttaattgactcacagttccacattgctggggaggcctcaggaaacttacaatcatggtggaaggggaagcaaatacatccttcttcacatggcagcaggagagagaagtgccagcgggggaaatgccagacacttataaaaccatcggatctcatgaaaattactcgctatcatgagaacagcatgggggagccacctccatgatctaatcacttcccatgaggtccctttcccaacacgtggaaattataatttggattacaatttaagatgagatttcaatggggaaagagagccagaccatatcaaccataaaactggaagattataaaagacattacagtgtgtatccctttcagatgtgtaatctctatcagaatgtatgaatactttgctctgttgagccaagtcttgagatatgacattgccttcttccatgacactgaaagtcatcatgtgctgaataaattcttctaaaattccaagctggaactagatttgcttgtctcactgcattgccctgaaaccaaaaggaagccttgactaccattgtacatctcagtagttttatcagaaaaaaacttaatagtgaaatccaaaacaagaacagcagcaaaaaaaaatagtgaaaaaagtcttaataggtgaaaagttatatcaatgcatccatgcaatttgtaaaagcacccatttatatataattaattacacaatttcaaattattcttatatttttagttaaaaccaacctctcttcctttagaatctatagaagatagcattgatgacatttaattttgataattacatgcacctgaacactactaaactactgtttaatgaaactatattcacacatacaacatacacaactactgattggtctttccgcaaacaatctgactttggaagcttcaatgtttagcaagtgtttaaataataccaaacaataaagactactttgtatagcaagtgtaaatcttgtaccatttcccaggaacatgcaggtttgactaaattttatacaaggcttagaaatcctggtctgattttgtatagatcccattgcatgagggtctgatattccctacaatagagctgtttacatcttctcagagtctgagattaaggaatttcaattgagaaataaaaatgtggtgcaactgaaatgtttcatcaatgtggcctgatgatcccactgctttattggatctatctggtttgatacagatgaactcctactaattttcgtccttcagaacaagatggaagaaactacggtcacatatgcaaatggagaagatgatgaacacagaaaaattatgcaaagataatccctaaaccttctttctcatcaaaagttatagcaaggtggtttaatatatcactgacggaacacgatgctttgtttaatgaagactcagacggaaaggatcagacatcaacctataaatgcatcaaccagaaggaaagaccaattttgaaaactgttgagcattattctatacctctaagctgttcttttctgaaccatgaatcgggagaattattgtcactcatacatgagtatgagttgtaattctcaattcccaagtaaaaatcttcctgct

SEQ ID NO: 84 - DNA, 8590 bp, Homo sapiens
gatcagagtgggccactggcagccaacggcccccggggctcaggcggggagcagctctgtggtgtgggattgaggcgttttccaagagtgggttttcacgtttctaagatttcccaagcagacagcccgtgctgctccgatttctcgaacaaaaaagcaaaacgtgtggctgtcttgggagcaagtcgcaggactgcaagcagttgggggagaaagtccgccattttgccacttctcaaccgtccctgcaaggctggggctcagttgcgtaatggaaagtaaagccctgaactatcacactttaatcttccttcaaaaggtggtaaactatacctactgtccctcaagagaacacaagaagtgctttaagaggtattttaaaagttccgggggttttgtgaggtgtttgatgacccgtttaaaatatgatttccatgtttcttttgtctaaagtttgcagctcaaatctttccacacgctagtaatttaagtatttctgcatgtgtagtttgcattcaagttccataagctgttaagaaaaatctagaaaagtaaaactagaacctatttttaaccgaagaactactttttgcctccctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaattgttgtggttcttttgtgaataaaaaaatcttgattggggaaaaaagatgggtgttctgtgggcttgttctgttaaatctgtggtctataaacacagcacccataattacagcataatcttcaagtagggtacggactttgggggattggtgcgagggtagtgggtgagtggcctactaaaaagcccagtaacccccacaggaaaatagggaacttctttttaagtagcctcctttccactatttagtaattggctgtgagctgggctgggggagaaatggggcggggtgtgtgtgtcattggaaagctctcttttttgtttttttgagacagtctcactttgtcccccaggctggagtgtagtggcatgatctctgcaaactgcaacctccacttctggggtccaagtggttgtcctgcttcaccctccctgtagctgggactacaggtgcacaccaccacgcctggctaatttttgtatt

SEQ ID NO: 85 - DNA, 3570 bp, Homo sapiens
agcaacgagcgacggcctgacgtcggcggagggaagccggcccaggctcggtgaggaggcaaggtaagacgctgagggaggactgaggcgggcctcacctcagacagagggcctcaaataatccagtgctgcctctgctgccgggcctgggccaccccgcaggggaagacttccaggctgggtcgccactacctcaccccgccgacccccgccgctttagccacggggaactctggggacagagcttaatgtggccagggcagggctggttagaagaggtcagggcccacgctgtggcaggaatcaaggtcaggaccccgagagggaactgagggcagcctaaccaccaccctcaccaccattcccgtcccccaacaccaaccccacccccatcccccattccccattcccatccccacccccacccctatcctggcagaatccgggctttgcccctggtatcaagtcacggaagctccgggaatggcggccaggcacgtgagtcctgaggttcacatctacggctaagggagggaaggggttcggtatcgcgagtatggccgttgggaggcagcgaaagggcccaggccctcctggaagacagtggagtcctgaggggacccagcatgccaggacagggggcccactgtacccctgtctcaaaccgaggcaccttttcattcggctacgggaatcctagggatgcagacccacttcagcagggggttggggcccagccctgcgaggagtcatggggaggaagaagagggaggactgaggggaccttggagtccagatcagtggcaaccttgggctgggggatgctgggcacagtggccaaatgtgctctgtgctcattgcgccttcagggtgaccagagagttgagggctgtggtctgaagagtgggacttcaggtcagcagagggaggaatcccaggatctgcagggcccaaggtgtacccccaaggggcccctatgtggtggacagatgcagtggtcctaggatctgccaagcatccaggtgaagagactgagggaggattgagggtacccctgggacagaatgcggactgggggccccataaaaatctgccctgctcctgctgttacctcagagagcctgggcagggctgtcagctgaggtccctccattatcctaggatcactgatgtcagggaaggggaagccttggtctgaggggactgcactcagggcagtagagggaggctctcagaccctactaggagtggaggtgaggaccaagcagtctcctcacccagggtacatggacttcaataaatttggacatctctcgttgtcctttccgggaggacctgggaatgtatggccagatgtgggtcccctcatgtttttctgtaccatatcaggtatgtgagttcttgacatgagagattctcaggccagcagaagggagggattaggtcctataaggagaaaggtgagggccctgagtgagcacagaggggatcctccaccccagtagagtggggacctcacagagtctggccaaccctcctgacagttctgggaatccgtggctgcgtttgctgtctgcacattgggggcccgtggattcctctcccaggaatcaggagctccaggaacaaggcagtgaggacttggtctgaggcagtgtcctcaggtcacagagtagagggggctcagatagtgccaacggtgaaggtttgccttggattcaaaccaagggccccacctgccccagaacacatggactccagagcgcctggcctcaccctcaatactttcagtcctgcagcctcagcatgcgctggccggatgtaccctgaggtgccctctcacttcctccttcaggttctgaggggacaggctgacctggaggaccagaggcccccggaggagcactgaaggagaagatctgtaagtaagcctttgttagagcctccaaggttccattcagtactcagctgaggtctctcacatgctccctctctccccaggccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtctgagttccaagcagcactcagtaggaaggtggccaagttggttcattttctgctcctcaagtatcgagccagggagccggtcacaaaggcagaaatgctggggagtgtcgtcggaaattggcagtacttctttcctgtgatcttcagcaaagcttccgattccttgcagctggtctttggcatcgagctgatggaagtggaccccatcggccacgtgtacatctttgccacctgcctgggcctctcctacgatggcctgctgggtgacaatcagatcatgcccaagacaggcttcctgataatcatcctggccataatcgcaaaagagggcgactgtgcccctgaggagaaaatctgggaggagctgagtgtgttagaggtgtttgaggggagggaagacagtatcttcggggatcccaagaagctgctcacccaatatttcgtgcaggaaaactacctggagtaccggcaggtccccggcagtgatcctgcatgctatgagttcctgtggggtccaagggccctcattgaaaccagctatgtgaaagtcctgcaccatatggtaaagatcagtggaggacctcgcatttcctacccactcctgcatgagtgggctttgagagagggggaagagtgagtctgagcacgagttgcagccagggccagtgggagggggtttgggccagtgcaccttccggggccccatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttattcagattgggaaatccattccattttgtgaattgtgacataataatagcagtggaaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataatt

SEQ ID NO: 86 - DNA, 35608 bp, Homo sapiens
ggccgcgagatggggaagatggcagcggccgtgggctctgtggcgactctggcgactgagcccggggaggacgcctttcggaaacttttccgcttctaccgtcagagccggcccgggaccgcagacctggaaggggtcatcgacttctcggcggcccacgcagcccgtggcaagggtcctggtgcccaaaaggtacagagagaggagtggcgcgcgtctctccatcgctttgccccgcgtcttggagggacttacgtgtcttcttcgcctcttttcacctccagaccgattgttattgaacgattcctgacctcctttggctgcagagtcgaactccccactaaccgtcacacttagcaataaagcgttgagatgcctgtttctttaggcggccattcctggcgggggcgctcagtcaaaagagcctgggaatccgtgtttatttcttactgtaactgtctcctcacatttctgtttgggtttttgtaaaaccccatagaacgtctttgtagacggtagggtagacttctgcagcttaaaaaaaaccactcccgaggaatcccagaactgacagggatgcggcgctgtttgttaagccactgtgcgtaaaactagtccctgtcttctcctctggctcttttagaaggaggtcattgaaggattctgagaatccctccgtgttgaaaataaatggcaaacaagtatatatggaatacaggcaccgttctctctctcagcttttccccatggagattaagaaggggaacacagtccgggagcggtggctcaagcctgtaatcccgcacttcggaggccgaggcgggtggatcgcttgaacccaggggttcgagaccagcctggggcatggcaagacccccgtttccgccaaaaatacaaaaaattagccagtctcataacctgttctcaagtaaatagattttttaaaaattatttttttaagggaacataacaggcaagagggaaaacggggaaccaaaactgtagtccaatttatattttctttctttacaatccactttaacgttgaggatatgcagtcccttaatttgctcttggtgttgtccacagatgtctagatgaggcattctttccaagcttcctaacagctctgataaaattgggatgctacagtattaagtgttaatgattgcatacttgagctcagcttttcagcaccttcatttgttagggaaaaaaagtggtcttagagttgtcaaaatacagaaagtccacaccccaataataatatactttttctctccagagcgcttcagactctcattcagctccttttacctacattttaccataatatgtacatgctttttagaatgtcagccatcagggaatgagccattatgtgtctagtacaggacctaaaacagtactaagtacagtatgtgttgagtacatgaaagcttgggtgtttagttcctcagctcaaagcagattaaagtagtaattaagagaagttactattacaagccagctgatgagactggtggggaaagtggtggttaacagtctggcaagggaggaaagagaaaaccttttataaaagctcagtggtgtcgttcagtttagcatatgatagaataggtccactaacatcacctctgagagtgtgttgaattatagtgcagtattaagtatggcctattaaagaaatcatgacaaaatgcttaaaagtgttttaccagtgcctaggtacctggaaaactcagctgatagtactgtcagagggtttcatatagcccttttattatagagactggttatacatcagcaaacttttggtattttgtccaggaatctccacacttggagaagttgataagataaaagatcattctctttcaaagagaatgtttcatatatatatatatgtgtgtgtgtatatatgtgtgtgtatatataatatatatacttttttttactgagacagcgtctcactgtgtcacccaggctgaagtgcagtggcgtgatcttggctcactgcaacctccatctcctaggttcaaatgattcttctgcttcagcctcccaagtagctgggactacaggcacgcgccaccatgcctggctaatttttgtatttttagtagagacggggtttcgccatgttggccagtctggacccaaactcctgacctcaggtgatctacctgccttggcttcccaaagtgttggaattacaggtgtgagccaccgctcggcctgtttcatatattttaaggcaaggcagaccctaggtttactattcagggaagaataaaggttttttcctttaatgttttgacttcaatgactgcatagtgggtctcttaaccaatgtaatgagccatccattagatactcacatacaaagaaaacttcagcccctgaaatactaaattcatttctaagtaattaacagaagcagaagttgtagcgtcagttggacatttcatctagaagagggcaaacaggattttttagcttttacttttagcagacaggattcccagtgtctcactgcaacattttttctgtctgtttacagcactctcttttcattctctttttttttttttttttttttcttagacggagtcttgctctgttcctaggctggagtacagtggcacaatctcagctcactgcaactttcacctcccaggttgaagcaattctggtgccccagcctctcgtagctgggatttcaggcgcccgccactacacccaactaatttttgtatttttagtagagacggggtttcaccatgttggccaggttggtctcggactcctgacctcgtgatccgcctgcctcagcctcccaaagtgctgggattacaggcgtgagccactgcgaccggccttctcttttcattttctcaccctgtccagcttggtgttccttatagctctgtttaaataccaactctatacaagtgtctcaaaagcattactgttagccctaactgaagtaaatagctttgtgactcaagatatttcagtacaccaagcacctttcatgattcagccccataagaagttggaaaggtatgatgtcataggaaaaagtagttttgaaagccaaaattagcctgcttaagttttcttattaccattttgccttaattttgggtgactctactgttactatatagatgagaaactgaggctctaagacattaaatgactcatctaaaatgcccagatcaagtaagcagtacagctaagattaaccccagagttaatactccttgctttggccaggcacagtggcatatacctctaatcccattgctttgggaggccaacacaggaggatcacttgagttcaggagcttgaggctgcagtgaactatgatcatgcctctgcactcgcctgagcaatagagcaaggttctgtatcttaaacaagaatcctagctttgcctcatacaagaaatgtgtttggaggtttgaggttcccggggttgacctgcaaaatagatttagtcctttaacttctgtttccttcctgccaggtgatcaaatctcagctaaatgtgtcttctgtcagtgagcagaatgcatatagagcaggtcttcagcccgtcagcaagtggcaagcctatggactcaaaggctatcctggtgagtgtaactgacctcagagaaggcaatatcactcaatcatttatgtcttcatgtcttcaaagaaggtactgtgtgtgagcaagtaaatagacaaaggatacacataataaacagataaatgtttcatttccaaacccattctagactgtaccttgtctaagacgtccgttttgaaaggatagaacaggagtcagcagtgcctgcaaatgtggctgaaagtggcatgaccattgaaaaaataaggacattgcctctgggctccctgccacaactctgaacatctgatttggcagaagtgctgtgaagaataatttatcattatcattgtaataaatgtcataatagttatgaataattcataattgtccctctagtcacattctcaaatggcataacaacttaaaacttgttgctatcaaggctgaacatatttaataaagaattacaattaatgacatcaaaagtcctcgccaggcgtggtggctcatgcctgtaatcccagaactttgagatgccaaggtgggtggatcacctgaggtcaggaggtcaagacgagcctggccaacatggtgaaatcccgtctctactaaaaatacaaaaattagctgggcatggtggtgcgtgcctgtaatcccagctacttgggaggctgagacaggagaatcgcttgaacccaggaggtggaggtttcagtgagccaagatcgcgccattgcactccagcctaggcaataagggggaaactctgtctcaaaaaaaaaaaaaaaaaaaaagctggacgcagtagctcacgcctgtaatcccaacactttgggaggccgaggcgggcggatcacgaggtcaggagattgagaccatcctggctaacaaggtgaaaccccatctctactgaaaatacaaaaacaaaattagccgggcatggtggcgggcccctgtagtcccagctactcggcaggctgaggtgggagaatggcatgatcccgggaggcagagcttgttgagccgagattgtgccactgcactccagcctgggcaatagagcaagactccatctcaaaaaaaaaaaaaagaaagtcctaatagggaccaggcgaggtgtctcacacctataatcccaacactttagaaggccaaggtgggaggatcatttgagcccaggaatttgcgaccagcccgggtaacatagtaagaccctgtctctacaaaacaaaatttttttttcccagacagtctcactctgtcgcccaggctggagtacagtggcacaatctcagctcactgcaacctccgcctgccaggttcaagtgattcttctgcctcccgagtagctgagactacaggtatatgccaccacgcccagctaatttttgtatttttagtagagacagggtttcatgttggccaagctggtttcgaactcctgacatcaagtgatccacccgcctcggtctcccagagtgctaggattacaggcgtgagacacctcacctggccaaaaaaaatgtttttaattagccaagtgtggtggcatgcctctgtagtctcagctactcaggagactgaggtaggaggattgcttggggtgcagtgagccgagatcgtgccactgcactccagcctgggtgacaaaatgagacccatctcattttgcagaatagattcgtctgcaattttaaatttagtaatgttaggtagctgcttttacagagaatgaaattaagaaaataatgaagaataggtaatgttattaaccttttttctaggctcctggggccattgtaaaagttaacattgcacttgtgatttcaaatatgggttaaaagtaagagaaatctttaaaaagaaatgttagttttcattgtgccaatggccaggactctatggtacagctcttaatacgttatgaccaccgaaatacttgttaatagcttgggaagatataacagcctggctcctcttgagtttgggtaaatgtagagcatgcatcaccaatagtcttgttcttggaggccgctcctcacctttcaactctagcacttatttttatttatttatttatttattttgagacagagtcttgctctgtcgcctaggctggagtgcagtggtgtgatctccgctcactgcagcctctgcctcccaggttcaagcaattctcctctctcagcctcccaagtagctgggactacaggcacccgccaccacgcccagctaacttttttgtgtttttagtagagatggggtttcaccatgttggtcaggctggtcttgaactcctgacctcaggtgatccacctgccttgacctcccagagtgctgggattacaggcgtgagccaccacgcccggcctctagtacctatttttaaggccatgattctctgttgctctaggctttctccccttaacagattgttcatgccacaaacttaaccccacttgagttttaaattgtctaaactgctgtacttgctttctgaggctttctaggatttactgcttaattaagccacatcttttgggtgggtgtcccattatatccttggagagtttattctgtctctcttgccattataagctgtgtttattttatttatttattttttacttactttcccctataagctgtatttaatagaaatataatgtccaaaatacaggagagaacagtctcttcttactctgagttgatcaaaaggattgtgtttacttctggatctgacttaatctgaaggaagctgagtatactacaacctgtcctcacacttgtgtgaggacacatcctcttgaacaagaggataataggcctggaaaccagaaacagaatctagggaagaaaagacttatgggggaacttgacagcattaaacattgaaaaattgtcctgcacaagaagtggtgggaagcagtgcacaccagtggttaaggcgtaggttctggtgccaggttacctgggttcatatcctggctctgccatctactaactgtaagactttgggcaagtttttaaattctcttgccctcagtttcatcatatgtaaaatgtatataaaaatagtacctacttcataaggttcttatgaggattaaatgttaatgtatatgttaactgcttagatcagtgcatttatcaagcacttaaaaatgatttggggttgctctaggtgtcagaacccaagaccaatgactgaaaattatagagaggcagattttttttttaatctggagaacatgtagatgcaagatgggcagagtttggttttgtttgttttcttgagacagggtctcattctgtcacccagtggggtgcagtagcacaatcacgcttcactgcagccctgacctcccaggcttaaaggttcctcccacctcagcctgcctagtagctgggaccattggcttgcaccaccatgtccagctaattttttttttatttattttttgtagagatggggtcccactatgttgctcaggctagtctggaactcctggactcaagtgatccccctgcctcggcctcccagagtgctgggattacagacctgaaccactgtgcctggctaggaggcagattttaacccactaaaaagaagacaacagttgtctaaaatggactgcctaaagagatgttaaatttcctgtcaccattcaagcttggactaaaccagaagtattattcctttagtctaatatgtttgggaatattataatattctttatttcgtgaaattgtggtgatagcaggtggtaggttgttggggggtttcctatctttttccataatattgatgatcctatcattctcccaaactatttggagaattttactgataaatgaaacataaaatccaaatgtattttggagctactttagaagacatatgaaaaatcagattactggtaaactttgtctgtatgaggtttccttgatgccaaaagctcattgactttggtcattaggtttactttggagtatatgctattgataatattaaatggtggaacaggattaatcaactgcaatgaggaacctgtccacattgaatatctctaagctatctagtttttttctatatctgcaagaatctagacatagaattttaagtgcttttagtaagatttagtacagtagaggaatcttcaggttatttcctgtgtatttctacgatggcataacctcctttcagctgaaccatatgtggttttaaatctctttgaaattctgatagtggaccattgatgatattgttcagagatttgtttggttagagcctagtatttatttatttatttttatttatttatttattttttgagacagagtcttgcttgtcgcccaggctggagtgcagtggtgtgatctctgctcactgcaagctccacctcccgggttcatgccattctcctgcctcagcctcccaagtagctgagactacaggcgcccgccaccacgcccagctaattttttgtattttttagtagagacggggtttcattgtgttagccaggatggtcttgatctcctgacctcgtgatccgccctccttgcctcccaaagtgctgggattacaggcatgagccaccgcgcccagccagaacctaatatttataatgcaaagagcataggtttgttgcttatgtgggcttactggttttgcttgttccatggccgcaaatccaactctgtttgtcgtatcccagattgtttgtttgtcttatctcaaatgtgtgctagccttgtgatgggccaggagagagggatgaatcagtgaagccatgttacccctctgaaattctgttctcttatctgcaaaactggattaataacttcctcatagagttactgaagattaatgagatagcataaggttgctggcacagtgtctgacacttgtaggcatctagttatttttagcagctactataattaatgacttaggaataaacttacttattgttaattgctgttattaaactttatcattattccattaatttatgactaaattatatgccaaagagaaaagaggaaaagtagttaagtaataacaaagttgtttctgttttaggctctcggctcagtgtctttactgtctgctttccatagtaattctccctaaggatatttccataaaatgtgtcgttattgctaatagtctacgccaggacttggcaaactgcagttttattgtaaatacattttattggaatacagccacacctttttgtttacttactatgtatggctgctttctggctacagtgacagaattgagtgctaaagagaccgaataagggcaagcgcagtggctcaggcctgtaatcccagcactttgggaggccgaggcgggcagatcagttgaggccaggagttcaagaccagcctggccaacatggcaaaatgccgtctctactaaaaaataaaaatagaaaataaattaaaatacaaaaattagccaggcatggtagtccaagcctgtaatctcatctactcaggaggctgaggcagaagaatcgcttgaaccagggaggtggaggtggcagtgagccaagattgtgcctgggtgacagagcaagactctgtctcaaaaaaataaaaataaagagaccaaataactgtcgaagcctagtctttactatctagttcttgacagaaaacatttgctgacctctggtctagactagatctggagttcaaccaggaactgaagaagaccttcaaattattgccagcatttaattcagaaatccttaagctttagtctgttcatctgtttttaaaatccttttgcaaggggaacattacactaatatatgatgcttggcttttatatcattgcttggattccttcttgttcctcaggacctgtccaaccatgctcacttttgttgagatgaccttgctatttatcttattgggaaaactgagtccctcaggcacaaaccctttgagccttcaatgcccccaacacttataagcaaatgttctcatttccaccatccagtcgtagaggaggagttcctttagttcaaagccagtctctctaccctcttgatccatctcaccttcttaaacctcttccagctttcaagaccttgctctatttctttcctctcttctgtttccaagtggctcttccctgttggctctttcttcacaatctgtaagcatacttaggtcttgccagtccttaaaaaccaaaaactaccctcttaactctatttttctgtgactatgcctaagcttttattttctttcatagctggtcttacaaaaaggagtttaacttgtctttattgccccctctccagacaaggttttttatcactttatctctaattctttttttttcttttgaggcagtctgtttttgtcacccaggctggagtacagtggtgcagtcttggctcactgcaacctgtgcctcctgggttcaagcgatcctcccaccttagcctcccaaatagctgggactacctgcgtatgccaccacgcctggctaatttttgtattttttgtagagacagggtttcaccatgctgcccaggctggtctcgaattcctgagctcaagtgatctgcctgccttggcctttcaagtgctaggattacaggcatcggccaggccaccatgcccggcttctaattctttttttttttttttttttttattacagcaaatgattttatttgtaatttctaccccactcagtgcctcctcccaaaaaacctgcacatgaatttacaaacctattaacgtataaataatgagaaacatcctggccagagtctcccggttgtctttgctggagattaagactggaggggacgctatcttcatacacacttccagtgacatcgagagtcacttggtggctgttctgggcccacagctggctttttcaacacctccaagttcaaccaccagtctgtctgctgtgtccaaggtagagcccagggactgcgagcatgtgcagctccattgcccgtcattgctccagctgaggtcatgctggaaggggtgcttcctctcctgacagtgcttcatggtggccagcccgctcctgctggcactcagagcctcagtactgggccacctggcagcacccacagattttgaactcctggagctacttctcaatcactgtgcaggaagggtaatgctgctatagtaggtgtaagaattcaactcttccaccacgtctccattggtgttacagtaccaggtcacagttaggacaggtcactgctcttctttggggtccatgggaagctgctgaattgcaaaccagtacaagctttgctacctcttctggaggtctctttggctttgggccaccagccccacagcaccagctacaggttgtccaggcaattgtctcagtcagggcattgagacgtaccgcctggaacccaggggtcatgcctcttctgtgctcccacagcaactcatgaaggagtcttcccaatcctcttcctcagtgcttgtcaaaagcatacctgaatatcttagtaccatttctatctgcatctacttccatttggacctcagaggagtatccctccaccagcaggatatctttgctcatctgtcagcgtatttggtctttatctgactgcatactgcctatactactctctcctaccagaagctacagccactggtgacaggaacagagctctcatgagggtaaagtccctggctagtacagctacacaggtagctccctcgcagccaatgagctgagccatgtgatgtccaatttgaagtcagtcacagccaggcctatgctctcagccagcagtgccactcccatgggagacaggggtgctggggcaaggccagggctagggtcaggccaggcaggccccaggtaggacaagaccaggcccggctcaccttgttcatgccagacctcccaggcactgacctctaattcttaagaaagtgcctagtacagaccagcctggccaatatggtgaaaccccgtctctactgaaaataaaaaaaattagctgggtacagtggcaggcacctgtaatcacagctacttgggagactgaggcaggagaatcacttgaacccgggaggcagaggttgcagagaagcaggatcacaccactgttctccagcctgggcaacaggatgagagagacccccatctcaaaaaaagaaagaaagaaagtgcctggcacatattgtgtgtttgatgaatgaatgaatctttaccatgcgtaggattccagttaaatattattatttatcttttgtttttgagacagagtctggctctgtcgcccaggctggagtgcagtgacgtgatcttggctcactacaacctccacctcctgggttcaagtgattctcctgcctcagcctcctgagtagctgggattacaggtgcgtgccaccacgcccaactaatttttgtattttagtacagacggtttcaccatgttggcgaggctggtctcaaactcctgacctcatgtgatccgcccacctcagcctcccaaagtgctgggattacaggcgagagccaccacgcccggcctattattaatcttttacagagaaaaatgaggttaggttgctgtcaaggtcacaaagatctttaacacacatgctgtaattgtttacaaacactgagataatacagagacactaactgcaggaatttgcaaacactgagatattacagagacagtaactgcaggaagcaactgtcacccctgcagctgagaagaacaacaaaagagcttgggattactacattgagaagcttggaaaagggactacatggaactggggcttagacttctgaggagaggacataatgaggctgattctagtgatgtggaaaagctacattagaaccaacttccgccctccagtcttccattagtgacccttataggcacaggttagcagacagccagctggcaaataagaaatgtagctggcagggtctcagccccatattatgaagctaagtatagaagagtggatttgaaactgagagaaaatagaccaataatgagcacgccattcattagacgatgactttcaaatctatgttttagctaaaattcattataagatttcgtgtaatcatgcctgtaataaatgaaatagggaggtaaagaagtctcggatgactctaagtgtcaagacctgataaaaattagaggtgtacttttaccacttccaattctaaagtttgctttgggataacagttgttgtggaatatttatttctcttgagaatacccagaaagccagacacatttgcataggggtagatgtctaatgttcatcaaaacctacctgttcattaacttgaagcatgaccaaaaaaatatggggagtaaataacaaaatagtgagtataaagatgtcaaaattatttgaataactgatggagaatttccccctcttctttttttcccacccatcttttgtatagggtttatttttatcccaaaccccttcctcccaggttaccagtggcactgggtgaaacagtgccttaagttatattcccagaaacctaatgtatgtaacctggacaaacacatgtctaaagaagagacccaagatctgtgggaacagagcaaagagttcctgaggtaagtcttgtcaatcagaatgaagtgttaatactcagctcagatcatcacaggtctttgaaggaactgttctataacaatgcagtaaaagtgactggctgggtttttttttcccttcattgtttccaagcaaaaacagcacaattgtattctttccccaggaacatttggacagatgctttgacagttatagtaaattgagatccattttaaagacttgcttatcatagcttagataattgagttcatcctcattaatcatcacatgatccatttccattagcttcagccatttttttctacttaaagtgagttcctttgaaggcttttggtatcctaggaaaggtaacatcgaaagctctttgcttctaccctcctagatggattcagtggtactagccgttttatgataggtcagttgttcctgatgagaataactaatattttcaccttcatgcttcaacattcattcattcattccacaaatacttaatgagggtcagtagtgtgtcaggcatgatgctaggcgttggacacagaaagataaaggcaccctccctgcactcagtagtgcatagtctctggcaagaatgcattacctatgagaataattactgtagagctcagaaagtgttatgatgcggtttagaaaaatactgtgggagcatagaggaggaaataattattccaggcagggtagaagtgtgaacgaagaaaaaatgattttttgtttgtttgttttttgttttttgagacagagtctcactctgtcacccaggctggagtgcagtggcgcgatctcagctcactgcaacctctgcctcctggattaaaacgattctcctgcctcagtctcctgagtagctgggattacaggcatccaccaccacgccccaccaatttttgtatttttagtagagatggggtttcgccatgttggccaggctggtctcaattcctgacctcaagtgatccccctgcctcagattcccaaagtgctgagactacaggcgtgagccaccaagcccggcctgaaaaaatgatttttttattgggttatcctcctttcactgtccatttgaactaatcttcaaaaatgagtaggggtttaccagtcagaaaagtaaaaagtctctactgagtagagaaagcagcctgagcaaagatacaatatttaagacagaataaatcgtcctgcgagacaagagcataggatgtgtactttcttacgtttattcagttgttatctattgagtttctgctatgtgtcagacactgtgctttagtgttagagattcaaaggcagataaaaaacagttcctgtcttcaagaaatttgtactttagttatgttcaaaaacctacaaacagataattagatacaatttgggtctgggcttggtggctcatgcctgtaatctcaacactttgggaggccaaggtgagaagaacacttgaggcctggagttaccagcctgggcaacatagcaagaccccatctctatgaaaaaaaattttttttttttttttttgagacggagtttcgctcttgttgcccaggctggagtgcaatggcatgatcttggcccactgcaacctccacctcccgggttcaagcaattctcctgcctcagcctccagagtagctgggattacaggcaagcgccaccacacccggctaattttgtatttttagtagaggtaggggtttctccatgttgttcaggctggtcttgaactcccgacctcaggtgatctgcccacctcggcctcccaaagtgctgggattacaggtgtaaggcacttcccggccccaaaaaaatttttttttttaattagctgggcatagtggtgtgtgcctgtagtcctagctactcggcaggctgaggagagactgtctctaaaaataaataaattaaataaataaataaataaataaatacaatttggtaggtgcagggacagacattataagatataatgggaatggtcacttaagtagctaggctggaggtagattatagaaaatgcttcctggaagccatgagtaggtggaattggtaaaacatgaaggaggagaggtggatttgggccagatggtaaaggttttagtgatgtagagcaggggggtccccaatcatggggcagcagacctagacagccaagcattaccacctgagcttcgccccctgtcagatcagcagcagcattagattctcataggagcgcgaaccctgttgtgaactgtacatgcaagggatctaggttgcgcactccttattgagaatctaatgcctgttcatctgagatggaacagttttcatccccaaaccaccccccatccccactccatccatggacaaattctcttccatgaaactggtccccagtgccaaaaaggttgggaaccactaatgtagagcactagttctggagtcagactgactgtgttcagatcccagctccaccacttaatagctgtgtaaccttgagcaagttccttcacctttctgtgtctcataacagttctttccttattgaatagtatgaggattaaacaagataatacgtgagaagtcctttaaagtgcctgttaaaaccattttaccaactttgtgtcccgtttggtgttacgtggccttaattttgtagttttcagaaactgtcatgccgattctaacagagtaaagagaagattttcttaaggggaaaggaaaagtaaaattcagtggttttttttaaaccttggtctataggttatggtatcaacaggagcagtgaggaaaatcctgtccatgagcttttagtagtgtcttcttcgcaactgagagcaggggaaaggaagatcgtggttaagtaaaattagtccaagagaacctactgctattaaaccagcctgtgttttcaagtaattttttttccttctgatatatgactctgcagaaatcccagctgtcttttaagatagctcagatgaatctctgtaataaatcatcctgtaaacaatggtgagataccttttttttggtctaataaattagcagaaataaaaaatttgatggtcgtaccttatgttgtcaagggttggaagaaattgatatgctcaagacattgtactggcagcactgaaaatcgattaaggccaagttttcattgtatcactatgtgatacgtgcttcagtttcctcatgtaagaaatgaaggtattggactggataagccattcaaggtaattgaatcatgggcagtcagggtcatgtggacagtacctggcagctctcccaactttgccagagtctctcagaacaggagagagtctgttgagttcaaaacagttcccctggagattttgattaggtatcataacatcctctgacattgagaaccactgaagtaaaggacctctaagatccttttggttttaattttctagaattctatagtcagggaagaaaaaactttaaataggaaatgaagaagaaatacttgaacttaagcaaaaacaaaaattatttaaaaaaaaatacttgaacttaaggactgttcaaaaaattagagtacctcaattctgttcttttttttccaaagtgaatggcgtagctagagattgttgtaaaagtgtacaagagttatgtgcaggccgggcacggtggctcatgcctgtaatcccagcactttgggaggccgagttggacagatcatctgaggtcaggagttcgagaccagcctgaccaacatggtgaaaccccgtctctactaaaaatacaaaattagccgggcatggtggcgcatgcctataatcccagctactcaggaggcagaggccggagaatcacttgaacccgggaggcggaggttgcggtgagccgagatcacgccattgcactccagcctgggcaacaagagtgaaactccgtctcaaaaaaaaaaaagagttatgtgtaaacatcttcattgtgacattgtttgtaacagaaaaaaaaaatgcaaaacagcctaagagttcatcaacaggcgaccaggtaaatctaacgtgacatatcccagacatagaatgcagctgctgtgcaaggattaaaaaaactttaaatgcaaccctctagtatatattccagacttcaaagccagaataaattcagtcatttctcaccatctccatcacaactgccttggtctaagctgccatcatttcttatctagagcactgcagtagcctcctaaccagcctcccttcatagcacaaactcaggtgtggttccaagggcccaccttgattaacagtgacactttatcactcaggaaatttcaagggtttagaagttccctgccaggagccagggacaaagaccagtcaaattctttgttgcataacatcatcacatttagaaaaaatccagaattcttaaccatggctgtaaggccaatatgacctggcccacagctacctctctactctcatttcctaccattcctacctcatttccttttcatttgttcttttctgccacattgacctccagtgctatccttaaacacactaggcatgctcaagatttttttttttgtacaggctgttctacctaggaagctcttcccttagatcaacagtgtcttgcttcttgtaagtctttgttctaatatcatcttagaagaaagtcttcacttatcattcagtcaacaagaatctcctacttcccctcattctttatcttcttgctttggtttgtttgtttattgccacttttttttagagatggtgtcttgctatgttgcccaggctgccttgaacttctgggctgaagcagttgccccacctcagccccctgaatagccggaactacaattttctgtctattttttgttttctaaattttttgcttgattttttttttaattaagtgcaacatagttgccaaataacaacttagctttatttgttctgtaaattagcttatgaaatactctatttttatgtatatgaaagcttttttcccactgttaccctcattgtggaagcagaattaatcctctcctctttctacttgactgtttataatgctagtatagcattttttctagtgaattgagttatctacccctgtctccttccattgccttcctctcccatcttgaaaattttgtagccttgattcttaccacagttctttgtatatattagaaggtgctcagtaaatattatttcaattaaattcatattccctctttattagtccaataagaacaatgctaaatttgagaaggatcatttagagactatatagcttttcttcttattttcactaatttattaaataatgtacatttgtgtcttagaaaatatgtgatgctaggatagctatgaagaagaataaaagccagtgagggagggactgttaaaggaggaacccaggtacttaaataaggaatttacaataccaaagcatgtatacttgaatagaagttgcaaggtgctttgggggcacgatataggaaatggctgggagaaagacttcccagaagaagtgagtgtaaactgtatgaaaaaacaaattggaaaaatctgctaggctgagagtggagtagagcatttcagtagagaaaattgtatagtcagaggcacggccatgaaaaacatgagaatagcataccttgtgggaaatgcttggagatgagactagaaaggttagttagagccagaatataaatggctctgcatgtcatctaagagtgtggactttgtcctattaacagtgggtatttatcaggattaataacagatttttcacttcagaaaaataactctggtagtggaggaaattgactgaaaatgcagtggttgcaaaaagcacaattaagaatttagttcaggccaggcgcggtggctcacacctataatcccagcactttgggaggtcaaggtggggggatcacctgaggtcgggagttcaagaccagcctggccaacatggtgaaaccccgtctctactaaaaatacaaaaaatagctgggcatggtggcaggcgcctgtaatcccagctactagggaagctgaggtgagagaatcgcttgaacgtgggagaatcgcttgaacccggcaggtggaggttgcagtgagccaagatcgcaccactctactccagcctgcgcgacagaatgagactctgtctcaaaaaaaaaaaaaaaaaggctgggtgcagtggctcacacctgtaatcccagcactctgggaggctgaggtggacggatcacgaggtcaagagatcaagaccatcctggccaacatggtgaaactctgtctctactaaatctacaaaaattatccggacatggcagcacgcacctctagtcctagctactcaggaggctgaggcagaagaatcccttgaacctgggaggagaggttgcagtgagctgagatcacgccactgcactccagcctggcgacagagcaaaagcagagcaattgagactctgtctcaaaaaaaaaaaaaaaaatttagtttaatccatgcaaaagatgataaaggcctcaaaaagatgttgtctacagaacttagttaccaagcaattataaaaagtgagagaaaagaaagttaacaattatctactgatttctacatggcagtgagggtaatactgaggcttgtaatggaaataagtattgaaagaagaaaagaatgagcagagactatccttagtgtagttggggccatactgttttttgaaatgcctgtagggtatccaggtggagatgtccagcatgattttggaaatacagaactgagcttaggagtaactaagggtgagagggacacgaagagagatgagatgaggagttacacgtaaaggccatagtaaagcgctgaaaatagatgtggttttctttcttctcttcttttcacttttctttctcatctatagaaaagaaggctgttggccccaggaagcctcagcacaggatgaagaaaatagagcaggaaaagacatcaagcagccagaaggatatgaggaaaaacagaagaaatgctgttagaggctaagacaggaaaatgtttcaagaagagaagggccagccatgtcaaataggtctaggatttgacaattaattggtgtaatgaaaactaagaaactagattcagtagtggtgtaaacaaaagtcagattatggtgaggggagagagtgaggaaggcaaatgctgaattttttaaaagtttaattataaagggaaggaaagatagggggtagaaggaggtgaggtataagcagggtagcttgcataagtgacaaagaaaatgtttttattgtctattcttaagtatgtaggagtattaaacatgtttgaaggccaagaggaaaaaacaagttcagaagaggacttgaaagtatgagaagaaacattctattaatggagaaaggcctcagaggctgtgtcagggaaataggatatagtataggtagagaattagctttggaagaaagaagtaggaccacttctgaaaccaggaggatcaggtgaaaatttagagaagtttagtggtgtgggggaggaaagttgaaattgttcactggatcatttgagcaggcttctgttttctcactgacatagaaggaaataagaacaaaactaaggacttgagatgaatggtgaaggtttagaacagaagacggttagataagactgaatatttgcaggatagcaagaggatgttagcagttacagtggcattggatgtccatttgcagtgagtgactgggagtgtcaagttgagaagggagagagaaaactggaagcactcaaacactgaaagaatggggtggccaggcacagtggcttacgcctgtaatcccagcactttgggaggcaaaggcgggtggatcacaaggtcaagaaatcgagaccatcctggccaatgtggtgaaaccccatctctactaaaaatacaaaaattaactgggcatggcggcacacatttgtagtcccagctacttgcgaggctgaggcaggagaatcacttgaacccaggaggcggaggttgcagtgagccgagatcacgccactgcactccagcctggcgacaaaacgagactctgtctcaaaaaagaaaaaaacaattgctaagagaaatgccaacgcttacataaggcgcttacccatgacataaaccaagcaaactgctgtatgagcacattcaccaggggagaaggtggccaacccacccatccatcatccttctgctagtgcctggagaaggcagcagggagcatagcatgtttcttttttagtgagacccaataattagggtcatgtttgcttgaacacattcttttggataattggataaagatgtattaggtgccaacgtatttcctgcattcttcaaggtgagagttgtattggtactgatccttcttgacctccttttggacaagtcaggtttaaaaagagaacaacccacccccttcagtgattctctcagtattttatgcttaaaaatgatccggaagcatgttaaatggttttggtcttactattcacagtgttcaagaacaaatcttggaatttttgttactcaggaggcccatgattaaccagaagggtccttaaatagtactaagacaagaaatgtttggtgctggccagtcctgctctcaacatattgaaggcagatattaagagttgttgctactttcctttcagaaaatacaaaggcaagaattgaaatcaggttttcagaagagaatataaaatgagggtctaatgcacttacatgggtctaatacgttacaaaaatatatatgtcattgcccccaaaatggcatagacactcaaagatcacaatttttctttttgttatgaggactgaacttaatgcttttcaatgtaagactcgactctggcttgttttacatccctggaccagtcatcctctataatataacgcaaaaactcaaagcctttttttcccccccgagacagggtctcactctattgcccaggctggagtgcagtggcacaatcttggtctactgcaaccttctcctcccaggctcctgcctcagcctcccgagtagctgggactacaggcgtgcaccaccatgcctggctaattttttgtatttttagtagagacgaggtttcaccatgttgcccaggctggttctccaacttctgagctaaggcaatctgcccacctcggcctcccgaagtgctaggattacaagcgtgagccaccacgcccagctcaaagcctttcttttaatcatacagttagagtccttgtttttttttgtgtttttttttaagacggagtctcactctgtcgcccaggctggagtgcagtggcatgatcttggcccactgcaaccttctgggttcaagcgattcttgtacctcagcttcctgagtagctggaattacaggcacccaccaccatgcctggctagtttttggttttttagtagagacagtgttccaccatgttggccaggctggtcttgaactcctagccttaagagatccgcccatctcagcctcccaaagtgctgggattgcaggcgtgagccaccgctcccagtgagagatgttattttggcttcttaggaaaggaactaaattagaaaaggtatattacaggatgattctattcatgctgtcactataattttgataatttttattgttaataacataaacctgtgtttataaaatgtattctctgttcttgaatattagactaaatcttttggtggaaaagcagtttgttgcggccatatcaaatgtctaaaatactgtcaccttttgaattatttccaaagcagcattattgttatgtttattgtttcagatcagtctgacattgatataatagtatggattcttcataaaatgaggctgggcatggtggctcatgtctgtagtaccgatactttgggaggccaacgcagaaggattgattgaagctagaagttcaagacccacctgggcaacatagagagaccccgtctctacaaaaaaattaaaaattagccaggcatggtagcacacacctgtagttctagctactcaagaggctgaggtggggaggattacttgagcctgcagcaagctgtgactgttaggaggctgaggcaggtggatcacctgaggtccagaattcgaaaccagcctggccaacatggtgaaacctcatctctactaaaaatacaaaattagccgggcgtggtggtgcatgcctgtaatccaagctccttgggaggctgaggcaggagaatcacatgaacctgggaggcggaggttgcagtgagccaagatcgcaccattgcactccagcttgggcaacaaaagcaaaactccgtctaaaaaaaaaaagaaaaagaataaagcaatctgttattgagctagaaagaaacagacggtattgtgttttgttttttagtttgggctagaatagtggttttcaaagtgtaattcctggaccagcagcataagtatcatttgggaacttactagaaatgcagttcttaggcccccaccctagacctgctgaataagaatttataggcctggacccagccatgtgagtttcaacaagccttctagatgattctgatgtacactaaagtttgagaaacactcggcaaaaattaagtgggttctgtaattaagacaggttctgtaaaggctttcagtagagctcttaagactgcgcttttcagctggaactgccatcttccagtaatttgcgaaaatgacgaagacaaagggaaagaggagaagtacctgatagatgttttctaggccttttagaaaacggagtttttcctttggccatgtatatgcgcatctgtaagagggatgatattgtcagctggacgcagtggcacatgcctgtaatcccagcactttgggaggctgaggcgtttggatcacctgaggtcagcagttcaagaccagcttgggcaacatggggaaaccctgtctctactaaaaatacaaaaattagccaggcgtggtggtgcatgcctgtaattctagctacttgggaggctgaggcaggagaatcgctggaacttgggaggtggaggctgcggtgagccgagattgcaccactgcactccagcctaggtgacagagcaagactgcatctcaaaaaaaaaggaggatgatgttgtcgacattaagggaatgggaatgggtactgttcaaaaaggaatggcccataaatgttgccatggcaaaactggaagagtctacagtgttccccagcatgctgttagcattgttgtgaacaagtaagttaagggcaagactcttgccaagagaattaatgtgcgcattgagcacattaagcactctaagagccgagatagcttcctgaaacgtgtagtaaaatgatcagaaaaagaacccaaagagaaaggtacctgagttcaactgaagtgccagcctgccccacccagagaagcacactttgtgagaacaaatgggaaggagcctgagctgctggaacctattctctatggattcatagcataataggtgttaaaatacccctggactgtttgtaaaaaaaaaaaaaaaaaaaaaagactttacagcttggtgtgatgcctcacttagcactctgggaggtcagggcggaaggattgcttgaggtaaggagttcaagatcatcctggacaacatggtgagactacatctctatatttttcttttttgttttaattaaacaataaaaataggccaggtgcagtggttcacgcctgtaatcccagcactttgggaggccgaggcgggtggaccacctgaggtcaggagttcaagatgagtctagccaacatggtgaaaccccatctctacaaaaaatacaaaaattagccaggcgtggtggtgcattctgtaatcacagctacttgggtggctgaggcaggagaatcacttcaacctgggaggcggaggttgcagtgagccaagatcgtgccattgccctccagcctgggtgacaaaatgagacacagtctccaaaaaataaaatttttgagaagactctttgccatttagatactcagggtgccatctattttgagttctagattccagtcttagatgaccaacttctttcatcttttactaccacttctaccatctctcttttccccctcctcaaaaacgcatagcttcaatattcataagatcatcatcatcatccttttcttcaacagcattttcttgtatcctagagattaccttaaaataaggaattggctacaaagtaataccttggaaagagaaatagaatggatcacctctataaggtgcttatgtaactctggaactacgtttatatttccattaaccacaaagtccacatgagtcatacttatttttctgtctcaggctactaaaatagaacatgttctctagaggagaacatcaaggagttcttttatttgtacctttagctgaataaacattggtagacctcaagttgtgttaataactacattacatttttttcatatttcagtttttatgcacaaaaataatgtgtggttgttatccatattgtaattgttcaaatcagctagttgctgtcagtggccaagccttatatttttccctaaattattagttatctgtctcctgttgtgtcagggagtccccaaaaccacacccaaatttgatgattcgccaggaagactcaggactcagcagatggttgcacttacagatttatcacagtgaaagcatacaaagcaagatcagcaaagggaaaaggcacctggagcaaagtccaggaaaaaccaggtgcatgcctccaaaagtcctctcccaaggaagtcacaccggatatggcaatgggttgtgacaaaatctgtgaaatgtttaccaaagaaactcagtgcctaggtttttactaggagcttgtcatgtaggcagcctctgcctgacacatgccaaaatcacagactcccagaagcaaagcaggtgttgaccataaaccatattgtttgcacagtttaggtgcagtaagccactcttaacacttccagagaattgtgtgaaccttgccaaggaccatctttgtaagcagaccatcagtcaagtctgctatgtctcttctgcacacctgtcctaaataaatcagtgtgtgttcatttctttttatctgctggtcttgatgtatgtatgtgtcatgatgtctttcttagaatgtaaactctgtgaggacagatagcatctattctgtaaactcttcgtcaaacatcaagatgagtgccactgaacagtgtgggtctcaataaatcctttgcttttgcttgtgctgtgtgcccatattgcctactgcatcactccctatttaaatgctgcccattcttcagtgccgtgctcaactcccaactctgccaagaagccccaactgattcgacagctgactttgagctctcctttttcttaattctcgtgcccctcaaagtctgctgtttactttagtactagactttatactgcgttcagtttccctctaatttctccttagactttctattacatttgccatttcctgtcacaatcagattccttaaaggaatctgattttttcttttttacacagccatagttttggacaaaaaaatttttgattgatcaatgatgtaaataacagagaaaaattaaatcattagacctaccattctcatatttttagatatttggaggtgagccaaacaaacaagcttcctttttagaaaaagagtagtgggccagttgtggtggctcacgcctgtaatcccagcattttgggaggccgaggcaggcggatcacctgaggtcaggagttcgagaccagcctcaatatggagaaactccgtctctactaaaaatacaaaattagctgggcgtagtggtgcatgcctgtaatcccagctacttgggaggctgaggcaggagaattgcttgaacctgggaggcggaggctgtggtgagccaagatcgcgccattgcactccagcctgggcaacaagagcgaaactctgtctcaaaaaaaaaaaaaaaaaaagagtagttaatcacatagatttgatcagatgagatgtaattgcagaaagagcacgtctcggttgtacagaaacctcctgtggtttgaacaagggtatgtcagaaaccaaatcagttacagtggtgccttaattgttagctaagcctcagttatctaagctatgttatacagagttaaagaagtcatgttaaaccagttattttttattgtactatacactatattttgctaaactttttttttccccaacctgcaattctgggaagccaccctcattatagacatagaaatcattgtgattaactgtaccctgcttttagcaaaccaaactgaaaatgttctgtaagtcaaatttttgattgcccatagtgctcttggtaccatttcccatggacaggtaaagacatttctcttgtcattgttgtcattcttattttatcattaccaagatgctggaggcttgtgatttaaagttgaccccattcagcagaggatttagaacaaaggattataaattagaagtgctaacatgtttttctctgttaatgtatctgtggtctactcatttatctcttctaatttctcctactgagtcttggctaacggcttataccatgtaatactaaattttaactccagagtccatacaaacggctattgctgccattttacatgaataattcctcttttgtcaccaatctttgcaggtataaagaagcgactaaacggagaccccgaagtttactggagaaactgcgttgggtgaccgtaggctaccattataactgggacagtaaggtattcaggttttcttaattcttttgttttctgtttataggcttctttagcccacatagttgtatttcttcctaaccacgcttaagatatcaagattatacatttgtgggaggatccctttcttttatttccttaaaaaatctcaactgggccaggtgccgtggctcacatctgtaatcccagcactttgggaggctgaggtgggcggatcacttaaggtcaggagtttgctgccagcctgggcaacgtggcacaaccctgtctttacaaaaaatacaaaagtttgccgggcctggtggcacatgcctgcagtcccagctactcaagaggctgaggtgagaggattacttggacccaggaggtggaggttgcagtgagccaagatcgcaccactgcactccagcctgggtgacagagcaagactctgtctcagaaaagaaaaaaaaaatctctcctcaggtatctcaagaggaatgaattttattatatcagaagtcaccagtgctttctcacagtaggttccaggaatatagaactcttttcaagagcagttctcaccatctttatttccattattagtgagagtttgttgagcatatatttttctttttctttttcttttttttaatttttattgtgcaacaaaagccacattcaagagcacttatttttctatgtaatatctgcctggagtaaaagaagctccatgtatttcaattgttcattcgtcaactcacaaaagaactttcaacatatggataccgatcacacgcggtggctcactcctgtaatccaagcactttgggtggctgaggtgggaagatcgcttgagctcaggagttccagagcagcctggggcaacatagtgaaaccccatctctacaaaaaatagaaaaattagccagatgtggtggtgcatgcctgtggttccagctactcaggaggctggggagggaggatcgcttgagcctgggaggcagaggttgcagtgagccaagatcgcaccactgcagtccaactgggtgatagaacaagatcttgtctcaaaaaaaaaagatatttgcctgctctataatgactaggaaggagggaggtgggaaagaatttcctacagttgacagtttcgtgttttcttgagctacgatttcttctttcctatcctctatgctttagaagatgccttgtaactagcagtgcagtgcctcttgtctcaattagacatttgccaccaagggagtatactgattataagaataaaatgaaaaaaaaatattggtatagaccattttctttgcctactaaccagttactttgtctgttttttttttttttttgtaatggtcttacactgtcacctaggctggagtgcagtggcacaatcactatagcctcgacctccccagactcaggtgatcctcacacctcagcctcacagtaactagttactttctaaaagctccacagtttcagccaacccaacttagatacattaactgctccaaatgatgacagatttgttttaaaaatatttgtgatataattctgactttcagcaatacagactcagtaggaaactagatattttttgaggggaaatgccatgtgattttctttggattagacagcctgagtttgaatccttcctccggtaatgatagtgcctacctcataaggcagttgtgaaaattaagtgatcagtgcctgtaaagtgatctcaatggtgtctggctattctaagcagttaaatgcattatcacaataaatgttagcttttttttttttttttttttttggtgataatatttttactgttgatattgttattccccaagacctcaaagttaacctcattgactaagaaaaatagggagtaaaaatgaccaaaaactgaatgagtagtcagagaaaagtgaaagagaactttaaaagaaaaagtagtgagtaatgcagagacagtttggacagggttgaaagcccaaaagggtgattatttcattatagcagaggctatctacagctagaatgacagccttgactgtttgattatctgagggactaaagcttaaaatgatagaggaaaacttaaagttctttaatcacactttgagttttgagaaattgaataggaactcttctaatttacagttcagtaaaaggagaaaaaatgaaaaacagaaaagttccaactgaagagaccaggccattcatcaagagtcttccttacacctgaagttaaaggtcgcttctggccaaagtaaatacttgctgtccagacctatgactgctgcttcagctagaatatattcagacgctagtagagatatgagacaaaagtagattttctgatcagatttgaggttaatttagcaaagaaagaagtgagagcagaggagcatcaagacaaaagaagagtctgtcaggtacatatagcccaaatagccctcagattcatccatataggaacctgtaagtgaaagtcttaatcataactgcagccatgtcactcatgcagaaagatgttatagagagtattatggccaggccaggcatggtggctcacacctgtactcccagcactttgggaggccgaggcaggcagttcacttgaggtcagaagttcaagaccaccctggccaacatggtgaaaccctgttcctactaaaaatacaaaaattagccaggcatggtggcaggcacctgtaatcctagctgctcaggaggctgaggcaagagaatcacttgaatctgggaggcagaggttgcagtgagcagagatcgtaccactgcactccagcctgggtgacagaacgagactcagtctcaaaaaaaaaaaagagtattatggcctttgatatatttttttttaactggaaaaagatatttgtgatccttaggtgtaaaaaacagagacagcccagggaagtaagttcaggaaattacttccaatttaaaggcctatcttggccatgctataaatgagagttagttccgatgttttgagcatgtcatcccatcagattgaccagtcaaattgccactaagccatgttgcaagctgagaggtccaaaaccaaactggctatagtatttgagttgcctttttataaattaactttttagtttaggatagttttagatttgcagaaaagttgagaagatagtacagagagagctcgtgctctccccctattattaacattttaccttagtatggtacctttgtctcaaatagttaaccaatagtaatacattactgtaatagcatttgtacttcatttagatttccttagtttttaactaatatctttgttcttatatctaattttctaatatccaggatcttatccaggatactacattatatttagtccttgtgtttccttgggcacctgttggcaatgacggttttgagttgcatttttaccctaatagaactgtctcatttacagatagagtatactaactagagggtggtggagtaattgcttcatgtatagactcaatgcagtatatagcacagtgcctgttatataacaggtacttgggtttttgaatgattcattattagatcattagataccccaagaatggatggatagaccgggcacagtggctcatgtctgtaatcacaacgctttgggagactgaggcaggaggatcatttgagaccagtctaggcaacatagtgagaccccatctctgccaaaaaaaaaaaaaattagccaggcatggtggcacgcacctgtggtcctacctacttgggagactaaggtaggaggatcactgagcccaggaggtctaggctacagtgagccatgatcacaccactggactttagcctgggcaacagattgaggccctgtctttaaaaaaaaaaaaaaagaaaagaaaagaatggatagataatgctgtgttaatatgttaatatgactttgtaagtaagattattttaaagtggtaattaatcttatagtttcctgtattcctgagatcattgtttatttttcttattctctctacatttaccaaagaaatactcagcagatcattacacacctttcccttctgacctgggtttcctctcagagcaagtagccgctgcctgtggatttgaggatttccgagctgaagcagggatcctgaattactaccgcctggactccacactgggaatccacgtagacagatctgagctagatcactccaaacccttgctgtcattcaggtgagttagttccagggatttgggattactttttatcatttaattcttttttctaagacattttactctaaaataaatacaggtatttaactttaaaaaagtggttggactctataatcttccacttctgggaattttaataaattatagttagtatctctgtttaagacacatggagcctaccttttattttatttttattttttattattgtttttttttgaaacagagtctcgctctgtcacccaggctggaatacagtggcttgatctcagctcacttcaacctccgcctcccagtttcaagtgattctcctgccttagcctcctgagtagctggaactacaggtgcacaccgccacacccagctaattttttttttttttagtagagatggggtttcatcgtgttgcccaggctggtcatgaactcctgagctcaggcaatccgcccacttcggcctcccgaagtgctgagattacaggcatgagccactgcacctggccgtaacctaccttttataatgaaaggtattgtcagtgctctgtggaatagacaagtggaaagccataaaagcaaagcgagtgacctttggtatagaagagcaaactatagagcaaagcacaaaagcctgagtagtttactctccttgtctccctaaaagtaagtttaaatttgtgccaagttttgcacctgcatctcgggaaagtgccttttattaattgccttatctttaaaatgaggaaaggtaaacatagtaaagaactcaaatgattttattgaaagactcaaagacacatcaataggctgggcatgatggcttacacctataatcccagtactttgggaggccgaggccagtggatcacttgagttcaggagtttgagaccagcctggccaacacggtaaaaccccatctctactaagatacaaaaattagtcgggtgtggtggcacacgcctgtaatccctgctactctggaggctgaggcacaagaatcacttgaacccaggaggctgaggttgcagtgagccgagatcgcgccgctgcactccagccactccagcctgggtgacgaaataaggctctgtctttaaaaaaaaaaccatcaataaaacttaaatggataacattaaagctaagttctccatttgcttatttaactgcatccaattttattttgcagcagttctgtgggctgtcataactataggtagaaggtcatgagttggtcactcatagacacaaaccagaagagaaggatcttagcacagtttaaaaaggaggatttgggagcaataaatatcaacctgaaattacaaaataacacagttggcagtaactttcccagtcatagttaataaacaaaatttatacttttttattgttgtgtgtttttacttattttttgtagctttggacagtccgccatctttctcctgggtggtcttcaaagggatgaggcccccacggccatgtttatgcacagtggtgacatcatgataatgtcgggtttcagccgcctcttgaaccacgcagtccctcgtgtccttccaaatccagaaggggaaggcctgcctcactgcctagaggcacctctccctgctgtcctcccgagagattcaatggtagagccttgttctatggaggactggcaggtgtgtgccagctacttgaagaccgctcgtgttaacatgactgtccgacaggtcctggccacagaccagaatttccctctagaacccatcgaggatgaaaaaagagacatcagtacagaaggtttctgccatctggatgaccagaatagcgaagtaaaacgggccaggataaaccctgacagctgagacttggagatcccatcctttttactcaggcacctgcttaccgtaaatgatcatgttattgtgtattgccgtggacttcagcacccagacaagccaaaaacagagacagggaagaactcattgttgatcacactgttgccttggaacccacgcagaagtaaactcagccactttgctcagagaagtgtttgacatggtctgttcctagttacatgttggctgtaatgtatgttgagaagtcagtccaaggaggtatgttcttccacaacagccttctcagcctctgctatttcctttgaggaaggtagaagtgagtttccatgtttgcagagtatttaaatacctcagattttattaatgagaaatacagtacccctccctccactccatctggtaatttatggtaaaattgtggttctgtgaaccagctattagtctcatcttcttaactccctcaggcatcatcaaattctttgatcttctcttccacctctctggctctcatggaagaatcctttacacatgaaaacaatggaactggaaaatcttgtcttttagaaaagaaattaatcacaactatctctcttgcctaaaagataaatataggtaaacccaaggaaaggggaatttagtttctctacatgtcatttcggtctccaaactccctgttggctttttaatgcaattttaattgttggaataaaaaagtcccaagggtgttttgttactgttttctccatgaataaactcacttgattttaaattaaagatctatatctgtctttggggtttagtctatctgggattaaggtttttttttctgtttttctttgctgtattgttcatgctattgaagccctctagctgtttctgccctacaccattctgctgtgccctaagtattctttgtggctgtctcacagaagagagaacatttcttaatattccagtcactgctgttattgtctgagggtaggcagcttggaaaaatgtaggcaacaccaagttttaatctttatacccccaacaatttgactgactatatcatggtccaggttactttacatttctctggacctcggtttcctcatcataaaatgaagatactgtagactaccatcttcctaaagggatattggtatttgaaagagaattaagtgctcctttctacaaacatgatgtgccaaaattgttttattataagggctctttgaaacatcctaacttccttgtgtggaggactggctggaagcccatttggtacctactgtttgcaatgcatgttattaagtttacatgtctcctctgtcctgctctgccccttttttaaattactggcattgaatattgagttcatatggtaatagcagggtttttaaatgaataaaaattatggatttatctct

SEQ ID NO: 87 - DNA, 69056 bp, Homo sapiens
cgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggtgagtaacggtcccaaccgctgctcggagctggcggaattcatttcccccgaaacacacgccacctccgaccagggccgactccaattctgaactcagcttctgagttctcccatggcaagggtaaattagtgttagcagggactactaaagaaagctgtactttcatcccctcgggacacttgtaatcgtaatcgggcttttaaaatcgtaacgtaggcagggacgtcgaaataactgccttccaaggccccttacagcttacatctccattgcgcgttaacgggaaaatgcatgcatttgtgtgtatatgtttccttcaacggttatttgagatgctcaaaactcctaatcattgattaattcattcgtttgttgtagaatcttagtgagcccagctatgtgctataggtatataccagtgaatatgacccgctgttaaggaactcagtcaagcagagaagacaggatatctgcttctaacaggaacaaaatcttattttccccgtttactacacggtcataaaaatttaaattatagagtgaaagatgcctgtaaccacatccgccagagatgacccctgttaatagattgaagtatattattccagatgttttcgacgctagaggtaatacctattattttcagaaatcggatcaaaacgtccagttttttcactttaatggtataagttgaacgtattcccatgttaatacgtagaaatctaacttattttcttacgctaaaacattggcaataagagatttgaggttagatttggatgtcatcaacttaaactttttggtaagtttcagataagggagctaactacccagattaaccttggacagaaataaaatctcactcatgtgaaggtcgactatagccagaggttctttttccccttgaaactatgtggaaaacgaacctgagaagggaatttttatattcagcgatgagtctaggaaaataatattgagaaagagactgagaagtagtccctcaacttcctgctagcagtctgaaactttataccatccttatttatttccctcttagataatctttgtaattatacttaaatgctcctctttctgtctctcctgggaccttgtttgagtaacttctttgtcctctgtttaagagtgacagtacgcacagtggctaagaactctgtctttgaagttaaactgcctgggttttattatacttccacaccttactatatgtgtgttctgggggagctgttcagcctctattttgtgacagattttctcctaattctccatgtgtttacctttcccttccctctttcctattctcaagtactcattcgttgttacataatagtcactgaaattcattcgttattatatgaaatctatagaatcatctcctttcctcttcagtgttggtgttccatccttgaccccttttcttcttctacctactcctttggatgatcacagccacaaccagggcttcttccacttctacatacatacaaccttctgttacttatatagtaagtcctcacttaatgtctagataggctcttggaaactgtgactttagggaaaacagtgtataactaaactaactctaccataggctacttgatataaataagaattgtttcagtggcatattttggtcacacaaacaccaccgaacttctaaagaaagactcaaagtacttttaatattaaatgttgaaataattgtgtgctatacatatatttgagaaagattaataaaaacaggtgagataattatccaagttttggtgtatcagcgagtgacctcggtcatagtggtggtgggctaaatcaaggaataaatgtttgcaaagtgaaaattggaaggagcacctcctaccaccacccaggtcaaaaacaatcacaaatatggcagctcactgagccctttcataccaaatcgtttattgtcattcatttgtatgattattgtaaagtttacccatttttattttacaatgatttgtattcattcattttctgacacacttattccagctcagggctgtgggtgcccggagcctatcctggcagctcatggtacaaggtggaaaccagctctagaccagacactatttcatcacaggaagcactcacacacactcattgtctactgggaccatgtagacacaccagtgaacctaacatacacatctttggcatgtgggaggaaaccagagtacctggagaaaacccctatgaacatgggaagagcatgtacaaactccacacggccaatggcctcaaacaggaattgattttttcctcatgaacagtataacgaaatgacattgtacaaaattatgttattggaagacttcctgtacctgagattcatttctataaaagctgtgtgggttgattagcacctagacggtcaatcccacaagcatctcaaactcaaatacccaaaactgaactcagcttttcccccaaacctgcaatattaccaattttagagagtggcctcattatttaaacctgccagaaacctgagtaaattaaagacttcttcatcttcctcacagttacacattcaaaacatttcgttaaaatctcttgaatccatcctctcttctttatctgttatgattatgcatctttactgtatgctggatgtgttctatttttactattccatttccctaggttgggccctaatgccttcttgtctggattgtaagaagtctcccagatggcctcctagtttgtctgtcttcggtttattctccacattgctgctaatgatccttctaaaatggaaatctgattactcttctgtgtatttttaaattgatatctaaaagtttttattataaacttaaacaaatgcaaagaatataatttctgaccatattgggaatattgacattttaaaaataaaaatgctatatcactcctttaagtgtatctaatataatttaaatactatagtgatttgataatcacatcatccattttttagaaaaatacaaactcctctttatctgctggacattccatatagctgctttttcctcttgaatttatttccatttcatttctcctacagaatttctcctaatgtaatttaattttatgcttgaaaagctcttttactgatcactctgtcatacccttctgtgtcaaaaaatgtgtttaaattgctgttttctgtcataagcctccaagtattaaaacttctttatggattgaattttcaattcaattattagtactatatgattgattaaaacaatatagattaccaattttgataattattaaccaaaagtaaaattttattggaagtccatctttttaaagagatgaatttgggtgtttatggtccctttattgaaggaattatttaattatctcttagttaaggttccaccagtttatttgtttttatttaaaaatatttgatacccaaaagtttttattctttggatcagtgcaaggtttaagattggggcacgggaatgcctttcttttataaagtggaagaaaggaagtgatgaagggaaagggaaaaagtggtacctcaaccttctcagagacatcaggtttttcagacaggtgagttttagaaatgcgtatatagtcatccaattgcttataaatggagataacattttgagaaatgcatcattaggtgattttatcattgtgcaaacatcacagagtataaacacaaagctagatagtgtaactactacacacctaagctatatatttttcctaggctataaacctgtgtagcatattactgtattgaataccgtaggcaactgtaacacaatggtaagtatttgtgtatttaaacatagaaaaggttcagtaaaaataggatataaaagataaaaaatggtaacacctgtggagggtgcttactatgaatgggagcttgcaggactgggggttgctgtgagtgaatcagtgagtgagtagtcagtcagcacgaagacctgggacattatactactgtagactttataaacactctatacttaggctgcattaaattgattaaaaaatactttcttcaataataaattaaccttagcttactgtaacttttaaacttacaaacatcttaaattttttaactttttgacccttgtggtaacaggtagcataaagcacagacacattgtataattgtacaaaatattttatttcttcatattcttattctataagtttttttattttaaatgtttttcttttcttaacttttcaaaccttttgttaaaaactaagacacaataggaatttttaagctccattataatgttgtaagactaccattgtgtatgcggtctgtctttggccaaaatgccattacatggcatatgactgtatatcgtagttgagtacagtagtacctccttatccttgaaggatatgttccaagacccaaccctatgtatgctgtgttttttactatacagacacatacctatgattaagtttaggcacagtaagagattaacaataactaataataacatagaacaattataacgatattctgtaataaaagttatgtgaaggtggcctctcggaatatctcatggtgctatatacttgcccttctcatgatgatgtgagatgatataatacctacaacatgaagagatgaagtgagatgaatgacgtaggcaggcactgtgatataacattaggctactacttccaactatgtgacagacaaagcagcttctatgtgatataacattaggctactactcccaactatgtgacagacacagcagctaagtgactaaagagcaggtaacgtctatggcactgctactctggacacagggatgattcatatcctggacaggtcagggtaggacagtgtgaaattttcttgccactcaaaatggcacacaatttaaaacatgaattgtttatttctggaattttcagtttaatagtttcagaccgttgttgactataggcaactgaaaccacaaaaagcgaaaccacgggtgaggggtaactactgtatctggaaattgagtctctgaaaactctcatgttcttgtatactacttggaatatgtgcatgtaactccaggggcttaagttgtacaatgaggaaataatagctttttccaaatgtgttgtggaggaaagcattacagtttcatgttcataacacaataaggatccaaaagtagcttagggtggttcatcagtgaagtgtgtattgcagggattgcataagtagaggggtaggcaaggaccaatcactcaccattcattggtgtttggatgttaattataggcagtgaggcagagttaaagagtcattgtttaattgtaaaaaattgtaggttttttggagtgtatcatcttcatttcaaccaagttgttcaaaagtcccttttgagtttttattttgcagttgatttttttttttaattccaaaacgtgtatatttacataacctttgaacagaggcttttgtttttacacacttattccgtaggttaatacttgtgacctcaacataactattgcatttttggcgggggggtggggggtggggacggagtgtcgctgtgttgcccaggctggagtgcagtggcgaggtctcagctcgcggcacgctccgcctcccaggttcactctattctcctgcctcagcctccgagtagctgggactacaggcgcctgccaccacgcctggctaattttttttttatgtatttttagtagagacggggtttcaccgtgttagccaggatggtctcgatctcctgacctcgtggtccgcctgcctctgcctcccgaagtgctgggattacaggtgtgagagaccgcgcccggcctattgcattcttttagtggtctttaacagctcctttacaatgatatgtgatgctgaaattatgacgtgatggccccagaactaattaaatttggattaaatttctttggtgcccttctgttgattcattcagattatgtctatgaacatccaaatgtagatttgtctgaggttatgtcaggctaagatgtattctccacatagtacttttgatgaaaagtgaggattcagagtaccctaaaatgtgagtttgttaattatttaagatgctttcaatagattgtaaactcagtgtttcctccaatgcttattgaacatttggttttcagtaattacttgttgaatgaatgtttattttatatatttaaaatgtcttgatcacaaatcagtataataaaaacaaatctctgaagatgtctttactatgtaggagcatagtgcacattagacctctgacccaagcagaataaacttttcttctaccctgagtctcttgttctctgttctaaattcagtgaaaatttacccatctttcaagacctcctgtaaagactccctgacccactaccactagccagggctaattaaatgttttctaggggtaggtacataacacttcactttacaatttctctaatataatttaaggtactataattgctgctattgacattttagattcctacaatttcagcactaaaggaaaacagaagtaaatttggtgaatatgttactggctatagtagctgcattgacatattattttctttggctctttgaccattggattttgtatgatgttctggaataagaatttaattgaaggggatagcagttttaatggaatgcttttgtggttgtctctttggtaggagaagggggaagatctttcttaatatgcagaggcctcttgtttcttctaatctcaatgtactagtgagagtctccattttagatagtaagcccaaagctatacctccccagaagttggaagtgctctttcattttttccttaggactccttaatgaaataacagaaatggtgtcttccatagatattaatagtaagtggatctatgttaatatctaaagtttcttaaggacaaatatttacctctgaatttgttaaaaatgctgaaatgtgatgctgtattggaattctataaggaattatcttgttttaggatggtcttcacaataccctcttcaatcccttctgactggttatcagtgcagtggtaatgatgaacacacttcttatggagaaacaggagtcccagttcctccttttggatgtaccttctcttctggtaagagaattactatctaggcaaggcttggacagaaatgatctatttcacacttatagggaaaatatactagagtatttccctttcaaagaaaagtaaattaggtggatgttagagtttttgtaaaaactgttatcttctgatttataaaatagacttttcttaatctctatacatcattagcataactatatttcctctaaagcataggactattatagcactatttttaaaaaatcaatataaggaaggggttgcaaaggttcagctactatgaaaactgttttatccagtagatacataccctttgatctggttgaatgtatctttctgtgactcattggggaatatatgaacagaaatagaagtacttcagccaggctcagtggctcacacctaaaatcccagcactttaggacgccaaggtaggtctgggcacagtggctcacacttgtaatccccgaactttgggaggccaaggcgggtggatcacttgaggtcaggagttcaaggcagcctggccaacatggtgaaatcccatctctactaaaattgcaaaaaatcagctgggcgtggtggcgcacccctgtaatcccagctacttgggatgctgagacaagagactcacttgaacctgagaggcagaggttgcagtgagccaagatcgtgccattgcattctagcctgggtgacagtgagacttcatctccaaaaaaaaaaaaaaaaaagaaatagaagtatttgtctccacccataatagtttgagaggaaagaaaaagttgtgacaaggaaatttaaaactaatagactccttataaaaattagccgggcatggtggtgcatgcctgtagtcccagctactggggaggctgatgcaagagaatcgcttgaacctgggaggcggaagttgcagtgagctgagatcacgccactgcattcctgcctaggtgacatagcgagactgtctctcaaaaactaatagactattacatagtcatgattgtggtaaaaataagtaaataaaaatatggttaaaaaaactaatagactcagcctgctggcagcctacatcatcatatgcctttgtttgccattggccagtaccactcttgttttaagtactaccctcgatttagcccttctctaaataagagattatctgaagaaaattttggtggttttgagtaagcttaaaaatttttgtagctaggcatggtggctcacgcctgtaatcccagcactttgggaggctgaggtgggtggatcacttgaggtcaggagttcgagagcagcctgaccagcatggtgaaaccccatctctagtaaaaatacaaaattagctgggcgtggtggcgcatgcctgtaatcccacctacttgggatgctgaggcaggagaatcacttgaacccaggaggtggaggttgcagtgagccaaactgcactattgcactccagtctgggtgacagagcaagactccgtctgaaaaaaaaaaaaaaaattgtgttactctatatatttttttctttatttctgctttagctcccaatatggaacatgtactagcagttgccaatgaagaaggctttgttcgattgtataacacagaatcacaaagtttcagaaagaagtgcttcaaaggtaagtctaggtctacaatttttgttttaacatttaaaaaactttacacatcctcaagtatattattatttgaacacattctgttttagtctgtcttctgttgctataaaggaataactgagactgggtagtttatatagaaaaagtttacttggtgtgtgattctgctggctagaatagtagacatctggtgaaggcctcaggctgcccccactcctggcagaaggcaaagaggagcccatgaatacagaggtcacatggcaagagaagggtgtactaccaagctcttttttaacaatcagctctccagggaactaatagagtgagaactcactcatcttttcacctcttagggagggcgttaatctgttcatgagggatccacccccatgacccaaatgcctcccattaggtcccacttccaactttggggattaaattataacatgagatttgggaagggacaaacatctgtagtatatataacacattcccaatgatattaacttctgattaagtctttttagggaccagattagatgtgaatggtggactgcctatctgtcaataactgttaactgtgacaatgcctttactcaaagttaagaaaaatactttttaggattaaaaacaattcttcaaaaagttaaatctttaacacttaatgtgattagagaagtgttgctttaaaatacttatattaatcaagcatttttcatgtttaaagcaaagttctaaccttaagaagctgataatttggaacccataagtcaagtgttgaaataactgaaataaaacaaagactataaatgatgtagaagtagaaagaaaacacactggtgtcaaagagaaagctctcatgtagtaaagaaggctaggaaaacttacgaagcatggggcatttgagttggattatggtatttagaccagtggaaatggaagggggcactccaggtgacgggaaaagcattagcaaaggtctagagatagaaaagcataggatataataggaagtgaccaatttgtttggaataaggtatcgagaacagtgagagatgaggcttgcaaccaagataaagactaaagaatgcaaaatgttgaatgtcaaactaaagtattttacattccattcagagagcatcatgaagttctttttgtttttggttttgttgttgttgttgttgttgttgttgtatttttggtagagatggggtttcaccacattagccaggctggttaactcctggcctcaagtgatctgcctgtcttggcctcccaaagtgctgggattacaggtgttagccactgtgcccagccagtatcatgaagatttttgaactggaatatatttcagaaagattccattgtagagaatatattactagtgaactcatggaaaggaatttgacatcagatggtagtagttctcatgtggtaattaagggaatgtgtaatttctgtgagtccacaaattctctttgctcatgccaaagggtgctgactactgattttttatgtgtgcatctttatttttattattttaagttccagggtacatgtgcaggacatgcaggtttgttacgtaggtaaacatgtgccgtggtggtttgctgcacataccaacccatcacctaggtattaagcccagcatgcattagctatttttcctgatgttctccctctccatgctccccctcaagaggccccagtgtgtgttgttcccctccctgtgtccatgtgttctcgttgttcagctcccacttatgagtgagaacatacggtgtttggttttctgtttgtgcattagtttgctgaggataatgacttccagctccatccatgtccctgcaaaggacatgatctcattcctcttatggctgcattgtattccacagtgtatatgtaccacattttctttatccaatctatcattgatgggcatttgggttgattccatgtctttgccattgtgaataatgctgcagtgaacatatgcatgcatgtatctttataatagaatgatttatgttcctttgggtatatacccagtaatgggattgctgggtcaaatggtatttctggttctaggtctttgaggaagcgccacactgtcttccacaacggttgaattaatttacattcccaccaacagtgtaaaactgttgctatctctccgcagccttgccagcatctgttgtttcttgactttttaaataattgccattctgactgacgtgaaatgatatctcattgtggttttgatttgcatttctctaatgatcaactactgatctttttactactacagctttccaggcatttaaagttatattaatatgggtaccacagaatacaatttagacatttcacatttaccattttctttgtttagaatggatggctcactggaatgccgtctttgacctggcctgggttcctggtgaacttaaacttgtaagtgactttatttcattaggatctgggtaaatactgataagggagtgctttattaaattgtgtttaccttatttttgaaaggttacagcagcaggtgatcaaacagccaaattttgggacgtaaaagctggtgagctgattggaacatgcaaaggtcatcaatgcagcctcaagtcagttgccttttctaagtttgagaaaggtaggtttgtgcttatcttctttcatctccttaaccttctttgcagttgggagataagaacctgtaattgtttctaccctttcccctgtcaaagttactgctttacctacatagatgattaagattctttttttggagacagtttcgttctgttgcccaggctggagtgcagtggcgccatctcggctcactgctacctccgctgcctcccaggttcaagtgattctcctgcgtcagcctccggagtagctgggactacaggcgcacatcaccatgcccagctaatttttgtatttttagtagagacggggtttcaccatgttggccaggctggtctagaactcctgagctcaggcaatccacctgcctcagcctcccaaagtgctaggatcacaggcgtgagccgctgcacccagccaggtgattaagattctaacatgactgaaaaccttaataaaattaaattggttttaggcccactcttctggacattatctctagcttgtccctgaaagtcaagagtctttgataagtttttctgtaatcttgcacataaggtaaagatttataaacagctacaataccattgttcaaccttgattgttcattgaagttaaaaccttgtactgggcactcattaactatttgtaaaacagagttactttaactctgcttgtaaaatctaaatgagctataaggctgataaacaacataatttttttctacctaaaaatttatcatgtatttggtttaaatggcctgttttttgttttttgtttgtttgtttgttttttgagacggagtctctgtcacccaggctggagtgcagaggctcgatctcagctcactgcagcctccatcccccgggttcaagcaatcctctccctcagcgtcccaagtacctgggagggattacaggagcctgccaccacgcccagctaatttttgtgtttttagtagatctggggtttcaccatcttggcgaggctgatcttgaactcctgacctcgtgatccacctgcctcggcctcctaaagtgctgggattacaggcatgagccaccacacccggccaaatggcccaattttctattatgttttcaactattacttaaaattgattttcctatgtttatattgttataatggacaaggaagatttaagagttatataacacagcacagtactgtagcagctagggaaaaacttatcagtggtgtctgaataagctcttcatttctgtttttgtttgtttgttttctccttccatttgtttctcactaaataattttttttaaatggaccaacaaacatttctctcaaaggagtctctgaagtaatctgactttaatctctgaataatagtgacagacattacaatctcctttatcactaaaaaaaaaaaaagtactctgttttaaaaatcaaatgttttcatttattcacctgagccatttaggaggttaagctggtttggactggttttttgtttgtttgtttgtttgtttgtttgtttgttttttgagacaaagtctcactctgttgcccaggctggaatgcagtggcgtgatcttggctcactgcaacctccacctcccaggttcaagcaattctcatgcctcaacttcccaagtaactgggattacaggcgtgtaccaccacgcccagctaatttttgtatttttagtagagacagggtttcgccatgtcggccaggttggtctcgaactcctaacctcaagtgatctgcccgcattggcttcccaaagtgctgagattacaggcatgagccaccatgcccagcctggcttggacttttaagaaagtcggttttaatttactgtggttgcagttgaaactggaaccttgaaggggaaatatggcatgatttttcttatttctgcataactttattaacatatttaagtagttaggtatgcttgtgttctagttttctacactcttgtgtcatagttcactctgagtttgtaaacataattttaagataatgaaaatttacctaactaaagagtagtggaaaacatatcttttggtccttttgcttaatttttacaactctgcatgtgaatcagcctgtgacaatgagctgtagaagaaaaggcactgagttagagattggggcaggtggcttttttcatgattttcagtagttcataggtactctagtgtaaattagtctgatcggatactgctcccaagccctgtggtttgttttgttaaaacagaatagataatagctccactcactccatcagccataagccctcttgcagggcaaacctttgcaactaaacatggaagccctctgttttattctggcctcctgggcaaagtgattttaacctccttgggccttcattttctaattttatgagataaatacctagtctatttaggtcacaaaaatattgtagacataaaagtgaggtgaaatatgaatacttttttttttttaatctgagctcattatggtggctcatccctataatcccagcaacttgggaggctgagaaggattgcttgaggccaggagttcacgaccagcctgggtaacatagtgagaccctataagaaaacagaaaattagcttggtacagtggtatgcacctatagtccgagctacttgggaggctgaggtgggaggatcgcttgagcccaggagtttgcagctgtagtgagctgtgattgtgccatcatactctagcctgggcaatagagtgagacccagtctcaaaataaattaattaaatcaatcgatctatctataatcaatcagaggaccatataaatacttagtgttttgtgggggtttttgtaggtagtatggtagaaaacatctttggtccagttccttccaccctacataggtaggatacaaataatcctaactggacatagtcacactaatggaatttgccttccctaagtatctaccaactaaaagcaaagaaaatggactcagataagtgctttgtgtggcaaaagggcaggtattagaacttctagtggataattaaaattgattataaatttatttcctctcctacaaacttacctatatttacaccttctttctcattcttcattctcaagttttaattaaatgagaatctcttgcaagtgggccaggcatttattttttcaaagttcctcaagggatttcaatgtgtagctaaaattgagaaacattcttgatccttcccaagaccttccaccatcacatgtatccccactaccctgtatcttcaagttctccctctctattggctgtttctccttaggagaagatatttggcctattttcccaaatatcttaaccctgtgttctcttttagttgttactgtttcatattttccatctcctttaatttggtttaatctattttccacatctagccctcttcctgaaatcactcttgctaaggttattaattatctaattatcagaaagcacgaaacttttcaggtcttttcttctgcttgtataatatgttacacttttggtcttttatagaatttcaataaaagtctttgcttagaatctgtgatatcccactccctctggtactccttctgtccttctctttattctttcatagttgcttttacctaggttgaagtgttagcaaggcccaggatttggtgtttagcctttttttgctttcaacctataccttcttggacagtttcatctgtaccagttttgttttgtttttcatcctacttgtgttgacccagatctatattcctagccttaacctttctgcaagtacttcagattcaacatatcaaaaagtgaacccacaattcctccctgaactcatgatttctccctggcaatgccatctttttcctctcctctgatatcatttccttgaacaacgtatttaacttttcttatagtgtgagtctgatggtaataatttaccttagtttttctttacctgaaaatgtccttatttcatcatcattctcgaaggacatttttgttggatatgaaattcttttttttttttttttttttttttttttttttttttttttttttagcccagaggtcctttattttttttttttaacacctattatgccatgaattcatagggaataggttccagcagctcaggctccttcccattggttctcacaaagtgtgcttctctgggtggagcaggctggcgctttagttgaacccaggtacctttctctttggcttctttctttttctgatcattttccttcacacgtttcaggaagctatctcggctcttagaatgcttaatgtgctcaatacgcacattaattctcttggcaagaatcttgcccttaacttgtttgtttacaacaatgccaacagcatgctgggtaacattgtagactcttccagttttgccatggtaacacttgtggggcattcctttttgaacagtacccgttcccttgatgtctacaatatcacctttcttatagattcgcatatatgtggccaaaggaacaactccatgttttctaaaaggcctagagaacatatatcgggtgcctctcctctttccctttgtgtttgtcattttggcgaattactggaagatggcggttccggccgaaaagaagctggatatgaaattctgggtcaacagcttttttttcctttcattgctaaagttgttccactatcatctctgctttcattgagaactctgtggttgttaaaatcatttccctgtatataatatgctgtttttcctgactattttcaggattttttgtctttggtttctagcagtttgactgtggtatgtctagtcatggttcccttcacagttttcctgtttgaggcttgttttagctttttgtatttgtaaattcctttttactgaataggaatttttctatcatttcttgaaatactttttctgggccaggtgtggtggctcaggcctgtaatccaagcactttgagaggctgaggcaggcagatcacctgaagtcaggagttcaagaccagctaggccaacatgatgaaatcccatctttactaaaaatacaaaaattagccaggcgttgtggtgggcacctgtaatcccagctactcaggaggttgaggcaggagaatcgcttgaacctgggaggcggaggttgcagttagctgagatcgcaccactgcactccacactccagcctgggcaacagagcgagactctgcctcaaaaaaaaaaaaaaaagaaatattttttctgcctaatttattcatattctctctcctccctgcttcttctgttaccttaattacccatatatatatattttttttcaattactcatgtatttgacttttctaaattatcccatgcatccttgaggttttgttttttttcagttatcctaaacttaagataaaatgaacaagccataaaattcatccatttaaagtacacggtttagtggtttttagtttattcactaagtcgtgcagctatcaccacaatctaaatttagaatcttttcatcagtccaaaaagaaacttgaacgcattagcagtactttcacccattccttccaaccttatacaaccactatagtaatttcggtctctatagatttgcccattatacacatgcatacaaatggaatgatacaatatgtggtcttctgtgactggcttctttaatttagcctaatgttcagttctatttttctctctcttcttcaaattgaatgatttctattaatttgtcctaaagttcactttctctattttctccagcctgttcttaggcctatccagtgatttttttttttaatttcagatactggttttcagttctaaaattttcttatgttttttttaagacagggtctggcactgttgcccagattagagggcagtagcatgatcataggcacatgccaccatgcctggctaatttctttttgtattttttgtagagatggggtttcacccatggttggtcttgaacttctgggcccaagggatctgtcaaccccagcctcccaaaatgctgggattacaggcatgagccacagtggctgaccttcatttgtttgtttgtttgtttgtttcctgctgagatttatcatctttttattgattacaagtgtatatatttttttcttcctttttttgttttttgttgttgttgttgtttgagacagggtctcactctgtcacccagtttggagtgcagtggcgaaatctgctcactgcaacctctgcctcccgggctcaagtgatcctcccacctcagcctcccaagtagctgaggctataggtgcatgccaccacacccagctaatttttgtattttttgtagagatggggtttcgccatgttgcccaggctaagtgtacgtttctttaactcatttaacatggttatgtatcctttacaaccttatctgataaatcaatatctggattatcttgggattggcttccattgatttattttcccttgagaattattcgttttcctggctctttgtaagtcaagtaatttaagattatattcaggacattgcgagtggtatgttggattctagattctgttatattgcttagaaaagagttggtgttccttttttaacaggcaattcacttgtttggatccaaattgaagactgtcacacctacaggagggcagtggatcttatctcaattattttctttagtttaagcctcagctgcaaactgctttcagtttctcttgcccatatggtacaggggtcagccagagacttggactgagtttaaacacggaatcatgggttccctttctctagctgtctccaggttttccccatcccctcactctctgactgttcttgttgctcccagtctccttttccttgttcttctggcttgaaagatggcagattttttaatttgcattttagctgcctggtattaatgctgcaactttggctgtcctcaaggtaaaaccacacacacaaaaaaaaaaaaaacaccaaaaaacccagtaacttaatctcaggccaatcatttgctaaagatgttgactctcctccaaaaattgcatgtttaagaggaaagtgggccaggcacggtggctcatgcctgtaatcccagcactttgcaaggctgaggtgggctgatcacctgaggtcaggagttcgagaccagcctggccaagatggtgaaaccctgtctctaccaaaaatataaaaaattagccgggtgtggtgacacatgcctgtaatcccagctactcgggaggctgaggcgggagaagcgcttgaacctgggagacagaggttgcagtgagccaaaatcgtgccactgcactccagcctgggtgacaacgagacaccacctcaaaaaaaaaaaaaaaaaaaaaggaggaaagtggtaacttaaagggaggagtaaattttatccccaaacaacagtttctattttaggcggagtaaattccaacaaaaggggaaaaatgaacccgagtgacattctgtacaaccaaagctgttaaaaggaatgaatagtgcctgacacttaaaaagtgctgaattagatgaatggtttcaacatggctgactagatgcatctggtactcacctctttcacagagtggaaccaaaatagtgagatattatagtgacagtgagatcgtagataatcacccttcaaatagatcatctaagagagaacactgggattcaacagagaagtgataagaagctccggaagcaaggaaggagagaaaagtaaagcagcctgtttggctgggatcagctaggaatctggagaggcttcctatgcagggacagagtaagtgggagacccccagcagcccaaatacccactgtgaaccctaataatagccatgggagaccccttgatgctcacggaccctgagactaacatagggagctgcctggagacttcatgaaggcattgctccagagagatatcatactgggtcccacaaaccctcaagtcctaagcagctgtaacactgattttcagagcccagcccccaccagactgtgtcctgccctgccacccaggctgaattgggagccacacacagcgacctcattcccctgagtggaggggcagctgcacattttcacactccccaaggacaaattccacttcctgcaaccaccaccactctgggctgctgcagggcagaggtgtaagcaaaactcagtcgtttaactgcctgcctatgggtactcccagggaaagcaaccccactctgcatgtcagtactgcagcatagctgctgctgccccttacctgagcattccactggaagcctggggatcaccccacccctgccttccatagccagcacctgcatgcaccaccagggtcactgagggcagttccacctagcctggcttcatacacgccactacccaagcacaccctctgggaggcctgaggattgcccagttcagttcatcaccagtggtgcctgagcactcctcctagagtctaaacttgggcctactcaatctgctgctaccaccatagctggcaccaacctgtacatgcaacctgcaagtctagggactggcctgcccaacctgtcacagccaccgccaacactagtacggaacacttgggttccaggggattttttcatcactgctactgtcatcatccacaccactccacacctcctgcccaggggctcaagaatttgcccacccacctggcccactgctgccatttccaatacctgagtaagtcatctgaaggcccaagaatctacctgcctggatccattaacaccagtgccagcgtatgctgccttggggccaaaggacacacaggctcagaccactgctgccaccactggggcctgaagactggcccacctggtatttcaatttctggcaaaacttaaccagtctgcactaaaaaccacactctaatctaccaacgaaaccagataccaatgactctatggccaaaagaaatgatagagactatgctactgcttgcatccagaaccaaagccaagtgtcctctccaaccatcaccatagatacatcttcaggaaaatgttctccactacaaaccaaattcaaaaaattggaaaaagcaactgttacaccaggtgcacaaatatcaacataaaaacacagagaaatcaaaaagcaaggatatgtgacacatccaaaggaacacagtaattcttcagcaacaaatcccaatcaaaaaggaattctcaaaatcctggaaaaatgatccaacatactgatactaaggaagctcagtgagagaaaagagaattctgaaagacaatacaaagaaacagaaaaataattgaggaaatgaatgaggaatctaccaaagagataggtatcataaaatagagctaaattctggaactacagaattcatttaatgaaatacaaaatacctttgaaagcttcaacaatagactagatcaagcagaagaatcccagaacttgaagatgttttgaagatcttttaaaataacctactcagacaaaaatagagaaaaaataataaacatgaatgactaaagctttcatggcatatgggacactataaagtggccaaatatatgaattttcagtgtcccagaaggcaaagataaaatgaaagggttagaaagcctatttaacaaaataataggtgaaaacttcccaagtctagcaagggatttatatatccacatacaggaggctccaagatccccacatggatataattcaaaaaggttttttttccatggcacattgtagtcaaactcaaaagtcaaagacaaagtgaaaattctaaaagcagagaaaaaacatctagtcacctataaaagaaaccccatcagacctaacagcagatttctcagcagaaatcttatagttcaggagagaatgagatgatatattcaacatgcttaaagaaaaaaaaaaaaacctgccacccaagaatactacacccagtaaaattatccttcataaataaaagagaaataaagtctttcccaaacaagcaaaagctgaggaaattaatcaccagtagatgggccgtacagaaaatactaaaaggagtcttataccgggaagtgaagagcaatatttactgtcatgaaaacacaagaaaatataaaaactactggtaagcaaacacacaaacaagaaagaggaaaggctgaaatgttaccactaccgaataccatgaaaccataatgataaaaagtaccagagaaaggaaggaacaaaggatatacagaacaaccagaagtcaatcaataaagttaggaataagccttcacatatcaataacgttgaatgtaaacatgttaaactttccatttgaaaagtacagactgggcaaatagacaaatgtgacctaattatatgctgcctacaagaaacgcatctcacctgtgaagacaagtataaactgaaaataaaggaatgtaaaaagatactacatgcaaatggaaaccaaaagcaagcaagaatagctatacttacatcagataaaacagactttatgtcaaaagcagtaagaagaaacgaaggttattctatgatgataaatcagttcagccaaaggatatatcaattgtaaacatgtatatacctaacactggagcacacagatatataaagccaatactattagatctaaagggagagactccagtgcaataacagttgaggacttcagccaccccactcagcgttagacagatatctagaaagaaaattggatttaaactgcacattagaccaaatggacctaagagatatttacagaacatttcatccaacagctacagaatacacattcttctcatcagcaaacagaatattctccaagctagaccacatgttaagacacaaaacaagtctcaacacatttttaaaagttgaaataatatcaggaatcttctcagaccacaatggaataaaactagaaatcaacaacaaaaggaagtttggaaactacaaatacgtggaaattaggcagtatgattatgaatgacttgggtaaaggaagaaattaaggaaatttttacaattcttgaaacaaatgaaaattgaaacccaacataccaaaacccatgggatacaataaaagcagtactaagaggaaagtttatagcaatacacacctataccaaaaaagtagaaagactttaaaagaatctaacaatgtacctcaaggaactagaaaagcaagaacaaaccaaaccccaaattaatagagggaaataataaatagcagagcctaactaaatagagacttaaaaaaacaagaaaaagggtcaacaaaacaaaaggttggtttttggaaaagataaacaaaatcaataaggtacttgctagactaaccacgaaaaaaaagaaagatggtcttaaataaaatcagaaatgaaaaaggaaacattgcaactgataatacagaaatacaaaagatcatcagaaactattgtgtacaactatacactaactagaaaacctagaggaaatggatagattacaggacacatgcaacctaccaagactgaatcagaaagaactaggaaacctgatcaaatcaatagtaacaagatcaaagcaataataaaaagtcttccaacaaagaaaagttcaggaccagatggcttcactgctgaattctaccaaacttttaaagaactaacaccagttctcaaactattccaaaaattgaaaaggatgggaattctccctaactcattctacaaggccagcattattctgataccaaaaccagacaagcacaaggacacacacaaaaaaactacagaacatacggacatagatgcaaaaatcctcaacagaatactagcaaactgaattcaacagcacattaaaaaaaaaaaatacaccatgatcaagtgggatttatcccaggaatgcaagaatagctcaatatagacaaatcaataaacatgatacatacgtcatcaacagaatgaaggacaaaaaccatatgatcattttagtagatagagaaaaataattcgataaaattcagcatctcctccgaattaaaaaactcaaccaactaggcatggaaggaacatatctcaacataaaaaggctgtatatgacagactcacagttaacaccacactgaatcgaaaaaagctggaagcctttcccttgagaactggaacaagacaaggacgcacgcttttcaccactcctattcaacatggtactggaagttctacccagagcaatcaggccagagaaagaagtaaaaagtatccaaactggaaaagaagttgtattttccttggctgatgttatgatcttatatctagaaaaacttaaagactctacaaaaaaaaaaaaaaaaaaaaaaaacctcagatctgataaattcattaaaagttgcagaatacaaaatcaacatacaaaaaaaatagcatttctatacatcaataatgaattagctgagagagaaatcaggaaggcaatcccatttacaatagctacaaaaaaataaaacacttaggaataaatttagccaaagaggtgaaagacctctataaggaaaagtatgaaaccgatcaaagaaattgaagaggagacaaatggaaagagacctcatgctcatggatgggaaaaaattattatttttaaaatggccatactaccccaagcaatctacagattcagtgcaatccccatcaaaataccaacatcatttttcacagaagtagaaagaacaatcttaaaatttatgtggagccaaaaagaacccaaatgccaaagcaatcctaagcaaaaagaatatagctaatataataactaaaacagcatggcataaaaacagacacagagaccaatggaacagaatagagaattcagaaataaatccatatatttacagccaattgattttcaataaaggtgccaagaacctacaataaacggtgctgggaaaactgggtatccacatgcagaagaatgaaactgtacctctatctcactatattaaagaaaatcaagataggccagacatggggctcatgcctgtaatcctagcactttgggaggccaaggcaggtggattgcctgagctcaggagttcaagaccagcctgggcaacatggcaaaaccccacctctactaaaatacaaaaaattagcttgacgtggtaggcgcgcctgtagtcccagctgcttggaaggctgaggcatgagaatcgcttgagcacaggaggcagaaattgcaatgagccaagatagcaccactgcactccaccctggttgacacagtgagactcagtctcaaaaaaaaaaaaaaaaaatcaagatggagtataaagacttaaatgtaagacctgaaacaatagaactactagaagaaaacatagggaaaacacttcaggatattggtttaggcaaagattttatggctggccaagaactcaaaagcacagacaacaagaacaaatagataaactagactatactaaactaaaaagcttctgcatgccaaaactttttgaatgggaagtatttgcaaactatttatctgataagggaataatatgtagaatgtatacaaggaactcgaacaactcaacagtagaaaagacaaaatattaaaaagtaggcaaacacagactgggcaatgtgccaaaactgtctctacaaagaaatacaaaaaaattaactgggcatggtggtgtactactgtagtcccagctacttggtggggctgagatgagaggatcactgagccctgagcggtgattacatcgctgtactccagcctgagtgatagagtgagatcctgtctcaaaaaaaaaaaaaaagtaggcaaagaccatgaatagacatttcgcgaaagaagacatacaaatggccaacaggtatgtgaaaaactgctcaacatgactaataaccacagtgagatatcatcttaacccagttagaatggctattattaaacaaaacatgctggcaaggatgtggagaaaagagaactcttgtacactgttggtggaaatgtaaattagtccagtcactatggaaaacagtaagatttctcaaaaaaaaaaaaacaaatagaattaccattgatctagcagtctcattattgggtattgattcaaagacaaacagtatatcaaaggaataactgcagtcacattgttgcagcactattcacaatagccaagatatggaatcaacctgtctattaacgaacaaatagagtttttaaaaatgtagtatatacacaattgaatactatttggccataaggaaatgtcattcacatcaacattatgttaaacaagccaggcacaaaagataaatttcacatgttcccatttatatgtgggtgctaaaacagtatcatggaggtagagagtagaatgataaataaccagaggctggaaagtgagtgggtgtgaggggggaatgaagaaaggttgcttgatggatacaagcataaagttagatagaaggtgtaagttccattgttcgatacctgactattgtcaccttacaaattattgtatatttcaagcagctagaagagagaacttaaaatgttcccagcacatagaaatgatgaatacaaggtgatggataccccagataccctgacttgatcataacacattctatgcaggcatcaaaatatcacatataccccataaatatgtaaaatactatgtatcagtaagaaaaattgcatgttttcattcagtttccacagagccctcaggtagctgtttttgtgttttatcccatgtacaactaatgcaagtggattagtttaagtgctcactctttcacacaggaagcagggtttttttctggcttaattttaaagaataaaacattacagataaattgaagttctcctatagtgccttttccaatcccattgcatcccaggcaacctctttaacaaacttcatatggatctggtccatatttttatactgagccaatacagtttagaggtttggagtgtaagctctggattcatactgccaggaatacctttacaagttacttatcctctctgtgcctctcttggtacttacctaataaggttgatagcaaggattgagataatttttataaaacacgcgggatagtagctaacatttagaataagaagcactctgtattttgactcttgattgttattcttattacaactgtactatatattttatatgggttttaaaaaatttacagaggggtgattctatgaagttttggttcaacattagcatctcaagctcttcataatcctttttcctatttgttattgagccatatatttttaaatgtttgatctccagtgacagatacagtacctagcacataatagatagtctacaaaatgtaaactgaaatatatgtgtcattgactggttttgttaacctcttaataatctgtttatttccccacagctgtattctgtacgggtggaagagatggcaacattatggtctgggataccaggtgcaacaaaaaaggttatctagatctattttaattttgagagatttgggattaccctgtacttaattttgagtgaaagagttagtgatttcatctgattaccaccagggggcatgtactcataatttcccatttctgctcactgttccagatctcaggatcttcactgagtgtcctgagtgataaatacatgagtgtcactgttacaagtattacactcatgtatttatctcatattgtcttctgaattataatgccatttacccacattattgatggacttaaaaatattaatacgcagcctcactggtaaatgtctttattttggtttttaagaattttttttattttattattattattttttttttttttgagatggagtctctgtcacccaggctggagtgcagtggcgtgaacttggctcactgcactccccacccgctgggttccagcaattcctctagctcagcctcctgagtagctgggattacagccacccgccaccatgcctggctaatttttgtatttttttaatagaaatggggtttcactatgttggccaggctggtctcaaactcctgacctcaagtgatctgcccaccctggcctcccaaagtgctgaaattacaggcgtgagtcaccaggcccagcctgattttaaagaattagattgaattaaacataagctcatggttgtctcatgatgctattaagcagacgatgattatctcactgttcacttttagttaatttattaaaatttttttttgtgtctgcattttaaaaaattggtaacatagttctacatattttcaggggtatatgtgatatcttgatacatatatagaacatgaaatgatcaaatcaggataattgggatatccatcacctcaaacatttatcttttctttgtgttgggaacattacaattcttctcttctggttttttgtttcttgttttttttttttttggagacggagtctcactctgtcacccaggctggagtgcagtggcgtgatctcatctcgctgcaacctccgcctcctgggttcaagtaattctcctacctcagcctctcaagtagctgggattacaggtgcatgccaccactcccagctagttatgtatttttagtacagacaggatttcaccatgttggccaggctgatctggaactcctgacctcaggcaatctgcctgcctcagcctcccattcttctagctattttgaaataaataataaaattatttagaaaaattttaataaaccttattttgtagagcagttttaggttcacagcaaaactgagcagaaagtacagagagttcccatatagcccctgccctgcccacacacagacttccccactgacaacatcctgtgcctgagtggtacatttgttataatcagttaacctatgtcaacacatgctgtcactcagagtttataatttacatcagtgttatatattcttagtattacacattctgtggatattgacaaatgtgtaatgacgtgcgtccaccattgtagcatcatacacaatagtttcactactctagaaatcctctgtgctccagttattcatccctacctccctctaagccctggcaaccactgatcttattacttcccccagtcacatttcctccatgtcattttatggctttatcaagctcatttctttccagtgctgaataatattccattgtctggatgaaccaaagtttatccattcacctactgaaggacatcttggttgtttccaagttttggcaattattaaagctgttataaacatctctccctttttatacattatagtctcaccacaggagatgtagtgcagctggctctgctggcttctaatttcaccaacttggtcaaaaattacttaatattgaagttttatttacacatgttatattcagcatgtaagaatcctgaaacctaaatttccttggaatatctttcagatgggttttataggcaagtgaatcaaatcagtggagctcacaatacctcagacaagcaaaccccttcaaaacccaagaagaaacagaattcaaaaggacttgctccttctgtggtaaggttttacagatgtatacatgtgtgcagatcttatctgtaggatagaataaatgggaggctattgattaagtgaatgagaatcttcatgattctcatttgatatcagtggtttattgcttattcagtacctacatttgtggttctcaaattttaatttttggttcttctgaattataatgccatttacctatattattgatggaattaaaatatatgtagcctcgttgataaatatctttaaatttattttggttttaaagaattagattgaattaaacataagatgttgtctcatgccattaagcagaaagtggtttttttttttacaatttcaatatctacattttaaaaaattgataacataattttacatattttggggggtacactatgtataatgatcaaatcagggtaattgagatagccatcacttcaaatactgtgtgcatcagagttgcctgaggcacatgttgaaaattcaccttactcatccctaaaaatctctctacacacacagacacaaacacacacacacaaacacacccctatagtatagtggaattcattaggaaaagtgggggaggagtagtttgaagaagcatattaagtactgtgatgcagttttctaaggggaaagaatacctgttgttttcgtaatacaaactacagaaaaatatgttttttgttttgagacagagtctcgctctgtcacccaggctggagtgcagtggcgcaatcttggctcactgcaagcaccgcctcccaggttcacaccattctcctgcctcagcctcccaagtagctgggactacaggtgcccaccaccacgcccagctaattttttgtttttttagtagagacggggtttcaccgtgttagccaggatagcctcaatctcctgacctcgtgagcctcccaaagtgctgggattaccgatgtgagccaccacgcctggccagcttatttttaagcatttgacaaaatattgttaaatatattgagaaacacatgggtagaacatagtaccactctaataacttacagtcagagctcaaacaatgcccataatatatcctttttctttaaaaaattgccctttttctcactttaatgtaatttttttttcatattcctggtgtgtagggtacaagttaatattttgggggaagtatgactgctaagacattaagacttaaaactatacaccgtgaacaggacacaagcatgaatggaagcagatagtagaggccatatgaagttaaaacgagtagcatttcagacatttaatctggttctgagccaagataacttgttaagtaatagcaattaggaggtacgactccactgggcctctttttcagggcatgaaataatcttttattcataattcttttgatactcctatatgataatctaggtagacagcaacattttagagattaaactggcacaagaaagttaaataagtttcctaaggatacacacagcatattagtagggctgagtctaagtagatgcagtaggctcagacgagcaaaatcttttagtcaccagtttgttttttgagtataagttgaaatattaacactgtatactaaaacttaatgatccttgctaaaattacctcttggtcagcatatatatctgatcgagatcattagacaagacttcatctaagtcagtctggggagaaaagtcgttttttagcaccttgttcccttgatggtaaagattatgatgcccaagatagaatcttcttcttttcttgtgctatcaggatttccagcaaagtgttactgtggtcctctttcaagacgagaataccttagtctcagcaggagctgtggatgggtaagagtctatttcttttttcttccgacgagatcttttttatgagattgtgatgaggcagtcacatagtctcattataattgaatgtgtgtgctttcaactgtcaacatagcaagtaccccaactgaggaaaggagctatagatcacattggaaaatacctagttgaaggactcttgctggataattaaatgaaagaatacatgtgtcacgcttagcacattgtctagcacataagagcagtggtagctgctgttgctatcttagaaaagaagctggctgggtagcttgcttgccttatgcaatataatttagtcactaattctcattttgaagagtaaaatttctgttactttgggttttgtctttttcaggtttaagaatatcctaaaagaagaaatctgattctggggatgtaattgacatttctgggagtaatctaactagattgatgatagtaaggtctaatgactttcacatacctgtcatccatgattagtctgaattcttggcttccaaataagtctgctctgtgatgcttgttgattgtgttgtagaatattaattctatgcaaatggagactctttctttttaagtttccttcctattatatctctcaaggcatccttctcttaaaatttttaatttaaaagatgatggcttaccaaactaggatttccattgtgtcctctgggcactaaaaccctctgaaccaaattctcaggcaggaatgaaggattatctaaaggttattagttctgcttgtgaatgactgtgaaagcttgctctgtttgtttccaagaatactgtcatttcatagcaggtctgtgttttcaagttacctttatactagaagtagaggattaagacaattatctcaatagatgaaatgaaaaaatactttatttcacagaacaatttgtttagattatttaaagagttatgtatggagatataaccacagggacagaacttgctacttatgatatcaaaaatatatgcagaatattaaaggcttaggaagtgtattttctaaaaacaatggaacaattactatcggcactcaaccttcatcttccttttccgttctcttagagtaaactccagtaacccatcactgggtcaaatcacatctgtttccgttctgtcagaattataagcctgatattggagacaacagtataagatactttaatttgtttcccaatgaaatatccttactgtacctagttaatgtgccagaggagttagattaaaagtcatttcacatttagtgtagttgaagttgtttggggttggaagaaggtctacaaaatatttatttgccttggtttttaggataatcaaagtatgggatttacgtaagaattatactgcttatcgacaagaacccatagcatccaagtctttcctgtacccaggtagcagcactcgaaaacttggtaagcctttaataggtcttttgggggagataagagtttttgtttaaaaaaaaaaaaaaaggctaatttccagtaacattgatatgaaaaattctaatatgtgaagttcaaaagataaaaactcagaagaatgtttttggtttgtgtatattttggggacaaagaattctgatgatgattcttatgaaatgatctatttttgtctctacattttaacctcagatctactcaccatcatcaggacgtgctaacttaagtttcctttttccaggatattcaagtctgattttggattccactggctctactttatttgctaattgcacagacgataacatctacatgtttaatatgactgggttgaagacttctccaggtaagatattagtcattcaaattctcttaccaggaaagcattatgggctttttttggtaatgataatttaatgggctttcttctaaactgaacttattaagccatatgaggactttggcatctttgattacatccagtgataatttcataagtgtacattccttgtgatgatttcataagttagctgaattgtgctttacatggtgactttattttaatagagagtatctcctgaaattatgccctttggcctatatttagaattctctcaattttttatttaataagctgtggagtagataaagtgcttctgctcagcttttttcctctttaggggctgctggttaaaattagggggctgaaattttcatacccccaaaatagtttcagcctatctcagccttctccttaatgttagaggcccttttatttctagatgttttccccagcctcaccttttttttttcctcaaaactttaaaaatagaatctgatacttaaaactaataaataaatgatagttttaaaaagaaaacccaagtttctcaagcatgctttcctcttttttttaatcctctcccctccctcttccaaatcaccagcctcaggcatgctttaagagagttatttgggttacattatttttaagaacatcaatttcttaagcaacatcttagtagcctggttattcctcatctatagatctttcaaaaacactttgaattccataaccaatcctcagagttacccagtttccactaaagtaaaaagtgctgataaacaagaaatctcaagtacagaacttgttttattttatttatagatagatgtagatatagatataaatttttttttttttttgagacggagtttcactctgttgcccaggctggagtgcagtggttcgatctcggctcactgcaccctccgcctcctgggttcaagcaattctcctgcctcagcctcccaagtagctgggattacaggcgcccgccaccatgcctggctaatttttgtatttttagtaaaggcagggtttcaccttgttggtcaggctggtctcgaactcctgacctcatgatccacccacctcagcctcccaaagtgctgggattacaggcgtgagccaccatgcccggcccagaacttgtcattttagctgagatcttacagaattttccaaagatcaccccaagcaatcttattaggactttagtatcggtggcagcatcatagtctgcatttctgatactttgcactgggtctagttttctctaaacaggagcaatagtatttagaaaagggaagaggtgtttcttttgctattttccttaatggaatctgagcttggagagctgctaatttagttagtcaaataaaatagacttttcaacatctttccttgaaagataaagcgtgatcctgattatattatcagatgtacaagagctctttctatataatttttgctacagtgtggcactgaaaaggtccttgagtttagtgtcctgctgtccaacacttcgctaataatttagtaaaccttttctatgcttctatttaatttcatttgcgcagatggatagataggtagataggttaatagatcgatttattccttaaaaattgaatgacagctggccatggtggctcacacctataaacccaagccgaggctggcagatcacttgagcccaggagttcgagaccagcctgggcaacatggtgaaacctcatcttgacaaaaagatgcaaaaaattagctggatgtggtggcatgcacctgtagtcctgctacttggaaggctgaggtaggaggattgtttgagcctgggaggtttgagtcttcagtgagccatgatcttgccactgcactccagcctgggtgacagagtaagaccctgtctcaaaaaaaaaaaactgaatgacaactgtgtgtgtgtgtgtgtgtaacgtcttgtaattacttgtccttttcaaaacttctgaatcgatcttggattcgatacttgatctaccatgctttgtattatggtgtttatatgttcataaggatgacttggttggaagtacttgaaaagcccagatcaccaaagcaagattaaattgagctcattaaagccaacatacattttaggaggatttttagcaaggtttaaacatttacagtgcatatcataccagcctttcttagaccagcagagggcaataaatacttacaggtgtagtgggaaattcaggctagagttttccattcatagttgagagttgaggaagattaaaaattacagttttagaacaatgttcagaataaaggagcttgtttattttgcagtgataataggtgtatacaaattgattcatatcctgcctcactttcacagtaaaaatgtctgatgtgaggagtatttgctatgcctgcatagctttttcctttaaagctataaatacaaagttcttttccagctttattctagaaaatggaagagattcctgtgagcacttatgggaagctgttaagtcccctactaatacttttctctctggagtgtgattgttttttcctgcctaaaggtatccttaaattctccaataattgagatttttctcttgtatttcctagtagtgttctgatgtcagaggcctcaggttttgaccttcttaggatagaagaacctgttaagaacatatgctagattgggttacctgcccttttgccattgagagtgagaaggctaaacctaatctagtgccttacatataaacagtttactccactagctcttccaccattcagtctactcaaagtgctggattaaaatgattctcacatcccacataagctattagtaagttttaaccagaactcaaatgatacttttcactgattttttttttccttttcatggaacaaatgtttgaggatctactctgttcaaagcactataaagtctagtgaggaaaaagtaagatataaaatttatcctcaagaggcctgaagtctaaggggaaattagatgaatatattatgcagtggaaaaaatcctaccctgggctggagagagagggtcttataaaggcattttactgcaagttggacattggctggattctttttttaaggaatgttttccctccaatttttttctcttgatattgccattttcgtaccaagtactcagactgagttcatgagattggatctaatataaagcttccttctagggttttgtttttctgccaatgtctagttcccttgtatttgatggataaagctagatcatctgcttcaataggcaatacagtgataaaacttgttagaatatatatgctgtctatatccatttgaccactagaaataacaagagccaagtaatttggtttttttcctctggcagtggctattttcaatggacaccagaactctaccttttatgtaaaatccagccttagtccagatgaccagtttttagtcagtggctcaagtgatgaagctgcctacatatggaaggtaagttgctaaacttcacccacaagtgttagactgaagtattcttgcaaatatttgttctgtccaatatgagataagtttaatgtaaccacgtgctatactattcctgcatcagatatttagtaaaggttgctcttggctcttaatatagctgaaaccttactctactacagaatgtatgacactttcagggccatagcttgtcagaaattgacaatttgtatcctctgtttcaaaaattattaggaaattgagaattcagagggtgataagaaccttaactactttgtcctgcatcctggaaaacatgctatactgactttctgccctatgttttcaaactctcgttcagaatacagtattttgatccctaggatcctgtgcttgaatcacccatggagccttgcacaaaacagaaactcaaaaatatttttatgattaatttattctttattctctccttacaagtagctgatcttcaggccactaaagtagatatggctgctttatcagatttttatatatttaatagcattatttactaatcttttttttttttttttttattgagatggagtctcactctgtcgcacaggctggagtgcagtggcacgatcttggctcactgcaagctccgcctcccaggttcacgccattctcctgcctcagcctcccgaataactgggactacaggtgcctgccaccacgcccggctaatttcttttgtatttttagtagagacggggtttcaccatgttagccaggatggtctcgatctcctgacctcgtgatccgcccaacttggcctcccaaagtgctgggattacaggcatgagccaccatgcctggccaataatcttttaaataacttttttaataacagtagttctaaagtgtctactgtaagctaagaaatttaaagctgtccatttgaagtccagtggagaaaataaaaatgttagacaacaggtagcacttgcttattactgaaaaatgtctcttgaaggaataattaattatggaaatgttctgggaattcagagaatgatcattaaggcattgtttacccatgactaagaattaattatcttctagatttccctgtaacttcataaatgtctttgacattggtgaattgaatgattagagttcacatattttgggttttaaagtcataatgtctaaaacttcatagatcccatagttccgatagtatcaaatcccttctcaagagaaagttatatcattttttatcctgccaagctctagaaagtaatattgctaattttttttaggacaggggtaaaacctgtttagtatgaagcataattcttcagcttaatttcttccaatcctgagggaagtacaaaagaaaagtgatttctatataactggagttgtgaaaatgcaacactactttattaaaattttactaacaatatcctaaatagtcacagggtggaaatattgctctatccaagatgcttctatgttgggcctgcctttttctacaagcatatttctttcttttgttatatttttaaatgcctataaagtatatacttgactccatcacaagatggagtttcctctttataatattcttcttacttgagattttaagtttaacaatgttatgtcgctggcactaatgctctgtcttatatttaaaattttcagtttcaaatttggtcttaatgcttattttgctacctttttcctttcttctttgctcactgtcttgcctatgtttccttctccactttggctcccaacttaactagaggattttattcctaccacaggtctgtatcttttaaggtttgtttcttgttaaaaaaaaaatttttttttccaacatcacaaaaagcatataagaataattcaaaaaatacttatgtattgatcattcttgttaaattattaagttttaattatatgtacataattatgtatacaattacatgtgtgttgtatagtttcttgatagtttttaaattcttaataaatttttaaattatatatatacataattatgtgtataattatatattatgtgtatcttgtgtaaagttttcttgacaattgttaaagttccttcctcttctctagtgcaaaggcctttttaagattttgtttcagggaatgaaggttgtgggaatacttgcctttaaagatatacactaaatatagttggccattgtttctaagccattttcagacaaccaatcagtgtctaccacatacaagggttacccttttttaattcctaggctgggtcacatgtcagtgttgaatgacgtggttcagacgtgatgttcttctgcctgtccacacataactcggtgtacaggctctgatatttgagatcctggcaagcttgcacctcctaaatttgaatttgcctagtgaggtggctcagtttctcttttccatgattaaaaaaaggaggagtggtattttaagagcaattccattcaagctgagtatccaggctgttagattgctcttctacgtgttcaaaaagtcagaattctcttaagtattagaattttttctatgctaaaaagccaaaagcccatgggcacaagaaaacaaaatagaagggagttttgtatcttaagacagaagagaatggcctcttaatcctcactactgcccagcaaagaggaaatataatatattcgggctgatattgaggcccaagacttaaaaagatttaatattataccttttctttttaatttcctaactattgtctcacccccaccccatcctcttttctctggtttgtttctgatatagccactgaatagcatcgaagtggttataaataaactgatttggcatagtcattctaccactgactggtgaaacgttgagcctgacactttaggaagtgtaaatgatctcatggcagaaataaagattagacttggtttccaactgggcagagaagagattttgtgaggaaaagtgctgatattctttgtatgtttcagtacacaaaataactttatgacatctgtaagttagagccacttacttctagaggtaccttcttagttctaggagatttaactttgggattccttgtgccttgaattaaagtctttattttacaaaaagtagaatatgtaagagaggacagtcttctgtgtctgagcatctccaaaatgcatggatataaatgtctcttagacttaatagtcgccttcctacttaaaagggaaaggaagctttaaaaaatgaagttacgtaattatgatagtgttcttataataatgtagggacaataaataaaaatttatttgaataaaaatgaaggatttaaaagccacctgaatctcattagaaggaatgaatctttcttgaagtagtcatactataccctaggatagtcctaaactatcaaagcataaaagttcataaaaacgtgttagacattagtttctcattttaacccataacacgcccttcctcccatttttccttattcagatagaattcatataacatataattcaccattttagtcattttaaagtttacaatggagtagttactattgtaatcacagtgttgtaccaacatcaccactatctaattcccaaacatcatcacaccagaaaaaaacccgtgtcctttaacagtcactctctaatcccctcttcctccccaacacctgctaaactacattcagtctctatggatttgctattctagacatttcatataaatggaatcatacaaaatcagcattttgtgtgtgacgtcttttacttagcataatatcgaggttcatccatgttatagcatgtgtcagtacttactcctttttatgactgaataatatgccattgtgtggatagaccacattttgtttattcattcatcagttgatggacatttgagctgtttccattttttgacatgaataaagctgctgtgaacatttgtgtataagttcttgtttaacataggtttttaattctcctgggagtgtaggaacagaattcgattcctaagaatagaattgctgggtcatataattgtttaactttctgaggaaacttccccccacttttaatgctatgtaaagtgcctggcttagacttttactgtcgtcattgataccttgttaacgtattccaaaatgtttttctaatgggtctctttcttttttctctgaaaccctatagataaatgcaaaaatgtgcatatattctattggtgggtatttagggggttttttgaaacttattttaacccttggtgtacacatttaggttctcctaggtattataatacagaaactgagaaaggaccaatatcatgaaattaaaaagctataggcaataagcagggtgaatcaatggaagacaataatgtatttctaccagggatgctcagtaggacttgaggatttcctctcccttctaatttgctgctaccagacctgtttggaccttgggtgaagagaaacttaatcgactggggccatcccaaacagaggaggaaaggaaaatttctgtgactactgggatagttagagacgatcttcaaagtcttttctaaaatatgttacattgtgaaagaatgaattatctctgtgccattgtaggagtaggcagtaagtgagattcctgtagatgtggaaaaagcttcctttctgataaattttaattaactctgcaagacaagttagactctgctctttgtcttcttttgcttttttaattattgcatatgtaccatttaagccaagagaggagtattaatgattgagttgaataaccttatcagtcagtgtgtcagatctcttaaccataatctgggggaatctattaagtttacttagtcattctcacaaataatcattccagagtcacctccactttcttcatacaaatgagccatgattcagagcctcaggaaaatgaaaagagaataacttctctcagccccaacctccttgctcttttgaaacacacatgctaataatagttatgtgtgtttgtactcgttattgtgctgattaattcccatggcctatgaaagagattgacatctcttgaatgagtcagctgtatgatgctgtcaaatgtacataactggtggcatctgatgatggaaaaatatgattcttagtcacatgtacaggacagtacaatgtgacccttctttctgcattaaaatatattaaaatgcgagtgacacttacttgaaaattcaaaacttctctcagaaaattaactgaaatatagttttagaggaaaaaaatgtttttcagaaaggataccaaagtgccatgtaaaatatagtttataccccttcagaatgaaggttatccaactcaaaatgaaggagtataactttgggttttgtaaaagttagtgaccagctctgttgggacaagaggacggtcttcttttggaaggaagaccatcatcttgtccgaagagagctggtagcatgtttcagaaatcttcaggtttcacagttaatttagtgttcctagaagtagctgactagggatctgaagatatatatgctgtgtaaaaacaggactgagttgtcgagttgactacttaaggatggataacatccttccagaaagtttaccacctaaggaataagggacaatgccagtcttgaattttagtcaaaatatatatggctaggttgtcctgatatgaaataaggactatccttgtgtgtaagctcatgttatttacttattttgactgttttcattgtgttttctcagattagtaacagaaatatttcattgcccattggaaatctgttgttttttttttcctaactatagctaggcaggtctagtggcctttggtaacaatcctaaagctctctaagacacacttctgaattcaaaggcctctatctgggaaatctaatattgctttgctgacttgtttgtttttgattggactaggtctccacaccctggcaacctcctactgtgctcctgggtcattctcaagaggtcacgtctgtgtgctggtgtccatctgacttcacaaaggtttgtaaatgaatctctatagttggtttaaaatgtagatcacaggtttgtaggtttttctaaggtttgttttgagaatgatataaatttttatgtttaagttgagattttaaagacctaaaggccatccaggatctatattcacattactcaggcatattctgcttttctctacccataccataatggtattatgccctgtgaaataaggatagatttctggttccctacagttatttctttcctaaatgtaggattaagttgttaacttaattaaaattttctattaaaatctaagataaaaatacaatctaaggtgagaactagtcttttttactttttagatattatcaatgtagtatattaaaggtaacatcttgacagcccaatttgggttttcacatatggctaacaaaatggtaactgtgaagtcttaacatgttaggttatctattgcttaaactatgtaagtaggtctgaaatgttttagatactccagaaagaagacaatatgcccaccttttaatttttttatagtgacactttaagaaacaaaaaaaccctaaaatgtagaaaggccagaaacattaaaaactatgtatctattggaattgcatataatagtagctcaagttccagtcattctcccaaaccccattgcctctggtctttgagttattctgggttctacaggaaatcttatttctgtggaggtctcccctttcacgtatgacgttttgaggttttgttgcctattgttcccatctgttttttatcttccagaaacttctcatggtctggtctatttgtggcatccctgctagcttccagtattgctgtggatttctccttattgttaccatttctgtgctcaacttcatggcagaccttttctttttttttaagtcattactttaatcacccaaaattacatattaatgatattttttcctctgagattccatgtaatttcttttaacatggagggttgcatcttcatgggacttactaagttgaatgatttttgaattattcagttaattatgttatctttttttcaattgtcatatattatccttacccctatgcatctcaaacatcatatattaattatccttatttcctgtgctcaaaggaaatagcagggctgtttacctatactaatttattggctacttttttaagtcttaaaaataatttcatcccaagcctagaattaggaaagtaaaatatggtttgtgttgtttttgtgtttttaatgtctggcatttggaataggagaaagctgggtttaaattctagctcttccatttgattgtggttactttgggcaaataactttattcccattttgcatatgagattatttgagtacaaagcttttagagtgtgagaattaaataagataaagaatgtaaactaccagacacatagtaggtgctctgcaaataactattgttaataaactatagaagaactgtgagattccaaacatttcatattgaacagttaaatatgtgtatcttcttttggcctcccagtaaggaaaggaaaaagctgccagtctcttgggggccaagacttaagagaacatgtattctttttttctttctctttagtgactgaaatagagaaattatataaacaaatgctggggaacagctctggtaccagtggccatttgccacaagctcttcaagctggactttctctgccataaaaggcttgggaccaagatctagaatagtcagatatttttaaagggacaaaggttattttttaacttctttcagcctagggaacttgttgttttcccagattgctcctctacctatctgaaaaagaatctcaaaaggaatggtttccttctacttgtcacagcctactagagtcatgggccaagtctgatcttgcaaatggtgccattactttagcaatgtggcacaacatgcagaattcagaagaaagttgtagaaattgaatgttggtaacatatactgattgatcatttaacagaagagtaaaaagagtgtcttaactacatattttgtatttatacagaagatgataaagagccagaactttagattagataagaaatgaccagtaacaaaagacatactagtagaatgtatatgaagaataaactaaagagtcagctttgttggaaatctggaatgattcctgaaagcaagaaatggatgtacatgatctttaagatattattttctatatcctgtttattagacaaaataattatccagtcacaaggccttaagacacacctgttttttaatgtattttgaatcttgattgaaatttcttaattcccttcttggtactccctcttagattgctacctgttctgatgacaatacactaaaaatctggcgcttgaatagaggcttagaggagaaaccaggaggtgataaactttccacggtgggttgggcctctcagaagaaaaaagagtcaagacctggcctaggtaaggatatcatatactttccaagttttttatggtttgactagtttagtccgacagtacagagtaataagctagatttgatcttgctttggtatgtttttaaagaaaagcactatcttcttgccattcattctttttgataagtatttcccaagcactactatgtttatcatttacacaaggtactacagtggtggatttattcaacaaatatttcttgaacacccagtatgtgctgggccctgttcttagttgctagggattcagcaatgaacaaaagaataaaaaatcctgaagatgtaaatagagctaacatattagtgtgagaggcaataaacaagataaaaaagtaaaatatatactgtgtcaaataacaataagggcttaggaataaaggaaataggaaagggagaagggcaagggtgaaatatgctatcaaaattttatattaggtgaccaggggggcctcaatgaaaagatggcatttgagtaaagaaagtgaagtagtaagccatatagatattttaaagaagaatattccaggcagataaaagtacacaggccctaaagcaggagcatgcttggcatattttctcttcctcagagaggctagcatggctggcccctagggctgcagcaggcaaaggaaagggagggaatagtagtagaaaatgaaattctgtgagactttggcttttattttgatagacaaaagtccaccagagggtttggagcagaagagtatcataatttgacttttaacttgatcattcttgctcctgtgttgaggataaattgtaagggggtcagggtaaaagcaaaaagctacttttaaaaagccattgagataatccaggaagtgatgatggtgacttagaccagagtagtagcagaagctatggtgagaagtcatccaattttggatatatttacaagacagagccaacagaatatgttgagggatcagatgtggggctatatgggagagttatcaaggataacttcagagattttgcttaagaagctgaaaagatggagtgtcattaacctagataaatatccctgcaggaagagcaagtttgggagggaacagctggagttccatttggacatgttgtttgatatgattattaaacacccaaatggacatgtcagggaggcatttcgatgtttaattctgcagttcagggttgaagttgcagatgtgaggttcattatcacacagggtgaagatagctatagatagaaaaaaataggcctggtgtcttggggtaccccgatgtttagaggttgaggaggtgacaaataccattaaagcctactgagcagccacaaccagagaagtaagagaaaaactgggagagtgttacatcctggaagccaagtaaataagaggagagagggatgaacttgatttgatgtttctggtataccaaataaggtgaggcctaaaaactgaccaatggattaggcaatcataggggttatttggtgaccttaatgagtgttgttttggtggtatgatggtggcctgattggtgtcattcatgtatatgacttggggactacaagtatagacagttctttcaaggagttttgttataaaggaaagaagagaagtgaagtggtagctggagaaagaagcagggttgaagtttgctggggtttttttaaataggaatataacatttcacagtgattggcaggatcgtatagagagggggagattgatgcaggggaatttgctggagcaatgttaagcatgaggggatactatctgatacacagtaggagggtaggcctttgccaggaacatggatagttgacccatagtaattggagaaaaggtggaatatataagcatggtgcaggtaggctactgagagatggtggggagagaggtggagagatgagatggccataacttacagaagcttccttctgttctgatgttaaaacatgaatcagggttattaactgcgaatgaggataagggagaaagggagtagagattttagaagagataagaaagtctgaaattgtcactgagagaatagaggaataaatggacaggaaaatatgattgttgggcttcaagagtcaacttgaggctagcaataattaattgaaagtgagcactccacatggttgtgtgtttgctatgcaagtacaagtatactataggtagagagctagatttaaccagggatgtggtttagcaatgcaagtgaagaaggaagttgacagtggatgcaaagaggatgattatgactataagatataaccttggtaaggaggcatattagtccattttcacactgctgataaagacatgtacaagacttggcaatttacaaaagaaagaggtttaatgacttacagttccacatgactggaaaggcctcacaatcatggcagaaggcaaggaggagcaagtcacattttacatggatggcggcaggcaaagagagagattgggcagagaaactcccccttataatattgtcagatctcatgagacttatttgctgtcacgagaacagcatgggaaagacctgcccccattattcaattacctcccaccaggtccctcccacaacacatgggaattcaagatgagattcaggtggggacacagccaaaccatatcaggagggaagtaaggacataatggggccaagggatagtgtaaatgtggtactagcagtggattgaggataaaagattgttggaattgaaatactaaagggagatgggaaaataagtggtgatgagtgggatgattgaaattaagataatggaagatttccaggtattggtaataataaggtaaagaataagtggcttaggagagtgaaaggacaagattatagaagaaggaggtcaaaaaactgagaaaccaaggtattggaaagatcatgtacatagattttttaatcaccataaattgacagataatgttgaagagagtaacaatgaaccaagagcaaaaatcttcaagcaatgagccacccacagtgtggatcctcagggtatcattagatgtgctgtatacttgtacttacatggtaaacacacaaccttgtggaatgctcactttcaattaattactgctagcctcaagttgactcttactggccaacaatcatatttccctgtccatttactcttatattctctcagtgactgtttcaaactgtcttatctttaagcttgagttttaagcttaaagattcattttacttcagccatcaaggcctaaggttaatggggaattgaaggtgagaaagggaaaatatacaggttcatttttctaaggacttatttagttgcttataagatgcagaactagacttcagaggagtcttttgctctaagtctggtttctgtagtctttgatggtgctgccttatttgtttttgctctttgctttttttaatttctttttttcttttctttttttttttttgagacaaagtctcactcttgtcgctgagcctggagtgcagtggcatgatctcagctcacttattcaagcaattctcctgcctcagcctcctgagtagctggaattacaggcgtgtgccaccatgcccagctaatttttgtatttttagtagagatggggtttcaccatgttggtcaggctggtctcgaactcctgacctcaggtgatccacccgcctcagcctcccaaagtgctgggattacaggcgtgagccaccgtgcccagccctaaaaattttttttcattaatttagtattacagtttaataagtcagctagttctacaacagtgaataagataaatagcagtccacagaccctctgcctcatagtttccctttcccagaggcaacctctttcaaatccttttgctgattctttgatatgtatgtctagacctctaaatagttttgtgcatttctatttattttttgcaattttcagctttattaacttctttcctttgtaacatgaggatttaactccctttcctgtgtcccaccactatcaaaccttcatactcctcatcctcctaacacagggtcatgattttggttaaatcaagatacagctcagttccttttagtatgcagttgtccctcaggatccatgggggattggatccaggaacccccaacagataccaaagtccacagaagctcagattcattatctatgatgtagtatttgcctataacctatgtacattttcccatatacttttatcatctctagattacttaaaatacctggtacagtataaatggtatattaatagttgttgtactatatcatttagggaataatgacaggaaagaaaagtctgcacatgtttagtacagacacaaccatcttttttcgtgtttttgttttaatattttcaatttgtagtcaactgaatgcatggctgtggaacccagtatacagaactcaagatatagagagtcaactatatttagagttatgtagtcattaatacaatctaattctagaatatcttcaacacctaaaatgagggttccaatttctcttatgttcttgtcaacatttgttattgtccatctttttcattatacccatcctagcaggtgtgaattagtgtcccattgtggttttgatttatattttcctgatggccagtgatgctgaacatcttttcatgtgcttattggccatttatatattttccttggtgaaatgtctatgcagatcttctgcccatattctaattgggttatttgtctttttattgttgagttgtaagcattctttatatattctggacataagtcccttatcatgtaatgatttgcaatgatttattctgtgggttgtgtttttactttcttgatggtgtctcttgacacatgtaactttataattttgatgaagttcagtttatctgttttttcctttgtcacttatgcttttgatgttaaatcaaagaaactattgcctcttctgaggtaacaaggatttactccaatgctttcttctagttttttagtttaggcctgtgattcgttttgagtttatttttgtgttatggtgtgagttaggcattcaaattttttacatatggatatttaactttctcaccatcacttgttaaagagactattctttagcccattgaatcgtcatggcacccttggtaaaaatctgccaaaaatcaattgaccataaatgtgagggtttatttctgacttctcaattccattgatctatgtatctgtccttattatggttctgcattgtcttcattactgtagctttgtagtaggttttgaaatcctacttctgttttcttcttttatttcaagattgtctcgactgttctgggtctcttttatacaaattttagtttcagcttgtcattgtttgcaaaatagccagctaggattttgataggaattgcagtgactgtgtagatcagttatggaagtattgacatcgtaataatgttaaatcttctggtccatgaacttggatgtctttctattgcctgtcgttatatgtacttttctctctctcattttagaaaatataaaagaaaagaatcatatgaggccattagagaatactgattttaaaaaaaagtcatcagtattccctccactttgacataattttaaatgacatttccagttattttttgaggtttttcccttatacatagagattctttttaacagaaccatagttgtactgaatacgcatttgatttctctcaagccatcctaccacttcagcctcccaatagctgggactacaggcatgcaccaccacgcctggataatttttgtattttttgtagagatggggtttcgccatgttgcccaggctgggctcaactatgagctcaagcaatccacccacctcagtctcccaaagtgctgggattacaggcatgagccactgcacccagccttaagtactttctatgttatcttttttgcaacactatttcaaatactacacttgagtaaatgttccataatttacctagctattctactgtagtttaaacatttgtttcaaatattttaaaacttggggttttttcctccctgaatttagggtcccccttcccattaaaataagattcccaaaggtggaattcttgtgttaatgactataccatttcttaaaatttgtgatgaaaagtatcttgcttttaactatgtacttttagtgtgccattaattatccttagtattagaagccaagtcaccaaaaaagttacatattgaccaaatgtgagttgtaataataacaacgtttagccactattgactcctagcataattattctaaggacctacttggattatctcatttaattatgaaaacaactgaaactgaaggtcaaggaagttagacttgcttaaaatctcatagctatgaagttgtagaaccagagtctataattgaacccttgcagtctgattctagaacacatgctcagaaccactctgcagcactgccttctttagaacctaacagagcaggctgggtgcggtggctcacgcctgtaatcccagcactttgggaggccgagtgggtggatcacgaggtcaggagatcgagaccatcctggctaacatggtgaaaccccgtctctactaaaaatacaaaaaaaattagccgggcatggtggcacacgcctgtagtcccagctactcgggaggctgaggcaggagaatggcgtgaacccgggaggcggagcttgcagtgagtggagatcacgccactgcactccagcctgagcgacagatcaaaactctgtctcaaaaaaaaaaaagaacctagcagagcaaggcaaaagttcaggttaagatcagagtaagagttatgcctagattactccatttctgggtgatgctagggttactctgaagagcactacgaagcaacaacctgacacgggttttcaaaggctggcacactgaccattcgactctctaagccagcttccagccacagatttgctgcttctaatcacattgccatcttgaaaatcatgttcccctgctttcccaagcttctaattgccacgccaacctttcattgctgtcctgggctgcttatcttcacttctggccctggcttgtaaaccccctcagttaacacattaattggaagggtttaagtgctaagacatagcctctttttctcctgccctacctttcccagccggcacctgcttcattgcttaccactctttccctatgttttagccagagatctcatagcactgttgaaaccaatagtcctcaatcttggctatgcatcatagctacttggggagcttttcaagtccgtgtatccccagtgattgattcaatgggactggacctgtatttttacaaagctccaaggaggtctgttatgtagcgaggattgagaacctctggtttaggcattattgagtgataaagttgattatccttatcctaaagagaaggaaaccctacctattctgcctcagttgcttgctgcagtctcacaagtcagcaggataattatagagtcaattttctgatccctagaacctcacctgtatccttgtcagcagtaatgaaacttaacaaacattgtttaataattccttactacgcactataggggcactgggcctaaagatgagtaaaccattattagctgccctcgaggctcacagtctagtctaggaggcagattcaaaaactatagcacacagccattagctgtgtaaacaaggggctctgagaacctacttcccctgtgagaggagagctctgtgggagaagaggaaagaagttgtgaattcttcacagtggagttaacattgtcatcagagccttgaaacatgagaagaatttctgcctggcaaaggaggagctgacttggcaagaaaaccacatgaacaaagaaatgtgacagtacacagcttgttcaggaagcaactagtagtgtcctgtaacgtgatcctagaatagcaaagtacatgataagactgaaaaggcaggctgaggccagatggcaaactcatatagaaagaagctggctgggcacggtggctcacgcctgtaatcccaatactttgggaggccgaggcaggcgcatcacctgaggtcaggagttcgggactagtcttgccaacatggcaaaaccccatctctactaaaaatacaaaattagctaggcatggtggcacacgcctgtaatcccagctactcgggaggctgaggcaggagaattgtttgaatccaggaggcaaaggttgcagtgagccgagatcatgccactgcactccagcctgggcgacaagacaagactccgtctcaaaaaacaaagaaagaagctgcaaactgttagtagactctgtataattcttcgaaggaactgactttaggaagcatttagggcaataactcagtctatgctaccatgtcatcaaatctcatatattgcttaaggtcaataaggagttagtccacttaagtagatgaagtactaaagaaaatggcatgccatatttaaatgtgtaggcccatataatggcatgctatgcacctgttaaaaataatgcaatgcatctatgtgtacttacatgaagagacgtaaaaataaaagagcaaatggcagaacatgtacagatatatatatagtataatccatttgtattttggggttttttaaggtctgatacatatatacctttgtatgtgctaaataggcacagagaaaattgcggaatgcacaagaatgtaaaagtgaaatgaaaaagttgaaaagaggatcctgtttccaccctcttcccctctgtactggttgaatttttttaccattaactttcatactgttataatgtagttactgtttaaaaaacatatacacacacttaaatttgacccagcatttgctaaccttcaaagctaacaaaatttctttgacccccatggaccacttcctctttcaccatgacatcctgaaggaagaggaaatgccccaactttccaacacatcaatttcataccagccttatcagtaaatactccagtgtgtgccatgcaagtttcagaaacctagatacctggtttgtccctgtcccagctcttccttcttccccaatcctgccttgttaatcggcatattataggactcataaaattttaggactttctgccctaaatgtacactttgacccacttaaatggaacagatgactgtggcagctgtgcagtgactattaacctgcaccgaggagtgcagcaaatgaaaacttccttttctgctgaaaaaaatagctgttatcaagctctagagcgttagtgtgagaaccataaccagaggtttcatgaataggtccctgttactaagtccttttcatggcatcttatgacaaaatggggtttttcagtaattatccttattaaaagagcagtatcattttggctggttctaaacatatggttgatgagaaaagtttaggcaaaagtcaatttgtagaatttctctctctcaaggcaagactgctttaggagtgaaaaacacagggtaaaaaaaggacaggataattaactgactaaagtgagtacttgccaatctttatttatgctaaaagagagattgcatttttatatcagcccatcctaaattcagctggatataaatgcaattaggtaattaaactgaattaaaaattatagttaacaattcaaaggctttgtgactgagaataaataaatacccttgttatttgaagacaggaatgctatttcagcaatctagaaagctcagaaggaaattgagaaagtgttgtctgtggtagggcccgagagggaagaagcatgaagttcataaaaatttgcctgaagtacttgccattgtatgtaaacaaagggacaggtacacatacagaagtcctatttactaagtttgatttgatttacagagagcaagcactgagattctgaatgttttttgccttgtggaaaatagtagtcatttgtaaaataaagtgggaagccatgtgaggcctgataaccttaacaaataattgattgaatggcttcttgtgaaaagaaaaactatctcctttaacagatatagaatctgagtccaaagagataaagggttatgcccaagtcacatagtaagtgattgtgccaggttttagatctgtgcattcctgtttgagagcccctgtgcagtgcctttctgccctagcattgctcaacagtttatataagaatgctaatggcagcgttaaatgtgttgtagaatacctataccttagaatacattgtagctattaaaaatgataaatctgtattaatgtgggaaatgttcacaatatattaagaagcaggttattcctaattttaaaatggacaaagggcctgaatagacatttctcaaaagaagacatacaaatgcccaacaggtatatgaaaaactgctcagcatcaccaatcatcagggaaatgtaaatcaaaaccacaatgagatatcccctcacacctgttaggatagcttttatcaaaaagacaaaatgtaacaagtattggtaaggatgtggagaaaagggaacccttgtacactggtgggaatgtaaattagtatagccattaaggaaaacagaatggcagtttctcaaaaaattgaaaatagaactaccatatgatccagcaatttcacttttgggtatatatcaaaaaaagtgatcgcagtatgtggaagcgatacctgcactccaatgttcactgcagcactattcacgatagccaagatatggaatcacctaagtattcatcagataaagacaatatgatgtatatacacaatggactactattcagccttgaaaaagaagaaagttaatgtcatttgcaacaacagggatgaacctgaaagacattatgctaggagaaataagccagacagagaaagacaaatactgcatgatctcacttgtggaatcttaaaaagttgaactcataggagcagagagtagaataacgtactatgtacttgaaaattgctgagtagattttaaatgttcttaccacaaaaatatatgaagtgatgttagttggcttgatttaatcattctacaatgtatgcatgtatcaaaacatcacattatagcctatatacacaataaaaataaatttgcttgagataaaatattacgaaatagtatatatatagtgatctctccttttttaaaaaatttcaatagttttgggggaaccagtgatgtttgattacatggataggtactttagtggtgatttctgaaatttggtgcacccatcacccaagtggtgtacgctgtaaccaatgtgtagtcttttatcccttacctccctcccaccttgagtccccaaagtccattgtatcattcttatgcctttgcgtcctcatagcttagctcccacttataagtgagaacatacgatgtttggttccattcttgagctacttcacttagaataatggtctccaggccaggcgcagtggctcatgcctgtaatcctagcactttgggaggccaaggcaggtggatcacctgaggtcaggaattcaagaccagcctggccaacatagtaaaacccccctctactaaaaatacaaaacttaggtgtggtggtgcatgcctgtagtcccagctacttgggaggctgagtcaggagaattgcttgaacctgggagatggaggttgaggttgtagcaagccaagatcgtgccactgcactccagcctgggtgacagagcgagactccgtctaaaaaaaaaaaaagataatggtctccaactccatcctggttcctgcaaatgccattatttcaattccattttatggctaagtagtattccctggtatatatatacaccacgttttctttatccacttgttgattgaagggcatttgggctggttccacatttttgcagttgcaaattatgttgctataaacatgcatgggcaagtgtttttttcatataataactttttttcctctgggtagatacccagtagtgggattgctggatcaaatggtagatctacttttagttctttacagaatctctgtactgttttccatagtggttgtactagtttacattcccaccagcagtgtaaaagtgttccctttccaccacatccaccccaatgatggccattcttgcaggagtaaggtggtattgcattgtggtttttatttacatttccctgattattagtgatgttgagcattttttcataagtttgatggccctgtgtatatcttttttttgagaattgtctattcatgtccttagcccactttttgatgggattatttggttttttttccttgctgattttaaaactggaaaagttcccttgtcccccttgcagggcgtgcgatgagggtgtggcttccttcttcaatgccccggtgctcagacctctacgggagcatacagatgggcaggctgtagggctccgaccccacagcagtgtctgggggtgaatgtttatagctcctgaagccccagtgggcgtgtgttacagtgtgctcttttagttttgctgtctataggcggcttgtgttaaccagctctattagacccctgccttatcgcaaggacagagggctttctgtatcccggggttcttgccttggtgtaccagaagactcggatcacatgtgggcttggagaatttgagtgcaaggttccactgagcagaagtagctttccgcggatgggggagccagaagggaaatggctttcccctggagttgggcccttggcggccccagttctcctccgactgccccgaccaaactgcatcattccaccggttgatgccctgctggcctgccggcctgcctatgcctgtcagtgtgctcttctgccagcgtgcttctcaacgtctgcttgacgaccagccacttgtgtctttctctgcccatgtgttcctcacaacatccagccaccatgtgttcctgctagggtcttgggggtttttataggcacaggatgggggcgtggcaggccaaggtggtcttgggaaatgcaacatttgggcaggaaatgcctgtcctcacctaggtctgtggggatggagccctagccagggatcacaccttcttctgcccaacacttcccttcccccattccgtatcatttaaagggaccatgctcttcccttcccagcactcccgtatcaatttttttgagttccttgtagattctggataatagtcctttgttggttgcatagattgtgaagactttctcccactctgtgggttctttgtttactttgctgattatttcttttgctgtgcagaagctttttcgtttaattaagtcccatctatttatctttgtttttcttgcatttgcttttgggttctttgtcatgaactctttgcctaggccatgtctagatgagtttttcccatgttatcttctagagtttttatggtttcaggtcttagatgtaagtctttggtccatctggagttgatttttgtataaggtgagagatgaggatccagtttcattctcctacatgaggcttgccagttatcccagcaccatgtgttgaatagggtgtcctttccccacctcatgtttttgtttgctttgttgaagattatttgtctgtaagtatttagttttatttctgggttctctgttctattgcattggtctatgtgcctatttttatacgagtaccgtgctatttgagtgactatagccttgtagtgtagtttgaagtcaggtaatgtgatgcctgcagatttgttctttttgcttagtcttgctttggctatgtgggctgttttttggttccatatgacttttcagattgttttttctagttctgtgaagaacgatgatggtattttgatgggaattgcattgaatttgtagattgcttttagcagtatagttattttcacagcattgattctacccatccttgagcgtaggttgtgtttttccatttgtttgtgtcatctgatttcttttagcagtgttttgtagttttccttgtagaggtcttttacttccttagttaggtatattcctaggttttgcagctattgtaaaaggggttgagttgttgatttgatttgcagcttgtttgctgttgctgtatagcagtactactgatttatgtacattgattttgtatcctgaaacctaacagaattcatttatcagatctaggagctttttggatgagtttttagggttttctaggtatacaatcatatcatttactaacagtgacaggttgacttcctctttaccaatttggatgccttttaatttctcttttctgactgactgtggctggctagggcttccactactatgttgaatagaagtggtgaaagtgggcatccttgtctttttccagttctcatggggaatgctttcaacttttccccgttcagtataacgttggctgtgggtttgtcatggatggcttttattaccttcaagtatgttccttctatgctgattttgctgagtgttttcatcataaagggatgctggattttgtcagacgttttttctgcttctattgaagtgatcatgtgttttcgtttgtttttctcttagagtttcgctcttgttgcccaggctggggtgcagtggtaccatctcagctcactgcaacctccaccacccaggttcaagggattctcctgcctcagcctcccaagtagctgagataccacatctggctaatttttgtatttttagatggggtttcaccatgttggccaggctggtctcaaactcctgacctcaagtgatctgccctcctcggcctcccaaagtgctgggattacaggcatgagccaccgcacccggcctgatttttgtttttaattctgtttatatggtgtatcacatgtattgacttgtgtatattaaactttccctgcatccctggtttgaaatccatttgatcatggtagattatctttttgatatactgttggatttggttagctagtattttgttgaggatttttgcatctatgttcatcagggatattggtctgtagttttcttttttgtcatgtcctttcctggttttggtattagagtgatactggcttcataggatgatttagggagtattccctctttctcttttggaatggtttcagtaagattggtaccagttcttctttgaatgtctgatagaattcagcagtgaatccatctggtcctggactttttcttcttggcaatttttttattaccatttcaatctaagtgcttgttattggtctgttcagagttcttatttcttcctggtttaatctaggaggttgtatatttccaggaatttatccatctcctctaggttttctagtttgtgagcacaaatgtgttcatagtagccttgaatgatcttttgtatttctgtggtattcgttgttaatatttcctgtttcatttctaattgaacttatttggatcttctctcttcttttcttggttaatctcactaatgggctatcaattttgtttatcttttcaaagaaccagctttttgtttcatttatcttttgtattttgttgttgttgtttcatttttattaagttctactctggtctttgttatatctttcctcctcctgggtttgggtttggtttgttcttatttctctagttcttgaggtgtgaccttagattgtcaatttgtgctctttcagactttttgatgtaggcacttaatgctgtgaactttcctcttagcactgcttttgctgtatcttagaggttttgttaggttgtgtcacttttttcattcagttcaaagaatttttttaatttccagcttgattttgatttcattattgacccaaagatcattcaggagcggattatttaatgttgcatggttctaagaattccctttggagttgacttccaattttattccactatggtctgagagagtacttgatataattttgattttcttaaatttattgagacttgttttgtggcctatcatatggtctctatcttggagaatgttccatgaatgttctgatgaatagaatgtatattctgcagttgttgggtagaatgttctgtaaatacctgttaagtccatttgttctagggtataagtccattgtttctatgttgacttactgtattgaagtcccccactatgagatgagattctatttttgtgtatttcaaggttttgctctaagatttagaactccttttagcagtttttgtaaactatgctggcttggtagtggcaaattctctcagcgtttgaaaaagactttcatcttttcttcatttatgaagcttagtttcactggatacaaaattcttggctgataattattttgtcagctaataattatttaataaggctaaagataagacctttatcccctctagcttgtagagtatctgctgttaatctgataggtttttcctttacaggttacctgatgcttttgcctcccagctcttaagattttttccttcatcttgactttagatagcctgatgactgtgtgtctaggtgatgatctttttgtgatgaatttcctgggtgttctttgagcttcttgtatttggatgtctagatctcgagcaaggccagagaagtttttattcttttgcctttgtctttgttgaattgggttaattcaagagccttgtctttgagctccaaaattctttcttctacttgtttggttctattgttaaaactttccagtgtattttgcatttctctaaatgtgtctttcatttccagaagtcatgattgttttttatttatgatatctatttctctggagatttttttcgtctacatcctgttttgttttatttttaaatttaagttggttttcatctttctctggtgcttccttgagtagcttaataattgaccttctaaattcttttctggcaattcaaagatttattattggtttggatccattgctggtaagctagtataatcttttaggggtggttatagaaccttgttttgtcatattacctgaattgtttttctggttccttctcgtttgggtggactatgtcagaagaaagatctgggactcaatgtgtgctgtttaaattcttttgtcccacagagtgatcccttggtgtggtgctctcccccttccctaggggtggggctttctgagagctggactgcagtgattgttattgctcttctgggtcgagccacccagcagagctactgggttctaggctggtactggagagtgtctgctaagagtcctgtgatgtgatctgtcttcaggtctgtatgccatggatactagcacctgctctaatggaggtggtaggaaaggagtgaagtggactgtgtgagagtacttggttgtagttttatttagtgtactggttgtcttgaatgctagttatactagcactgaagttattacatggacagactcaggacctctctggttggccaagatgttacaggcagtagaattagctgttattttctgctttcttggagcagggttgttctgttgaattgctgtaatggcttgaattggttggcctccagccaggaggtggcactttcaagagagtatcaactgcagtagtatagcgggggatataagcttgccttacggtttcctggataggttttcgggcttctcaggcaatgagcagggccccacgagtttttgtcttttgtttacggctaccagggcggttagagaaagaccatctggtgggggcagggatagtgtgtctgagctcagactccttgggcagggcttgctgtggcctctgggcgatgggagtggtggttaacaggccaatggagttacgttctaagggagattatggctgcctctgctgcttcatacacatcaccagggaaataggggaaagccggcagtgacagaccacagccagcaaggccagtctcactcctgcagtgcttccccaacagccaacagaaccaaatttatatccatgcctccagtgcacagggtggagatcttgccctagactacaaaactccccgccgagaaagcaagcagggctgttaggccttgtccatctgcctgccacagcttctgtgctcatatctgcacttcctatttgtcccatccccctgcagattctgcccaggaaaattcacgctcagttgaaatcattacaaagttcagctgaaagtctccttctccctatggtccttccccaattccattggctgccctctccaaagacccctgtgagatagtcagaaatggtttccctggggaccaggagtgcctacagggctcttcctgctgctgcttctacttttatattttgtttggctctctaaattcatttcagttctccttctcccatgatctggatcctcagtgaggatgtgtgcagaagtggactttacccctctcacactgttttttgtttgtttgtttgtttgtttgtttgttttgaaacggagtctcgctgtcaggcaggctggagtgcagtgcatgcgatcttggctcactgcaacttccacctcccaggttcaagcaactcttctgcctcagcctcctgagtagctgggactacaggtgcacaccaccatgcctggctaatttttgtatttttagtagagacagggtttcaccatgttggccaggctagtgttgaactcctgacctcaagtgatccacccacctcggcctcccatagtgctgggattacaggcatgagccaccacacccagccaccctctcacactttggaccttgagagcttgtttggaggttctagcaggggagcacatttactcgtatacccttgactgaagaccgattctcctcttatcaggaatggttgtcctcttcgaccaagcacacagcttcgggagccctctcacactttgggcactcaatttttctgctgtcttgtggattttgcagcagcaagccacttctttcaaaggatctgttaattcttttgttttttctggtatgttcctgtgatagttcttggagccaaagttcactatgtgagtctccacatgctgttctgtctgtctgagtggcaaattagtcctgcctcctatctgccactttccccttaaatcagtctcatttttgtaaagaaaaaagttgagatgtatagtatgtatcacatgcacaaatatagaaagtatgctaaacatggtttacgtaagtgctttaaattttttctctttatgtttttcggtattttgtcgatttttacaagtatatattttataatgggatagttgggaggttggtgacttggaaaagagaaaggaaaatgataaaagggtgtggttggaatcaagtgatgtatacctacttactggcaaattgacccttagatgattaggttagctatgatttttcttgatgagaatttagggactttgtatggctttcacttctgatcttcatgatcctctcctctttttcagtaacagtaacgagtagccagagtactcctgccaaagcccccagggcaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagaaattgccaagcccggtaagtcagcagtggtgggaagatacatttcctaacttaaaaggggccagacacccagatgtctcaagtcaggatgcttttttttttttttaaagaaagaaatctatttattcctagtgctgccaaattcagcacataaatacaaaacaaattttgcatgggccatatttttagtaaaaatgttttatgctaagaaactatttttgtttgtctgaaattcaaatgtaactgaatgtgctgtattttatctggcaactctacttactcccattaaaatccctcctgtcagggtccatactcctcagccctgttgcctgattgaccaaagccttcatcatgctccaggatatcaattcaaaaatatctcccctctcctgttagacagtatgccatcctctttttatagataaagctgttgttcatgggaaagttgccaacatccataagtagatttccagtttgtaattccattttgtgattatttaaaatacagtgaaacttagatacttacaaaacaatttgagtgcaaaatctttctagatttttatgacttctccacaatcttttataatcattttgccacaccacagtaatacttttgacacctatatctattctttttaacattcagtgtagtgtcacttatctttttaggactcatttcattgactgacttaatatttaaattagataatatcagtcatcagtgattgatggcagaaataggtttgtgaaccttgaaaaacaagattcattacagtggtggaggcagaagtagctgagtgcattgggtgagctatgggcaccagtcagagagaataaaaagcttctgttgtttgcatgtgaaggggagatgggttaaggaagtttccactgtacttcacagtagctcttgtggtggcgggatgattgaaatagaatccagaatcatgatcagcatcatctgccattttaaagggcagaagctagataaccaaccttaggccagttttagtttaaaaagtgttcataaccccgacctgctctcatgaagacctatcccataattttagaaaaataaactgatagattttaaagacaacttagtacacaaactgcaatcaagaccttgctgtagaaagtggagaaaaaagacagttataaggaatctttccttctctcaaaattatgactgctctttatccctagccaaaatttctattttttttttcaagggagctggtctcagctatgtgttagcagaaaagtagtttcaatgaaaaactattttcactgatacataaatcttaaaatctttaaaaagtagaaacagtgtgctggtcttgtaatttatttgaagctaacatttcttaaaaattttttacctttatatgatgataatgtcaaccttcagaagagagtaacatcttccatttgaatacctatcttgtttataaattgggggggctgatttattcatttatttcaaaaaggatagtaattgtaacttatttgtttcttattaggagacttagctagtaaatgttttctattcacataagaagtctatgccttctttccctacatatcatctgttaagtttttactatagtcagtacaaatcagccaaaagagacattgccattgaaagtatttggagctgaaagcaggctaaacaatgaaatttctggcagcctaatttaaggtatgccttagtaataacttagtaacagttgaacttcaaggaaatctctgaaatctaaactttcttcttctaggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatccctgaggactgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctt

SEQ ID NO: 88 - DNA, 3343 bp, Homo sapiens
atggctctgaaggagcgcattggctggagatacagcctcctcttcgtgggcctactacagttaaacattgtcgtcttcggagcactgctcagacccatcatcatcagaggaccagcgtcaccaaaaatagtcatccaggaaaatcggaaagaagcacagtatatgcttgaaaatgagaaaacacgaacctcaatagactccattgactcaggagtagaactaactacctcacctaaaaatgtgcctactcacactaacccagaactggagccgaaggcagacctgcagcaggtcctggtgaagaccagccccaggccaagcaaaaagaaagccccgctattagacttctccattttgaaagagaaaagttttatttgttatgcattatttggtctccttgcgacactgtgattctttgcaccttccttgtacatcattcctctgggcattagtctgggcattgaccaggacagcgctgcttttttattatctacaatggccattgcagaagttttcaggaggatcggagctggttttgtcctcaacagagagcccattcgtgtgatttacattgagctcatctgcgtcatcttattgactgtgtctctgtttgcctttacttttgctagggaattctggggtctaatgtcatgtagcgtattttttgggtttatggttggaacaacaggagggacccacattccactgcttgctgaggatgatgttgtgggcattgagaagatgtcttctgcagctggggtctacatcttcattcagagcatagcaggactggctggaccaccccttgcgggtaatttaaatacacaaaatacaagcgcttgtctactttcccttatgaattgtgctagcttcctgttcaagccataaaaaaacttactgctgttttatatttccattgaattttagagctgccagggattagagattacttgagccagccctcttgatttaaatatgaggaaactggccaggcacggtggctcacgcctgtaatcccagcacttccggagatcaaaaccatcctgactaatacggtgaaaccccgtctctgctaaaaatacaaaaaattagctggcatgtgtggtggtgggcacctgtagacccagctactcgggaggctgaggcaggagaatggcgtgaacccaggaggtggagcttgcagtgagccgagatcatgccactgcactccagcctgggcgacaaagcgagactctgtctcaaaaataaataaataaataaataaataaataaataaataaggaaactgaaggccaaagaattgaaaccaaaggtcacatggtaaattagtggttgaatcaggactggaagctgtgtctgcagtccagaactgacccaggctttttttttttttttttttttgagacggagattcgctttgtcaccagactggagtgcagtggcccgatctcggctcactgcaacctcctcctcccgggttcacgccattctcctgcctcagccttccaagtagctgggactacaggcgcccaccaccacgcccggctaagttttgtatttttagtagagacggggtttcaccatgttggccaggatggtcttgatttcttgacctcatgatccgcccgccacggcttcccaaagtactgggattataggtgtgagccaccgtgcccggtcgacccaggctttttctgtcaccttgccttctctcatgctagacaggaacgcatggatttatcaccttcagagcccacctgacttttggaatgacagaaatatcggacttctgtaagtcatcttcccttcttaggaaaggtatttgggaatagaaagcagcactctgtaaatacctaattgatttgtatagaatgtttccttgtaagagggacataggtatgtttcatagcttagatcccaaatgggtctttaaagtgttgtgattagaaattgtaccccctgtcaaaagatacctacagtggccaggcgcagtggctaatgcctctaatcccaacactttgggaggatgaggcgggcagatcatttgaggtcaggagttccagaccagcctggtcaacatggcaaaaccccgtctctactaaaaatacgaaaagtagccgggcatggtggcaggcgcctgtaatcccagctattcgggaggctgagctgggagaatcgcttgaacctgggaggcggaggttgcagtgacccaagatcgtgccatcgcactccagctggggcgacaagaataaaactcagtctcaaaacaaacaaacaaacaaacaaacacctaaagtgaactcaagtgaaaataatacagttccttcctaccgaagaatattaccttttcaaagaagtatgcatcgaaatgtcccaggttttaggtcctctgctaggacaggcttagcccaagaagaacaagtatattgggtgtttgtctctttctcctctccagtctagtaaagatttctgcccttaacacccatttttctttagaaacacaaaagaaaacaaggaaggcaatgaaactgagaggcttctgaatgggatggtcgcctgggtgaggggcttatgtctaggaaggatgctgttaacggacgccatgctctcttccaggtttgttggtggaccaaagtaagatctacagcagggccttctactcctgcgcagctggcatggccctggctgctgtgtgcctcgccctggtgagaccgtgtaagatgggactgtgccagcatcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggagacacaaggaggtagaggagctaacccctctactccactttcaaaactacattttaaagggaatgtgtatgtgaagagcactaccaacatcgcttttgttttaagttttcctttttgcttgtttttaaagccaaaacaaaaaacaaccaagcactcttccatatataaatctggctgtattcagtagcaatacaaaagatatgtagaaagactctttggttcacattccaatattaaaatagtgacacgaactggcaaagtggttttaaaagctttcacatgggataaatgattttctttctttcttttctttcttcgtatggtcttgtcagaataaactactatcttgaataaaacaacatccaacccaggtcattgaaatgaaattggccagtcaaaaaaaaaaaaaaagac

SEQ ID NO: 89 - DNA, 8339 bp, Homo sapiens
cctccgagaacggtgtccatgacacagggcgggaagagataaggcctagggaaggcgcccctcgggcctatccacctcttctggggctcggcactaggaagcagcttccctctcaggcccctttgtctccaagccgttccaaactgagtaccgggagacgacacaaagggagggcggtgacggatggcgcaggcgcgggagccgcctaggctgctgggagtggtggtccggccgcggaatgggtaggtctcccgcgcactctgcggccgcagctcaaaggacaccgagagggtgccagtgcgcatgcgccgccacttccgcccgtgcccggccctccccttccttccgcctcccggaggacttgggtttctagtagtaagagtccggggggcattactcacggtctccccgcctcctcttcatcgtgattgggctgtcaaagtgatgttggcaagtagattggctactgcggttgccagttctgtttcgggccctacttatactgctctgtggggcggggacgaagagtcaggggctgaggagcgagttgcggtagttgctgtgtaccatggtctcggaggtttctgtcccgcggcccgttaggtcctggtcgggttttcagcgaagcaggccgctcccctgcgtttcccagcgggcgtgctgtgccgcccaacaggctctgcctccaagtgccaaaaactcctagtaaagtttgcgcctcgcccgccgtccacaccccagcggccctgacgctgtcccctccgcgaccctcgcctctggaaaaagtgacaggcaaggccacgcccccgcgagggccggcctggagcccgcagcccccagggcctgggacggtgaggggcgtgaatgcggcggggggcggggccgttgccgggggagggggccggggcgcatgcgcgctgcgcagcggggctgaatgtttcccaagtgtttgaaactggtatttgggttttccacgttggacaagtgcggctcggcggccagcggagcgcgccccttcccgctgcccgctccgctcctctcttctacccagcccagtgggcgagtgggcagcggcggccgcggcgctgggccctctcccgccggtgtgtgcgcgctcgtacgcgcggcccccggcgccagccccgccgcctgagagggggcctgcgccgccggccggggcgtgcgcccgggagccaccgccaccgcggcccgcgccctcaggcgctggggtccccgcggacccggaggcggcggacgggctcggcagatgtagccgccgggccgaagcaggagccggcgggggggcgccgggagagcgagggctttgcattttgcagtgctattttttgaggggggcggggggtggaggaagcggaaagccgcgccgagtcgccggggacctccggggtgaaccatgttgagtcctgccaacggggagcagctccacctggtgaactatgtggaggactacctggactccatcgagtccctgcctttcgacttgcagagaaatgtctcgctgatgcgggagatcgacgcgaaataccaaggtacggccgggtgatggatgggcgggggcggccgcctccttcccggcgggtccgggcgcgccgcggagccgggccggtcctgccgtggaccggaggaagcggccggctccgcagcggcggccctcggcaggggcaggaacaaaaggtctggagcgcctttgattcgccaaggtccttgtgtgcaaagcccgggacacggaggaggaaggaggcgcgagaggtctcgctgcaaggctgcgcgaccaaagcgctctttgtagtgaagtgatgaggcgggtgctgcgggggagggggcggcgggtccaagccgcgtcctctaggagggggtgcagattacggcgcgagatggagggatgtgccggcgcctggggctatagggcgccgagacggggctgcaggaggagggcggctgtgggccggggttcccgcggacccggtgcctcggtcccgggcaacgccgttcctctggcccttcttcgtcgccccccactcagtcccgaatctgagtgttacataaagtaccgggtagtactccgctcggggtaggtcggccgcccccgcccagccccctccggccctcacttggagctggacaccgagtaggggccgactgcgaggggcgacgccgccggttgtagtttgcggaggacgagggcttttctctgtgtgccgtagggaagggaagggaaggggaggagcggaggcggggaaggcgcccatctgcgctgcgctcgggggggcgcgggcagatcgctggcttggagaggactgtggcaggtgagaggacctgtgcgtcgttctctgcagacctggccgccccgggtgtcagagagaggtggcgagttcgtgtccgccgggaattgttggctgttggggaaactttcctgcgaggtcagtcaaggctttgggggctctgttttgaatgtggatcaccactcggagtttactaatgtttacaaggctgcgcagtagggaaacggaagagttgggtgggggcaaaaaaaaaaattgaccgctatccccgaaagtactagacgcctctgccgggaaggcgcccctgcgcgttctatccgagacgtagcttcgcagcgaattttataggaacttcattagcatattatggaacgtcccgcctcagccccccagtagttggctgtgatgtccttcgtggaatgtccttatcattcccctgcggaacgattggtcgctgaggcggatgaaggcgggcctagcgcaataactggtatgggtctgtgtttccgctgtcttcttttttctttttcggggaggagcggggtggagggtggacgagttgatttgaacgtcttcgggtcgctcggcctccagccttggattggttcttctcgctgctggggcgggccgtgctcttccgccctgcggtgtggttggttctcctcctggcctccgccctccaaatcggcgattcccataggcggcggctctcggggtgcggggcgagtctcccgctggcctcctccccattggctggaggcctggcgggtgtcgcccctgcccctctccccgctcagcccggccactttcgggcgcggatttatagcagtagcagtgatcccgggcctgtgggctcggggccggggctgcagttcggaccgcctcccgcgacccgcggggccggctcggagacagtttcaggccgcatctctgctgacccgagggtggggccgcgcgtggccgtggaaacgtgagtgactggggctgcgtccacgagggggaccctcggcgcagaaacttttctggaaggtgctgtcctcgggccggacgggccccgtggggtgaccctggggctccggacggaaggaaggcaggggctgagaccactttgatcgttcgacgatagaaaaaagtagcgcggggcggggtgcagggttccagctgtccagacagcaaagttcatggagccactttgtcctcctgtcgttgctggggagagcctggcttgctgcttgcttcatgttcacctagggtgatgaactttttggcttcaggaaagatcacagtcctgcccccccgggagtactggagcggcgcagctgggagcgccgagaagcgagcgaatctgtcgcaagggtcacagctccttggacttcggtgtaaatgctgagctctgccgcgtagttctgaaagacttccacagacctactctgtaggaagtcaaacgtcttttgcttagtaggcatcagttgtatgttaattcataaacttggattataattagtttgtcgatttaaaatggtgtttgaggttgcttgaattatttttcaaacattatcataaaaatacccacccaccccctgggaagttcgcttcataaagaacttcagtgcaacccgtatgtaaaattaaaatacatttaaaataattggacaaaccaatttaaatgttgctacaaccccatttaatctgtaaattgcatgtgctgctgctttccatggtaatgttggtgtggaatatgtttggaaaaaaggcagtagtgtctgaagctgagttgctggcattgaaaaagcagagtgtctggaaggatggcttcctatttagcagtggtgttgttcctgtttataaatatttgtacttagtggctttgttgataaaatactttgcttggagtatcaaagaaatattaggtaacagaaatacttcttggtaattttgcgatgggatatctgtttctcttgcccacaaattaggcttcacctggatggaagcttgcttgtgatgtaaaataacttctgtgttattaaattttaaatttatatgatacagttttctgtgaaatgacaatattgtctttagaactttgattactgatgaaaagaagtgataccattttgtaaccctaaatccatttaaaaataaatggtacacatattttaacattatgataaataagttgaataaattggtattacttggatacgttgaacacagctatttatttttataattaattactatatgagactagggctttcctcctggtggcaggcagcctgcattgttcctctaggagtcttcaaagctgtctttagtttgagaatatactctggaaaatattaccatttagagaagcttcagcgttggcctgagttcttatgtttactctagtgttaggtatatgtcttataactatttggagataagatctggaaaggaagggggtaacattttagacaatccctcccactctcagcccctcccctagtttacaagtagtattgttggccaggcacggtggctcactcctgtaatcccagcaccatgggagaccgaggcgggcggatcacctgaggtcgagagttgggagaccagcctgtccaacatggagacaccctgtctctactgaaaatacagaattagccgggcgtggtattacatgcctgtaatcccagctactcgggaggctgaggcaggagaatcgcttgaacctgggaggcaggttgcagtgagctgagatcgcgccattgcactccagcctgggcaacaagagtgaaactccgtttcaacaacaacaaaaaaaggtagtattgttgccttgtttaaagagactgcaaaaaggttttaggagaataatctggtactgtttaatttaatggttactgtttgaggaaaaagaactctggaatttctgtgtatttaagtagcctttttagcaaggctgtttacttcaactagattttttaatagcttttgtttcttgagaaattgcctaattacacttgccaaattacactttaaaatcatatacactgtcctctaacatgcccaggaaggtttacatttaaatactgaagaggttttcttttgtttttgataacattttaaagtccattgactttaacagatgtgaagatgtttttgtttaagcagtagatgcaaaagtaaaacctaccagcttcgctttaaagcaaggctagtgcattcactgcagttaaaaaataataataatagcccatcacagtggtgcttctgtagtcccagctactcaggaggctgaggtgggagggtcccttgaacctgggaggtcgaggctgcagtgagccgagattgcaccactgcactccagcctgggcgacagagacggaccttgtctccaaaataataacaagtcgtaataataataaagcaaagctaggttttctggattattgtggcagaactgttcttgctgtcactaatacagagggataacatgctagaataaatgtggggactgaaactgaggacctaagtcacaaagtatcctggacctttactgttaacccggttctttaaatcatagagagctattatataaatttatacacattctctcatttaacagggtattctagatgttggtatattaaaataaagaaaataaagaccttttttatttgaaatattcaaataatttataatatattttattaatgtttgtatattgtgtataaatgtaataaataccatgtttatataatgttatatgtatattaataattgtattcaaatagaaacatttgagtaaaaatgatggcagtatagacatagtcattaatagaaagtattaataaatgttgggtcccgagcactgcacctcatttaaacgtttcctcttaatggcttcgggcgttgtcacccgtgcgtgcctgggaactgttctcaggttccctggggtggctggagcggctcctgccgctgtggaagctgggccggcatttgtgttgtgttgtgttgtgttgtgttgtgttgtggttagcacaggaacagataggcccgggagagcctgtggctggtgggctttgttctgggcaagccgtgcgctggcccctaggctccctgccagccctctccgtagacccgtccggggccgtgtgggttgtcccggtgtcctgctcgcgagtgacgcctgtccttcttgcccccagagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaagattatatgaagtttaaattctagtgtccataaataaagtttcagcggaacaca

SEQ ID NO: 90 - DNA, 71330 bp, Homo sapiens
ctcctccagcagtccctttccccttcttccccaagatccagcgcgtgctcggttgcccttctccgttccttgcaggcccttgggtcaggacccaccacctgccggaccatcattttccgagtccctccggcctagtcggagtgctcgctcgcgcctcctaaagctctcagccgagcgcgccgagacccctcagggcggccggtaagaaggcggaggggcgggggctcaaagcgcgcggcgaaggtgcagcagttaccagggtgctgacgtcagctagaggcagggcaccgcggaaggttgaatccacgccctggctgtgcgcaggcgccgtagggggaaggcctggcacgctccagccaaccagggcgtcacctgcagctcgtccccctgcccgggcttgcctcgagcgccctgccgccgccggagcggggagggtgttgggggcaggtggagccgggagggcccagctgagaattcagggttgggggctcagagggcactgcggctaggagcccgtcaaagcctgtcgcccaccggggcgagggcaggtgggagcgcctggccgtgcgtcgcgcgctggttggccagctgacgccccagtgcgcatgcgcgtccgaacagccctgcgggcggagcgactgtcctcccttctggtgtactgggtgggaggtggaactagtcggacaaagccctcgcgtcggacccttgccagaactgtaaggagcaagaggggaggggctccggtggtgcattcatgctcctctaggggggaagcggggtcggaggggagtgctcagagccaccttagcgcaaagtgctaacttttgaattgaggcagtgccaggggacgcagtatccgcatcgcatctacattttaactcgctgtgaaatgagaacgcaaagacgatttaggttttattgtttccgacttatatttttccgaggtctttgatttacgggaaattgttacgtactaaatctcatatagcgagatttagaaaaggaagctacagaatctaggctaatgtatctaatagcatttcctgcttttgctctttttctttgcctttttcccctactctaagaagttcatattcaactgaaaagccatgaaaattaccgcttttgtccctccttgatataacaaactgctttcagaaaccgtacaagatagtcactaagggaagtcacagttcaaatgagagtggcatgatattaattttgttaaaataaattactttcaaataaaagttgtgccaaatggtcaaagctcaatcctgagagctctatttggcacacactcggtgttagttgaaagtaagcaaaacaaaaccgtttttcgtgtactcttccataatttggatttttcactgatttaggtatctttccaccaaatttggtttgaaactgcacagatttaatgcctcacttagaacagattttaggtaaaattagaaattttcactttatgaaacagaaactaatatcactgttaagtagattaaagtagtcatttacaatggtttgtaaataaattttatccttcccggtcctctgccctcttccaggaaaggcaccatttccttagagaagaccttcctgagctctccccgccccattccaagtgttgcgtctgggagtttctcatattctgtgcatgtttgtattattgcatttactgcgttgttttatacttatctgcttgtgtctgtttttacactcccccctccctctaaaagtcttttgagtattagaattgtcttaataattttctagtcccaatgctttacgcaggacctggcccataagtggtgatgaatgggtgagttaaagactcggtatgcctcccaagtgtgataagacagtgcaacctcttcagttattttatagcattttccaagtggaagtatagtgggctaagtgcagtatggacaggaaccacctatgtaagaatttatctgaagacgagaagcctgcggttgatgtggatgtcccagacttttggagctagtgtctgaatgagagcacccaactctactctgaagcaatgtgtcttcagtcagctgatagtaatttgattttctgtgtagctagtcctgaaagaggaagaacattagatctgaatcttctagttgtcttagcagttataatctcaaagtaaatttacagattgacattccagttatcaggccttctaatttagcttccccaaggcccacgtatttctgtcttgaagtgataaaattgggttctgttcttacaaggttgaagactaacccaagatctgggcgttgtgaagcggcaggcagccatgcctgccaacctgctggacattgtctctacttagaattttggtttttttaatctgaaaagtacataaaccatacaggaaacaaagaactaattcaagcaaaaacttgaaatcctcctttgatttttagcataaattgggtagctaaagatccaagtttgtattaaataattatttttaaagaattaaagcttaaacattaacagatgccccagaatcctctttggtgatagaatcaggattccctaatacagtggttctcaaacctgagtgtgcatcagaatccctgacagtgtgttaaaacagattcctccatcccacccagattctgattctgcaggactcggatgggacctgataatttgcatttctcacggatgctgttgctgctttgaaaaccactgccctaagagttatttctttctctccttcctaccctgtccctttcttcttttccaaaactggatcctcatctgtcacttagtcgtcagagcccattcttgaagagcttacaggaaatactcaaaagactcatagtactcggtttttcattcttattcttaaacagaacgagaaaatatatttttaattttttccaatgatttgtataggaagtgatcatcttagagcaataattttgttgaatggatagcagaattattaactgaatatatttttatatatataggcattttcctctagaaatatgaattggctgccattgtgggagagaggagaattattggaaaaaggaaaagtcacattccctctcatttctcccctattgctctctcattgtttctccatgacccagaacactgtctttaaaaagtcagtattaattcataaaaagacaattcccacagcacaatataactttattatattcactttaggtttttattttgaagagagaaatgctacttccatcaaaacttgtgtttttattggttagcaagtgccacctttgtcttcaaatggtaaaagtaaacaactagctattttttaattctgatgaattaaaagtatttttctagagaaaaatttgtgaaattattcatctgtactttttgaattgtatgtagccttggcaaaattgcctactaccttgtgtttaagaccttcagacattgactccttattgtgataattctgagtttttcaacaaagtttttcaaaatttgtttttgaataaaatgttgtattgaactgcatgtttgagcaatatgttatctgacattagatggaaaaaaattatgccattttttaatacactctgacataataatagttgcaactgtaatgaattttttatttactaaatgtggctaaatcccttatgcatattctacttaagcttcacaaaagttctatgaaaaagatagcccctactttcataagtgatgtacccctgaaaacacatacacaaagtcagatgtgggattccacatccacagtgcttaaacatcattattaggttctaaattagatttcaccttttagaaaagtcttattgaatatttctagcattttgtctgtgtctttccaccattttatcttaaatgtgctgtccagataacttcagtgagcatcagatacagaccaaatatcaatatagataacgttttctcatttgtatttcatttcgtattctttattactagtattagaattgtaatttttcttttttataaaataaagacaaaattcaataaaatattcactaatttcatttactaaattgtactcctgtctagcagattagcattgtgttagctcaaagtattctctcagttaatgaaaacttaagattcagaattaaaaggcagtttggagtggggacagaatgtttatatatatccacatgtttctgctgtaatgccattcttgcattcctggaaatcctgacatgctgccaaacaataagcaaaagtaacagtttgtggagaaaaagcacacaccactcaaaactgaacaaaattttataagagccctaacaaaaaccctaaccctaataaacatggtagtaaaattaaatctagtttagaccagtttcatcaagattaacattctaatctaggagtagctttatttatcaatcaaatttttttttaaaagacttggaaatctctagctttttcgtttatcctagcacattgccagatggtttgatgaagtggaaaatgtagccagacttgaacccactaaacatctgcttcttaaaccaaaagaaagaaataccaggagattttttttccttaaggtctttacatatcactaaagccttttttttttttttaaattgtagaaagcctacctctgatcacttcaaatcagtaatatgttgggggtaaagtgcatatataagtctttcccctattgaccaattgcatataagctgattcacattaaataaacattttaaggctggacacagtggctcaggcttgtaatctcagcactttgggaggccgaggaaggaggatcagctgaggtcaggagttcgagaccagcctggccaacatggagaaactccatctctactaaaaatacaaaaattcgctgggtgcggtggcaggcgactgtaatcccagctactcgggaagctgaggcacgagaatcgcttgaacctgggaggcagaggtcgcagtgagccgagatcatgccactgcactatagcgcaggtgacagagcgagactctgtctcaaaaaaaaaaaagaagaaatgttttggtgttacaacagacttttcttaaccatctatgttatttaagagatgaggaaacagactccagaaggtaacgtaacttgcccttgctcacacagtcactgaagatgtcaagatttgaatacaaatctcaagccccctagcctccatttcctaaccattatgcaaactacctactttgacagtcacattcactggaagtgtttagatcagcacaatccaataaaaatagaatgtaagccttggatataatttaaaattttctaaaaactagatgttttactttttaaaaagtaaaagtgaaattaattttaataaattataatttcaacacataaccaatatgaaaaattattactgagatactttccattgtttgtactgaatcttttaaatccagtgggtatgttaagcttaacacatctctatttagactaaccacatttcaagtgcacagtagctacatgtggctagtggctgcctactgttttagacagcagaggcctagattgtaattctattactctactgaaatgtaaacctttttaggaaatagcttgctcacaaaataagcagatagaaaacacctaattctcaacctgtcatttttttagtgctctctttctaaatctggaaaccatgatttaatgtttagatttgtatttggtaacattttatttttgttgagaaaatctattgtcacatttctaagcactaatgtcctttattagtcatttctcagtagtagtttagttatactctgtgattacaaagcgattagtggatgaatgtatttttctggataactaaagaccttgaactttacacaaattttattttgctttgattatttttgatggaaatgcttttttttttttttttttgagagagtctcactccatcaccccggttggagtgcagtggtgcaatctcagctcactgcaaactccacctcccaggctcaaggcctcagcctcccaagtagctggaattacaggcgtgtgtcaccacactcagctaatttttgtatttttagcagagatggggttttgccatgttggccaggctggtcttgaactcctgcccattttcacctcccaaagtgctatgattacagggatgagccaccataccgagcctcagaaatgcttctgaaatgcttctgaaatgtgctacataattccatcttacacacaacatactttatcctccatgattaaaagtcattaaggatactatcttagtcttcagctgctgtgtcaaactatcataaaccagatagcttaaaaacaacagaaatatatttcttgcggttctggagtctgggaaattcaacatcaagatgtctgcagatttgttgtcttgctataacttcacatggtagggggcaagatagccctctggggcttttttctttttccttttttgtaattttccttttttctgatagttttgatcagaggacaggactttttataagggcactaatgaccttattactgtcacacgcgtccgtgtgaagagaccaccaaacaggcttggagagagcaatgaagctttttattcacctgggtgcaggcgggctgagtccaaaaagagagcagagggagttaggggtggggtagttttataggatttgggtaggtagtggggaagattacagtcaaaggggattgttctcttgcgggcaggggcgggggtcacaaggtgctcagtcggggagcttctgagccaggagaaggaattcaattcacaaggtattgtcatcagttaaagcaggaaccggccattttcacttcttttgtgattcttcagttacttcaggccatctggatgtatacgttcaggcttgggctcagaggcctgacattcctgtcttcttacattaataagaaaaataaaatagtggtaaagtgttggggccctgaaaatttttgggggtggtatggaaagataatgggcgacgtttctcagggctgcttcgagcaggattggggcggcgtgggaacctagagtgggagagattaagctgaaggaagattctgtggtaagaggtgatattgtggggttgttagaaggagcatttgttgtatagaatgattggtgatggcctggatacggttttgtatgaattgagaaactaaacagaagacgcaaggtccaaataagagaaggagaaaaacaggtattaaaggacttaagaattgggaggacccaggacatccaactagagagtgcccaagggggttcagcataattacttgcttggttggcaagtttttgggctctatctttgagtttttttatgttgtcatataccaggccagattgatttaggtaaaaacaacactcttcgtttaatatacagagtcccctttttttttagcagtgactaacgagtcctccacgattttggaggaaagagaaatacaaagccagcaattgtttgttaaagaaggattagaaacggctaggagagagtgagtgagattgatagtgtggtggagatagctggggagaggtagagggtggcataagaacgggaacaagaataagagtgagtatgaaagtaaagaataggacttcatcaaggtgaaagtattggagtgtaccctgccagcaagatcatctatccactttaagagagacttaagggtggtggtttgaggtaaaaccagaaggtatcagttatgatggtttgaaggaaaagtgtaaaccggcagtggaaacaagggcagggcatttatgagtagttgagaatggtgaataggagtatgactagacagaagatagtagggatgacaagtttttggggtacagtccaagttaggctggtgtctggaatgagactggggcctaataaaaaggagcatccataggagctcaaatgggctgtaccctgtagcgtcccgaggacaggcccgaattctgagaagggcaagtggtaaaagtattgtccagtcctttttaagttggaggctgagcttggcgaggtgtgtttttaaaagatcattagtccgttttaccttttccgaagattgaggacggtaaggggaaggttctactgaataccaagaacctgagaaactgcttgggtgatttgactagtaaaggctggtccattatcggactgtatagaggtgggaaggccaaaccaaggaattgtgtctgacagaagggaagaaatgaccacggtggacttctcagaccctgtgggaaaggcgtctacccatccagtgaaagtgtctacccagaccaagaggtattttagtttcctgactcggggcatgtgagtaagtcagtttgccagtcctgggcaggggcaaatccccgagcttgatgtgtagggaagggagagggcctgaacaatccctgaggagtagtagaatagcagatggaacactgagaaatgatttccttgagggtagaatgtccatggtggaaaggaaatgagagattctaagaggcacgctagcggcttgtaatctacatggaagttatgagaattgtagggagtgagttgagcatagtttgtgattttgagggcctctaaaagtattagagcagcagcagctgccgcgtgcagacatgaaggctaggctaaaacagtaaggtcaagttgtttggacagaaaggctacagggcgcagtcctggctcttgtgtaagaattctgaccacagagccctgtacttcggctgtgtgtaatgaaaagggttgggatgagttagggagagctagtatgggagcagcttttagggctgttttttaaggaatggaaaggggagcagggaaaggatttaggatttatggtgtcagctaggtttccttttgtgagtttatataatggtttagtcaggatggtaaaactaggtatccaaaggcggaagtacctaaccatgcctaggaagaaaaggagttgttgttttgtagaaggggttggggttttggagattagccagacacgatcagcagggagagcacgtgtgtttttatgaagaattatgccgagataggtaacagatgaggaagaaatttgggttttggaggacgacacgagatatccttttgataacagatgttggaggagcaggaggatgtcctcttgggaagatttataggaggggctatatagtagaaggtcatcaaaatacttaataaggtgtgaagtagatggacagaaagagagtaaattatgagaaagggcttgaccgaagtaatgggggctgtccctgaaggcttgcagcagtacagcccaggtaagttgctgagactgatggatgtcagggtcagtccaggtaaaagcaaaggggctgggaggaggagtgcaggggaatagtggaaaaagcatgttttgagatccagaacagaataatgggtggtggagggacgtattgaggataggagagtatatgggtttggcaccacagggtggataggcaaaacaatttggctgataaggcacagatcctgaactaacctgtaagacttgtccagtttttggacaggtaaaatggaattgtaaggagagtttataggctttaaaaggccatgctgtaacaggcaagtgataacaggctttaatccttttaaagtatgctgtgggatgggatattggccttaagcagggtaagagtgattagtttttaatgggatggtaagggggtgcatgattggtcaccaagaagggagtagaggtgtcctatgcttgtggattaaggtggggagacacaaggggaggatgtgaaggaggctttgaactgggggaaagggcggcaatgaggtgtggctgtagcctaggaatagtcaggaaagcagataatttagttaaaatgcctcaacctaataagggaactgggcaggtgggaataactaaaaagtagtgcataaaagaatattgtccaagttggcaccagagttggggagttttaagaggtttagaagcctggccgtcaatacccacaacagttatggaggcaagggaaacaggcccttgaaaagaaggtaatgtggagtgggtagcctctgtattaagaaggggacggacttaccctccactgtaagagttacccaaagtgtctgtgatggtccaggaggcttccgaggccatcaggcagcatcagtcttcagccactaagctgagaagatctgggaaggagtcagtcagagagccttggggcagagttccaggggctctgggaacagctcccgggcaagttggacagtccgatttccagtggggtcccacacagatgggacacggcctaggaggaatcctgggctgcaggcattccttggcccagtggccagatttctagcacttgaagcaagatcctgggggaggaggtcctgaaggaatgcctggccactgtggcttaggtgttttgaagttcttgtgtgctggagatgtggctggggtttctctcacagcagaggcaagtaattgcaactcttctctattattgtacaccttgaaggcaaggttatttaagtcctgttgtggggtttgagggccggaatttaatttttggagctttttctaatgtcgggagcagattgggtaataaaatgcatattgagaataagatggccttctggcccctctgggtctagggcagtaaagcgtctaaaggttgctgctaaacgagccatgaactgggctgggtttttatatttgatgaaaaagcctaagtgctaactgatttgggaaaggtctgatagagaaaaaaggagcattaaccttgactatgcctttagctccagccacctctttaagaggaaattgttgggcaggtaggggagggctagtcacagaacgaaactgtaagctggaccaggggtgaggaggggaggtgatagaagaattatagggttggggagcggaggctaaggaagaattgggacctggcttggcctggcaaggagcagcctggggaggaggggagaggtcagatgggtccacagaaaaggaggatttaaagaactcagagtttggggtggagactgaaggaacagataagagagaaagaagaaagatttgggatgagtcacattggaagcagagattaggaagggaccgacgtgtaaaagaatgcctggacatcagacatctcagaccatttgcccattttactacaagaattatctagatcttgtaggatggataaattgaaagtgccgttttctggctacttggaactattgtcaagcggtattgcagaagaaaataaggcgtttaggttttaggttaggtgtgagttgaagaggttttaagttcttgagaacacaggctaagggagaagaaggaggaatggagggtagaaggttgcccatagtgaaggaggcaagcctagagaaaagagagggtagagacatggagagagggggatacttaccccccaggggaggttatgcttgccaccaaagtgaaggatcaaggcaggtgtccccgtggtgataacacacctctgaaatgtgggtgaataatcaggcaggcgtccccacagtgattaaacaccaagggaagactgtcttcccgagtctgtgactggtgccggagttttgggttcacggataaaacacgtctcctctgtctctaccagaaagggaaaggaactgaaattaagggaagggagagattgaagggtggcaccaaaattgaaaggagaaagaagttgagggatagtgagagaggttggagaagagagtagaaagaggccgcttacccgatttaaaattggtgagatgttccttgggctggttggtctgaggacccgaggtcgtaggtggatctttcttacggagcaaagagcagggggacaggggattgatctcccaagggagatcccccgatccgagtcatagcaccaaatgtcatgtgcgtctgtgtgaagagaccaccaaacaggctttgtgtgggcaataaagctttttaatcacctgggtgcaggcaggctgagtccgaaaagagagtcagcaaagggagttaggggtggggcagttttataggatttgggtaggtagtgaaaaattacagtcaaacggggttgttctcttgagggcaggggcgagggtcacaaggtgctcagtgggggagcttctgagccaggagaagaagtttcacgaggtaatgtcatcagttaaggcaagaaccactcattttcacttcttttgtgattcttcagttacttcaggccatctggatgtgtatgtgcaggcttgggctcagaggcctgacaattacctcccgaaggccccacttccttctttttcattttctttcttttttttttttgaggcaggggtcttgctctgtctcccaggctggagtacagcagcacgattgcagctcactgtagtctgcacttcccagagtcaagccatccttaccttagctttctgagtagctgaggcaacagacaaacaacactacccagctacttttttgttttttagagacagagtctcactatgttgcccagaggctggtcttgaactcctggcctgaagcaatactcctgctgcagcctcccgaattcctgggattacaagtggggaccattatatgcagatgatttttttaagaacatatttcacgtttgttgtaaataatatagaaaataagaagcaaaatgaaaacatttaatatcctaccacctagagatagctgttgttacagattgcatatttttctagtctttttttctttgcaagcttggggtctggtacttgtgctgtcttaactaaatctaggttattttgttcatcttatgatgaagtttgggtgagaatttagtccctcacaggtaacactgaaccttcaaatagtccaaattttttttgtattttttattgttgttgttgtttttgagatggagtctcactctcttgcccaggcagtgcaatggtgcgatctcggctcactgcaacatctgcctcccaggttcaagtgattctgcctgtagctgggactacagacatgcaccaccatggctggctaatttttgtgctttgggcagagacagggtttctccatgttggccaggctggtctcgaactcctgacctcagttgatccacctccctcggcctcccaaagtgctggggacccaaggtcataggtggatctttcttacggagcaaagagcaggagaacatgcatgaggcatgagcctctgcatctagccccaaatgtttttttttttcctcattgtatctccatttgatctcagaaatctttgaagtggtagaagtattttctgtatctttgtatttgtctcaaaatatcaatgtgcatggtttaaaaaaatcacctttttaaatttattttattttattttattttatttatttatttttgagacagagtctcactctgttgcccaggctggagtgcagtggcgtgatctcggctcactccaacctctgcctcccgggttcaagtgattctgctgcctcagcctcccaagtagctgggattacagggtcccactaccacacctggctaatttttgtattttttgtagagatggggttttgccatgttggccaggctggtctcgaactcctgacctcaggtgatcctcccacctcagcctcccaaagtgctgggattacaggcatgagccaccgcgcccaacccacctttttaatatttaaatggatacctataaatgcattctgtctcctagaaactcttgccacatcagtcaacctggaaataaattgaagtatccatttttgtttaagaatgtacttttaaaaaagataattcctgatttttcatttaaaattttctatcattctattaataacagttatgcttcattagatttcttcacatatattgaccacttcactaacatatatgttatgtatatattatatgttagttatatatgtattatatataaagtcatatatatgtgtgtgtgtatatatatatatattatatatataaaacattttggtacttaaaatgtgacagaataggactttagccatgtggtgattgttttgagagaacgtgctactcagcagctctccacaagaatggaataatggaaaacagaaaaagctcagagctcaattacatgggggagaaaagaattttttatctgatggttattatgcaaataatagggccttgcaagactttaataaggtactgctcataggattttaaaaatcatttggtcagttgatatggagactgtagtatattcgaatatcttgctaaagagctacattattggaaaagttcatgtgattcaaatcctttcccccacttttatctccatagcttgttttaaaaatagactttaattttcagagcaattttaggttcacagcaaaatttagcagaaagtaaagagagtttcatatactcacatccctactcacgcataacctccctcactatcagcatccacaccaaaatggtatatttattacagtcaatctacattgacacatccttatcacccaaagtccatgctttaccttagggttcacttggtgttgtccattctaaggattttgacaaacgttgacaaatgttgcttccaccattttagtatcgttcatacagaatagtttcactgccctaaaaatcctctgagctctgcctgttcatccctccctatcgattaaccacagatctttttatactgtcttcagacttcttgcctttcccagactgcttggaattcatatgcttggaatcatatgcttggaatcatacagtatacagccttttcagattgacttcttttttttttttttttgagacagtttttgctcgtgttgcccatactggagtgcaaagacgcgatctcggctcactgcaaccctctgattcctgggttcaagcaattctcctgcctcagcctcacaagtagctgggattacaggcgcccaccacacctggctaatttttgtattttttagtagagacagggtttcaccgtgttggtcaggctggtctctaactcctgacctcaggtgatccgcctgcctcagcctcccacagtgctgggattacaggcatgagccaccgcgcctggccaacttctttaacttagtagtatccagttaagtttcctccctgacttttttttagcctgaataatattcaattgtctggatataccacagtttatccatttacttactgaaggacatcgtggttgcttccaagttttagcagttataaataaagcctctgtaaacacctgtgcgctagttgttgtgtggacatagttttcagtttgttttgtaaattaccaaggactactattgctgtatagtatggtaagagtatgtttagttttgtaagaaattgccatactgtcttccaaagtggctgcacctgtttgcattctcccttcccactagcagtgaatgagagttgctgttgccacacatccttatcagcaggtgttgtcaatgttttggattttggccattctaatagatttgcagtggcatctcacttattttaatttgcagttgtctgacaacacatgatgttgaactgcatttcatatgctcatttgccatctgtatgtcttcttggtgaggtgtctgttaaggttttttgcccatttttgattgggttgcttgttttctcattgttaagctttaggagttctttgtacattttggataatagtttgttatcagatgtgtcttttggaaatgttttctccaggtgtgtggcttttcttctcattctcttgacattgtctttcacagagcagaatttttcagttttactgaagtccagcttaccagttaagctggatagtgcctttgttgttataactaaatagtcatttctatccccaaggtcatctagattttctcttttgttatcttctaggagttttatagcattttatatttaggtctgtgacccattttgagttaatttttgtgaacaatgtaaggtctgtgtccaggttaattttttcgcatgtggatgtacgattgttttagtgtcatttgttgaacaagctgtctttgctccactggattgcctttgttcctttgccaaagattagttgactttatttgtatgaatctatttctgggctctctattctgtttcatggatctattcattctttcaccaacaccgcgctgtcttgactactgtagctttagagtgagtcttgaaataaagtagtatcacttttccacctttgttctccttccttattgagttggctactctctgggtcttttgtctctctttataaactttagaatccatttgtcagtatccacaaactaacttgctgggattttgattggaatttcattgaatctatagatcaagttgggaagaatgacatcttgacaatattgagtcttgctatccatgaacatggagtatctctccatttatttagtcttcctgtttccttcatctgagtttgtagttttccttatctagatcttatacatattttataagattaataactaagtatttcatattttggggtgataatataaatcgcaatgtgttttacatttaaaattctacttgttcatttgtgatatctgcttaacttttaagcaattaatggatgcctcgaagttgacgtacatatatattcagaaatgttttgccacctgagacctatgaggaggtaagcatcatggtccaatctgtaattagtattgtggcggggggaggtctgttatgcatttggtttatttcagtttgttattatttttccaattctgaagttatattatggtggaaagctggaacaaaaagaaagaaaatttatatgagaagacaggtcctccaagagtacattcagagtagaaggtgaaaagaatactgtccttcagaagagttaggtgtgaaaagcttaaaaggaaaaacagatcaagtttcctcttaacacaattcactttatggtattatgtttcaagcatctagggcacacagtttcttttctttagagtttaaaagagggagagactaatgagaatacaaaagggaaggttctgggggaatagatacaatgcctcctggcgcatggcaggtgtgcagtaattgttcaatttggataggtaaaaatgcaggtcagggaggatgcattagggcttagaaattatgtaggacagaaaggggagaatgaggaagattcttgggagctggaactgagggtttgtataaggagtggttggagatcaagttggaaagatagatggggaaaccatgaaagagggtttcaaataccagactaaggagtggatttattctgcaggaattagggcaccaccaaagctgtttgagtaaggaatacagtgatggtggaattttaagaaagttaatctgttggtgatacccaatatggttggagaaaaggacagcagagtagactaattatgtacagtccagttttgtagtgatgataattgatagcagagaaagtggaaagaaggaatgatttcattgaacattgtaaagtgagaagactttactaactgatagtgaatgggggtagtgaactaatttgggttttgtgctttgcaacattgagaaaggtggtaccacaataacaaaaataaggaagataatcctggattgagttgctaactgctccctggccttctgtaaccaggctgaatttagaaagataataatgactcatactccttttttagatatgtaaaatttgagcagctggcaggagagctaagtgtatgtcagacgttgggaaatgagaacggaagctcagagggataagtggagttgccactgtggtttacttagactagctcatatttaatgctggctgattctttcctttactttaaactcctgttctaatctttgatgtacaaatccatatattgactttataaaaggttcaaatatataggagaaacaaaagataatctgcaaataggttggtggtctccagattgtttaaaaatcaccagaaatgattccacaatctctaccattttaaaaacataaaacttttctaaagacttgtcacacctaatgtatgagaacaaaagcatgtgcaatgtttagagacttcattataaaaagcttaggttgggccaggcacagtggctcacgcctgtaatcccagcactttgggaggccgaggcgggcagagcctttgaggtcaggagttcaagaccagctgggccaacatggcgaaacaccgtctctactaaaaatgcaaaaattaactgggcacggtggcgtgcacctgtaatcccagctacttgcaaggctgaggcaggagaattgcttgaacccagggtacagaggttgagccaagatcatgccactgcactccagccagggcaacagagtgagactctgtctcaaaaaaaaaagcttaggatggaaaaggtaaattataacatttaaaaataggtgtcgtggaagtgctttcaaaaaaccgcaaataatttcatttggatttaaacaccgtacttttaaaaaacactcccaggtgggttacaaaacttaagaatgagaatatcacggccaggtatggtggctcatgcctgcaatcccagtactttgggaggctgaggcgggtggattacctgaggtcaggagtttgagaccagcctgaccaacatggtgagaccctgtctctactaaaaatacaaaaaaaaaaaaaaaacagtcggcggtagtggcacatgcctgtagtcccagctactcgggaggctgaggcaggagagtcacttgaacctgagaggcagaagattgcatgcagtgagccaagatcatgccactgcactccagcctgggcaacagagcaagactccatctcaaaaaaaaagaatgagaatatcaagttatccaactagtataattttagcatgctaataatgagggaatgaactaaaagacatctgtatctctttttaagtataataattatcaaaatgtttgctactataaagaaaaaattgagccaggcatggtggctcatgactgtaatcccattgctttgagagggtaaggcaggagtattacttgaggccagcagtttgagatcagcaaaagaattagttgggtgtggtggcacgtgcctgtagttccagctacttgggagggtaaggtgggaggatcacttgacccccggagatcacaccgctgcactccagcctgggcaacaaagcaagactctgtctgaaagaaaaaaagagagaaagagatagatatagacagatatatatagaaagagaattacactattggatattaagattttttgatctgaataagaaacttataaagaaaattgttatcatttgcagtgaagtcagctgaatttcaaagtggagtattgaggggaaattattatgttatttaatatttctcattttgcaccagaaaaatttataaccactgttttagaaaccatgtggtactcactgcttgtaaaactaatagatttcagaaaaccacaaagtatctatcttgtttctgctgtgcatagtacgtttagttttattgtcacttatacattgaggatttgtgtgtgtgtgagtgcctcaatgaataaccagtccacatctttttaaaaggttatgtctagagaagatatttccacactggtttcccttttcaagagctttatcgggagctgaagcagtcaatgccttgaggcctttctattttgcagtacatccagatttctttggacagcaccccgtagaaagggtaaacatttatttatttttaaaccattagtgtacatttctgcttatttacctttgatacaatataatacatagagttctataaatgtggattattctgttgtggtgatataatcaatgctttgaactaatttgaaatgtagatactgaaaattgaaaatagagctttttttatgaaagctgtcattgttttgtgcaggcaataaagctgtcatttaaactctttagagtactagtaatcatgtttttggtaccaatttttgaagtacagttgagggtttgaaagaaaacttgagacctttattatcatgatcaatctctctctcttttttttttttaaggatgatacatggaagagttttcaatgccctagtgatttttccttatgatgcatgctgctggaccactcccctacaacatcagttaatgtgtgctccaggaatacaaactgatatgaaaaatgacttatggtagatgtagttaagacagtcaatatattttaacattagaaaatacagtcagtccttcatatccatgggttttacatccatggattcaaccaacctcagactgaaaatattaggggaaaaaaatacatctgtactacacatgaacaaacttctctttcttgtcattattccctgaacaacacaggataacaactacttacatagcacttacattatattagatattataagtaatctagaaatgacttaaagtatatgggaggatacacataggttatttgcaaatactacactattttatatgagagacttgagcattcgcagatttcggtatccacgggaggtcctggaaccaatcccctatggataccaagggactgctatgtattacaaagccacatgctttggaattacttcagtgttccttctattttcattaacactgatatctagtttaatatgaaaaggaacttgaaatcttgaaaattagaacatcgttatttttttctacttgcaatggaaaatctattttgcttttttgcttctaggaaaatattctgattatgatatgtgatatgttggctactcaaagtcagaacttttcaaagtaatcagtaaattgaatcaacagaaaaatattcattaactcggggatgcattaataaagtttttaaattcaaaatgtatagaaaaatcaagcttagtaatactttaatattattctaccaatgtattttttttaattaagacttctgtatgcagcagggcatggtggcacacctgtagtcccagctactagggaggctgaggcaggaggattacttgagcccaggaattcaagcctgggcaacatagtgagtcctcatctcctaaatttaaaaaacaaacaacaaaaacttctacgtgtggtaaagggttaactcagcaagcttgggttgcttaaaccttgcacattccaaagaaaggtctgaccccagtgctgacctttgactggctactgggaaatgagctctgagcccctggataggaatgtttctgtttgcctgaggcctttgaccatgccagatagtttatgctaacaatgtgatttatagtgaatacctgttttcctgtgtctaagaccctgggctgcactgtattaatttgaccttgggtatttggggagctgagactgagtagctgaagtgagtcacataagcactaaatgcttacctgactgacccccagtaaaactctggacatccagacttggatgagcttccttgggtggcaacacttttacgtattgtcacacaccattgctggggggattaagcactgtctgtaaaactccactgtgaaatgacaactggaaacttgcacgtggtctctcctgattctgctctattcaccttttccctttgctgattttaatctccattcttttgttgtaataaaccataatggtgaataaaacagcttgtctgagttctgtgaatccttctagtaaatcgttgaacctgagagtggtcttggggacccctgacacaatgtgcctagagtttaatggttctgataagtttacattttcgtgttatctttaacttgtatttattgactcctcctttgtgtcaagcccttgccctagctgctgcctctgtttagagcatccttttcccagatatcccagatatggcttgtcctttactttctcacctttcagtgaggctctcccagactacactattacttgtgtttgttttgttttgttttgtttttaaaactaccctattttaaattgccatctctgctttccttcctagcattccgtcccctctttaccctgcagtacttgtttttttttcctttccatgtaccctatttccttatttgtgaggtttgttgtttatttttctcccctcactaaaatgcaagctccatgaagactgttcactcttcttgtcactcttcttgccaccacatgttcagttcagtcttcttcctactattagagaacacccttgccccttttcttaggaagagtggcttaaagtcccatctattcatagcatcgaactcaaagtccagggtttcccagtgatgcacaggatttttgggttttttaaaaaatcctctttaatttaatttaaaaatctgcaaaacattgtgggtttaaaaaaaaaatcaaaactaaatacaaagtttaatgagaagtctcattcctatattcctgtttcgtttacccagttcctattcacttcctatatataatctttttttttttttaatttttttggagacagagtcttgctctgtcacccaggcggggagtgtggtggcaccatcaaggggctcactgcagcctcgaactcctgggcttaagtgatcctcctacctcagcctcctgagtagctgggaccacaagcatgtaccaccgtgcccaactaatttttgtattttttgtagagtcgaggtttcaccatgctgcccgggctgttctcaaactcctgagttcaggcaatctgcctacctcagcctcccaaaaactgctgggattatagacatgagccaccacgtccagccttcttgtgttgcttttcagcaaaaatagaaatatttatcaaaaaataatgatgaagatttagtcttacactggcaataattatcccacacttgcctgcaggactcatatggctaagaacatcatattagaataaattaaacaaacaatcatttattactttgggatatttagtcattggcattttctacatttaggttataaaggaattcaaccatgttttcttctattacttatatggttacatctttttacatcttacccatatggagttcattctgttacatgttgtgagatgtagatccaattttatcttttaccaaagagctatgaaatcccaacatttttaaatactaaattatttaatactctcaatgtgtttaaaaggttagatagatatcatttctgatatttccttgttctattttgtatgtaaatgcccttaatgtttttttccaggaaatcaatgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccggtacgttttttatttctggtgtgtcccttgcaagcttaatgttaaatgtgttcattaattttgacattgccagaatacctttggatgaaaactttggtgatagaaaaataatagcatttaattgattgttttcctagaattagattctattcctacctgcatatgttcgaacaagtgattttttgcgtgtttaaacgtttttgtttctaaaactaaagtgttcctatttgttcccttaccagttcagtgttattttaagtgttaaacatgtccaaacaatatgtatttctaaaaactacagcttgcattctcttatttagtcctctgaatactctgaggctggtagtacttacccaattgtaacttagtgatgttcagtgcctttcccaagaccagagagaaagaatatgagtcttgaacccaggtctttgaactccaaccttatgctgcttctaaaatccaattgatcttagcagacagccaccttttcactaccttttgtcactgcttatccatatttaaaattaaggacaaatatttagggtaaagatcactaaaggcctatcatttctctaattatacatgcttttaatgatccttgaagaaataactatatttttagaatgaacttaagacaatttaaggattcactgagtgctttctgtgagttaaggctaaaacaggatacactgtaatttttttttgaaacaaactgttataaaactcagaatttgataggtctttgagatctaaaatctgtttctagctctgccagtgacctagctgtgtgacctttaacttttgggtgttcatttattaaaatgaaagagttggagaactgtgtagaggccactcacatggaagatccctaatttacacctcaccctcccccggctctcaggacttcaaatggaaggaggaagagcttgatctgaagaatgctgaagtatgttgaagacaactcctcacccagtctctccagggactagtatttgatagtatatgatctcttaccttttattttctcataattgaatatgggagatcaggagtcacaaattccttttcttggcagtttctccatctacctctgacttagagttttattaaaaatagccctattcttcaatatttaaagatagaaagtcaattcatagcccttttgtgaaggaacaggtatactgaagaatgctgtaaataatgaataataagcatgttgatcactctaagtgacacaattctgtttgaaagtttaaatacatgaatgtgctgttcctaggcatgagagtctcataagcaactgagatagattgttactagtgtaaaaccaaatattcataaatatttttaatagatgtatgctcctgttagtcagggtcaagattaggctaggaattaaataacatcttacatatatgtagtggtctacttaggtttcattatttctccaggaagacagatggaatttttagaggcagattatatcctttatagttgttaaaataaaaatattatcatcaatctgtttttatttgtatgtggttgaaagagtcgagctcgttcctacagctaccactagtgcttctgctaccactctcagctggatttgtcttaaatattgaatatacatggagttaaagagtaaactgaatttaaaagcttagtggaaaacttaggaagtttcacacagcaaattagggacagagctggtactagaactaatgtctccttattcctagtccagtgttttgatttgtataccacattatctattaattcttcttttaaaatattgtaattaatcatttttccttttgcctttataacaaagattggccctctgacaaagatttaaaacatttttacttctgtaacatttttacctgattataaaattaaaatcaagtagatttttaaaaaatttttatttctagaacactagaaatcattaatcagctttgaataaataagatggtgataaggtaaaatgtttactagtgattttcattactgaaattttatgagcctttagcattattaatacattgaaatccttaaaggctgaaattatttcttcagctccgtatctttttggtggttcatgaggaagtaaatgttgttattagaataaattttaaaataagttaaagatttgctaagagctttctgtgaattaatgctaagacaaatagctgtagccagctctggctgagtaaaaacagaatcctttactttcagttaatggttaactttgaatgatttcttaaacaaaaatagcttatagctgggcatggtgacacaagcctgtactcccagctactcagaagactgaggtgggagaatcacttgagcccaggagtttgaggctagcctggacaactggacaacacagcaagtctgtctttttttttttttttttttttttttttcatacggagtctcactctgttgccaggttggagtgcagtggtgcaatcttggctcactgcaacctctgcctcccaggttcaagtgattcttctgcctcagcctcctgagtagctgggactacaggcaagcgccacaatgcccagctaatttttgtatttttagtagagacggggtttcaccatgttggccatgatggtctcgatctcttaaccccgtgatccgcccacctcagcctcccaaagtgctggtgttacaggcatgagccaccgcacctggctgagactgtcatttaaaaaaaaaaaaaatgtaaaaggttacagaaaaaattaaactagaaatgggagaaaagatatagcatatatgacaaaaagatgatgctaatacataaagagtttttacaaattaaaaataaaccagagtagttccattccaaaaatggagaaagacaataaatagacagttcaagaaataacacatataaatgtcagttaagtatataaaaatctttaggccatgcgtggtggctcacgcctgtaatcccaacactcttgagaggccaaggcaggcaaattgcttgagtccaggagttccagaccagcctgggcaacatagcaaaaccccgtctctactaaaaatacaaaaaattaaccaggcgtggtggcatgtgcctgtagtccccgctactcgagagcctaaggtaggagaatcacctgagcccagggggcagaggttgcagtgaggcaagatggcaggcaccactgcactccagcatgggtgacagagtgagaccctgtctcaaaaaaaaaaaaaaaaatctttagcctcagtattcgaacgcaaactgaaataattaggtagtattttttgcccattaatttttttctttttttgctggtaatacccataaatggtaaaaatacattttcccacattattgatgggtatataaattagtgcaaactacaaactctgcagcttggaattctctccccaaagccacaaaattcttcttggaatgtatcctgaggaaccagtaaaggatatttgcagtgtggtacaggcaatcctcactatatagcagctcttatgttggattaaataatgagctgataaattgagatagaaacagatttactccttgactttgcacttctgaggatgagctattttttcttaacctccagtgcagcaatttgggttttcctttcctcctttactgactagaataattcccttgccagtagttctaagtttacccaaattattgaactaaaaaaaagtatttcttagttggcatgttctggatctcataagttggtgtggcaagtagaatgtgtatctctgacaatgatttaaagtgtggtgtctgtcatcagttgcaaatactttttttttttttgaggcagagtcttgctctgctgccaggcttaagtgcagtggcacaatctcggctcactgcaatctctgcctcctgggttcaagtgattctcctgcctcagcctcccgagtagctgggattacaggagtgcaccaccacacccgctaatttttgtatttttagtagagacggagtttcaccttgttggccaggctggtctccaactcctggcctcaagtgatccacctgcctcagccttccaaagtggtgggattacaggcatgaaccactgccccggcctcatacgtgatacacacatacaagcacatagacggaaaaggtcaaagaacagtgctgcccaagagaactttctgtgatgagggaaatgttccatatctgcatcatctaatatggtgggccctagccccgcgtgcttattgagcacttgaaatgtggccaatgtggccaaagaacttaattttaaatttttatttcatttcaatcaatttaattttaaattgccacatgtgctagtagctaccatcttgggtagagcaggtctggaagaatatgtacctgttaatagtgattacctcaagtaaagatggtaaagttgtatgcctgctaacaggagaattttgcttttaattttcaaaactaattaagaatagttttttaaaaaagcgaagagtcagcatgttgtagtggagaaaatatttggcttggtgtcaactcagatttaagccctggcttcattcttaatctatgttccttcacatttgacaagagaaatgataatggcatagttggtggtagtgttgattgaaaagatatgtaaattaagctggaaccatgcctaacacccagaaaagaaaaaaagcaaaccagtggattttttattgatgacttaacaatttagattacttaccttagcccaatgattacccaacatcaaaatcagtaacttttttttttttttgagacagagtcttgctctgtcacccaggctagagtgcagtggtacaatctcggctcactgcaacctccgcctcccaggttcaagcaattctcctgcctcagcctcccgagtacttgggattacaggcgcccaccactgcgcctggctaatttttgttgttttttttttttttttttttgagacagagtctcgctctgtcacccaggttggagtgcagtggcacgatctcggctcactgcaagctccgcctcccgggttcacgccattctcctgcctcagcctccagctgggactacaggcgcccgccaccacgcccggctaattttttttttttgtatttttagtagagacggggtttcactgttttagccaggatagtctcgatctcctgaccttgtgatccgcccgcctcggcctcccaaagtgctgggattacaggcatgagccaccgcgcccggcctaatttttgtatttttagtagagacggggtttcaccgtcttggtcaggctggtctcaaactcctgagttcataatccacccaccttggcctcccaaagtgctgggattacaggagtaacttttaaacaactagagaattttaaatcactcctgaaaatattgggttactacctagtggagtgagcaagtatgaggaccatctccttcaatcatagagaaaattcaagatgggtttctgtgaccactgagactagattatatggcccctcttacctgaactgctgtcacagtgtacactagaaactatctttggtggacacctgcttataggagagcttttctctctcttaagagaccagatttatcgacagaattgagaatattctaaatccccttggtgggctgggatgggtttggtcactggagccaaactagaaaatggagctgatgattgaagtaattcactggagccaaactagaaaatggagctgatgattgaagtaattcatgaaggtaaaaatagtgtggtgtagttttagagaagggaagtcattttccatttacaggtgatttgctaataggacgaatttaaatcagtaatagaatgtttaaaagattttgattttatatatgttgaaataaagcaaataatcatctgtattaattgtttgggggaattatattctctaggatttcgagcagtcaaatttactttgcacaccagagatctgctaagcacagtgttatatattctcaactcctgcagtttatctgttgaacatatccaaagcttgaatactaatatgcatacccagcctctcaaagaagctaaaaggatgcctgacaggcccatcaaatgggacaagtcttattactcctttactggattcaaggaccctgatgaagaccttgaacaagtctcgagagtggaaacaactctcacgtatgtaaaagtttttatctaactaaactgtatttgtagtttgtgtttatgacactgatttattgggatggcaaaaacatttttttataaataaaaagtgtagttcacatttaaaattaaaacctaattttccaggaaaagtaatactatcagtctagttaatccagtaatcattatgaaaaatatatttcatgtttcttacttaaagctgccaaaatacttccaactgtatttaaagttgtggtcttttgataccaaacacatgcaggagattgttttgtttaacttttaaaaattctattcaagttacccccggtacatggagaaaggctatacctaagactatacaaatattttttactcttcttcatgtgttaggcatttctaacggatagttcagtagtgatgtactttagtgtaataatccatacataagaaaaatacatggtgaccaaattattaaatatcatctagaatagctgctttaaagagttactttttaaattataaaaatcatatataaaatgttttctattatttggcatgccttatttgtaaagtcaccttaatgttttttaagtcatttttggatttcataaagacccatcacattctcttcttatgattgtatctaaaaagtccagtggcttatcagaggattctctcattatggcatagtaaatgatccttcattatccactggcataatatctgctttgtggattatctatactaagggattcctccttgctacctagctagattctaaataaggctgaaaaggtaggaaggtagcagagtctagtacagaaaagtatagaagtatgtgtctgaagacgtgtatgtatgtacctacgtgtgatagtctatgatatttgtctatatgcataactgatggataaatcacttccctaaatatgatgactttaattgttcagattctcctctgagatggaaatgtgggtttgggaataacaatttaatgatggaccagaagtaatgacacagtaagaagtcaggtaaaaaatgaagagcctggcactgtggcttatgccgataatcccagcatttggggaggccgaggtgggaggatttcctgaggtcaggagttcaaaaccagcctgagcaacatagtgagacccatctctacaaaaaatacaaaaatttagccaggcatggtggtacacatttgtagttctagctacttggaaggctaaggcaggaagatcccttgagcacaggagtttgaggctgcggtgaactatgattgtgccactgcactccagcctgggtgacaaagtgagaccctgtctccaaaaaataataaataaataaaaagtagagtcatggtggcatagaggttgccgaattgaaaattttggtatagaaaaacagaagagataatttaaggttaattgcacacagaggctacagtgagaattgaagtagatttctctgagcacaaactggaagagaagttctcagccttgccttcaagttttatgtgggacacggcacatacaacttctgcttacacccgcgggagaatattgttgtacttatcttgcgctgtgtctagatgaacaaaaagttggggattactggcctaaagagtatagaaaacagtgagattgaatacatcaagccaaaacagcaaaagtaacagtttttggacttcactcaagttaaaagggcctaagaagaatgtattaaaggatttcatagaagcagttggtctgtggttcagttgagtatttcgtagaacacagtttttatttggagctggatgtgcagccatcatgaaaagagtgccccaaggacctagaactggacttagacaccggcaaagtagtgaaaatacattgaaactatagaaagccaactcaacaagataagtgtattcaactgggttccttacctaagctcagtatttataatttttttatttgtatgtcatttatccagtaaaattccttagtctttagtaaaaggagactttcttatattacattcgactatatgagttcttaagagtagggaatatgttttgataatctctgtgtctactaatctacttcatagattcatagaatccatccagtattttcattgaactgaactaaagaattgttgaataactaaatgtgatgtgctagaggctcagtttgaagaactcgggctttaatatgtgaatgcaaagtaacatacatagcgtagcaatagaagtcacttagcagtgaatgtagagggccattttttcttaaagtgcttctgttaatttcattaatgttaactaaaaaaatctgctatttttagtgaaagatacattgtcttaaggaaaatttctatgcatagataagttatgttgctgtgaattcttgatttcctcaaaagtcagctttgttttaaattcaagcttttattttgacagttatgaggacaagctcaaaaaacaagtccctctgacttgttgtctaccctttaagagtatagcaacataaaaaatgccttgggaggccgaggcaggcggatcacaaggtcaggagatcaagaccatcctggctaacacggtgaaaccccgtctctactaaaaatacaaaaaattagcgtggtggtgggcacctgtagtcccagctactcaagaagctgaggcaggagaatcgcttgaaccggggaggtggaggttgcagtgagccaacatcacgccactgcactccagcctgggcaacagagtgagactctgtctcaaaaaaaaaaaaaaaaaccactgttttagaaattgaagtcagtggaaatttagctttctaaatcactgattattattatccatcttgtcaacagctattttatctttacagaaattaaagtaaacccattattaagcagttagagcctttctttttttagcttcataaagtgaaattaatagtggcatagcattacagtagataggttttttgttttttttttttagtttttttatgcttatattgaagggccttagattgtatttcttttttaatttctttctttctttctttctttctttttttttgagacagggtcttactctgtcaggttggagtgcagtggcatgatcatagctcactgcagcctcaaactcctgggctcaagtgatcctcccgcctcagcctttggagtagctgggactacaggcatgtgccaccatacctggctaattttttttttttttttttttaaagatggagtctcactctgttgcccaggctggagtgcaatggccctatctcggctcactgcaacctctgcctcccggattaagcattctcctgcctcagcctcccgagttgctggaattacaggcacacaccgtcacacccctggctaatttttgtatttttagtagagacggggtttcaccatgttggctagactggtctcgaactcttgacctcaggtgatccgcccacctcgacctcccaaaatgctgggattacaggcatgagccaccgtgcctggcccatacccggttaattttttaatttttagtagagacaaggtctcactatgttgtgcaggctagtctcaaactcctgagctcaagcgatccccctgcctcagcttcccagagtgctgggattacagacatgagccaccatgcccggctagattatatttcttaagcattgacatcttattgatttacctgaaccagatcatcacaactcatggagtttgagtttagcttaagaatgtgtaattttagagcaaaaagtccaggttgggtaggagagagaggacagcactacactgaaccaagacaagacaaggaatactgctcattgggctgttagagtgaaatgcagggtaggctaaatccctttaccagcatgtcttacagtgctgatgtagcattataatacctgtactcatctgaaaggtttcatatctcttatctccctaacataacctggtttcccaattctagcatgttcacataggcccagagccccttgacctttccctaagcatgagcattgcccagtttgaaggaacctctgctgagggtttgttcaatgttttaatatatggtagtttttcctagtaagggttccaggagcttatatcataaaagctggaatggtatctctatcaatttctcatttcaattacagttgacccttgaagaatgtgtgtttgaactgtgcagatccactcttacacggattttttttcaaccaaaagcagattgaaaataccatattcgctccccaaaaactattgaaatagtaatagagagagagagagagagaaagagagaaggaaggaaggaaggaaggaaggaaggaaggaaggaaggaaggaaggaaggaaggaaggaaggaagatacagtattagcaagatgtgaaacctatgtatagggaaggccgactgttggtatacgcatgtttggcggggccaactgcgggacctgagtatgcacagattttggtacccgtgggtgggcttggaactaatgcctcatgtatagcaagagaaaactgtactgatttttttatatctgtaattattttacaaataattgtaaaactgttgaaccatttcagagctttcaaatcatgtgaatcaagtgactgcctagtagagagattcatggtgcctataagtctactaaaacctattagccatcatggtcattttggccatatgcagtttaaatttttattcatgtattgtttaattcatcttcattacatgtatagattatagagaggaatcataaggaacacatgctgaattatatagttcagaagtagcataaaaatggtaattctgcccatttatatcaatctgatctcttgatttacaaattacattcattggatcaaaactttcttttttttttttttctttttttaagacagagtcttttgctcagtcgcccaggctggagtgcagtggtgctatcttggctcactgcaagctccgcctcccgggttcacaccattctcctgcctcaacctcccgagtagctgggactacaggcgcctgccaccacacccggctaatttttttgtatttttagtagagatggggtttcgccgtgttagccaggatggtcttgatctcctgacctcatgatccacccgtcttggcctcccaaagcactgggattacaggtgtgagccactgcacccggcccaaaattttctttttaattaaatctttaaagcaagttaagatggttttaatgtttctgagcactatgttaaacgagaaaatataattacagtgttatttagtatagactttaactttcaaaataattttatctgtttttggttttgctgagaagtgcagggtaaaattgtgtcctagcatttttaaattaaaataagaaatcataaaaataaatcagttgagtttttttatttttatttttaaatattttttgagacagggtcttgtttggttgcctagactggaggagttttttaaaaacacaaaatgggagatttatcaggtcataaaaactctatttaacccacttttatattatatccattaattacattttaatgtatattttaaggcatggtttgtaattttgaatttctcagcagattgtgttttatcttacttcaacattcctttgttatatacctataaaaatgataaaatgaaagctttaggccaggtgtggtgggtcacgcctataatctcggcactttgggaagctgaggtgggcagatcacttgatgtcaagatggtggccaacatggtgaaaccccatctctattaaaaaaaaaaaaatagccaggcgtgatgatgcatgcctgtagtcccagctacttgggtgactgaggcaggagaactgcttgaacccgggaggcagagattgcagtgaaccaagatcgtgccactgcactctagcgtgggtgacagagtgagactctgtctgaaaaaaagagaaaagaaaagaaaattttaatacgtaagtagtttttgaaaattatataaaattataaaaggaatgttccagtctaaaaaaaattaggaaatgctgttccgtgttgtcaatttttgtatttctatattttgggtatattctttgattatcaaattatgttaaaacaaaaatgtactttaattatatagcttgtatttgagaggagctaaccagatccattttatataagcaaaataattccatatgaaatgtctatcccactgaacaaacatgtcattgaactagaaaaagaccattgaaatactattcttacagctactaagataccagtgaatgtcagagttcctttttttctatttgaccttagctcaaatatatttacatttcactttcagtgtctaaactttgaatcaatttttgtgttcatgaaataccatgttggacacctacaacattggaactattctataaaatgtttgggatttgatagtcatgatttaactcatattgtgcgtttatttactcttccctttgtttataggctaagtcactgtttttaaaattacaagtgataatgcacaatttagtgactcaggactagcaaagttgttttgctttgctttctttttttttttttttattttaactatatattgtgaatgcatttctagtagtaagtttaagtattatttctcaaaatacttcgtttagttacatacacataaatacaggtgtgtgtgtatatgctggttcactatgtgaaatatttcttaccatgtgttgccatcagagaagtataaaaagcttttggtgccaggtgcagtggcttctaactataatcccagcactttgggaggccaaggcgggaggattgcttgaggccaggagtttaagaccaacttgggcaatctagtaagaccttgtctgtagaaaaataaaaattaaaaaattagccaggtgtgatggcatgtgcctgtactcccagctactcaggaggctgaggcaggaggatcacctgagcccaggaggtctaggctgcagtgatccatgatcacaccactgtaccccagcctgggtgacagagtgagaccctgtctctccaaaaaaaatataaaaataaaaaaactattgctctatgaacttcaggcagtgaaaataaaataaaggctgttattggtctaaactcctttgttttatacagtttgaagcctaggagtgtaaaatttatgcaattttaactttattgtaatttggatcatggctttcttttttcatctcttaaatccatggaaaactgagcttcgcttgagttactatttttatttcaaaagcatcatgaccctaggaaccgaaccaaatgatttcacagtccagcattagtccttgtacgtggtattctggcattcatttttatataccttttaatgttcttttggcttcattttattatcagtttttttctttttatttggatcttataacaatacatgtaatatatgtattacatattgctgcaattataatgaaatcatttttaatcaagctgtcttagtccattttgcattgctataatataaaggaatactagaggctgggtaatttataaagaaaagaggtttgtttggctcatggttctgcaggctgtacaagaagtgtggcatcagcatctgcttctggtagggacttcagaaagcttcccctcatggtagaagggaaagaagaacaagcatcatgtggcaagaaaggaggaaaaaaagagaggaggaggcgccaggctatttttagcaatcagatcttatggaaactaatagtgagaagtcactcattaccatgaagatgacatgaagccattaatgagagttctgcctccatgacccaaaacttcccaccaggccctgcctccaacattggggattaaatttcaacgtgagatttggaggggacaaatatttaaactgtagcacaggccaaggtcaaacagacaaccacaaccagttaccacttcataccctatgatggctatattctaaaagagaataacaagtgttggtgagcaggtagggaaattggaactctcctccatataaaatggtgcagctgctgtggaacacagtttggcaatactacaaaatattaaacagagttatgtgacccaagaattccactcctaggtatacactcaagagaaatgaaaacagacattcacacaaaaatatgcttatagcaacgttatttataatagccaaaagtggaaataacctaatgtctaccaactgataaatggatttttaaaaagtggcatatccatataatggaatattatttaaccagaaaaaggaatgaagtactgatacttactacgacatggatgaaccttgaaaacatgctaagtcaaagaagctgattgcagtcaaccacatactgtgtgattccattttatgtaaaatacctacaataggcaaatctagagaaacagaaagtagattagtggttggtagggctggagagcaggactattaatgggtatgtgatttcttattcaagtgatgaaagtatactaaaattgactgtggtggtggttgtacacttctgtgaacatactaaaaatggatgaatgggtgagttatatggtatatgaattgtattccaacaaagccatttttaaaaagaactatcactactcttcctaaaaaatatatttattaaaagtattattagtttatgtttttggacaatgtataaagataattttgtggtaacaactgaaagagttggggagagctagtaaaggagcagagtttttgttattgaagttaagctagtataaattcaaattagggtgttataactttaggatgttaaatgtaatccccccagtaaccataagaaaataactaaagaatatacacaaaaggaaacgagaaaggaatttaaatgttttgccacaaaaaaaataaaatcaattaaacacaaaagaagatagtaatgcaagaaataagggacaaaaaagcggtaagacacatggaaaataaatagcaacatgacagaattaagttgtatcttataagtaattactttaaatgtaaatggattaaactttccaaaagacaaatactggcagagtgaatttaaaaaacatgatttggccgggcgaggtggctcacgcctgtaatcccagcactttgggagactaaggcgggtggatcacgaggtcaggagattgagaccatcctggctaacatggtgaaaccccatctctactaaaaaatacaaaaaaattagctgggcatggtggcaggcacctgtagccccagctactcgggaggctgaggcaggagaatcgcttgaacctgggaggcggagcttgcagtgagccgtgatcatgccactgcactccagcctgggcaacagagtgagactccgtctcaaaaataaataaataaataataaaacacatgattcaactatatgccatctacagaagagtcactttagatccggagttgaaagtgaaagggtggaaaaagatagtattccatgcaatagtaaccaaaagagagttatactaatatgagacaaaatagacattaaatttaaaaagattacaagagaaaagaagattattacatattaataaaaggctccacaacaacaagagatagcagctataaatatttatctacctaatacctgatcatcaaaatatatgaagcaaaagtggactgaattgaagagagaaatagaaagttctacaataatggctggacacttcagtactccactctcaatagtgtatagaagaaccaaacaagaaataagtaaggaaacagaggacttgcatagcacaattaaggagctggatctaacagacatatacaagacactgtacctaacaacaacagcatacacattcttctcgagtccacatggaacgttttctaggatggaccatattttcggccacaaattaagtctcaatagatttcaaaagataaatatacagagtatcttctctgaccaaaatgggatgaagttagaaatcaacaacagaagtaaaactggaaatttcacaaaattgtggaaattaaagcactcttaaccagcagatcaaagaagataccatgtaccacataaatatacttactatgttacccatgaaaattaaaaataaaaagaaatcccaagggaaaatagaaaataccattctggacataggggctggcaaagatttcatgatgaagatgccaaaagcaattccaacaaaagcaaaaattgacaaatgttacataattaaactagagcttttgcacagcaaaagaaacgatatatcaacagagtaaacagacaacctacagaatgggagaaagtactttcaaactatatatctgacaaaggtctaatatccagaatctatcaggaacttaagacttacaaactgctgggtgcggtggctcacacctgtaatcccagcactttgggaggctgaggtgggtggatcatctgaggtccagagtttgagaccagcctggccaacatggtgaaaccccgtctctactaaaaatacaaaaattagttgggcatggtggcacatgcctgtaatcccagctctcaggaggctgaggcacaagaatcacttgaaccaaggaggtggaggttgcaatgagctgagatcgtgccactgcactccagcctgggcgacagagtgagactctgtccccaaccctacccccccaaaaaaaaaattttacaagcaaaaaacagccccattaaaaagcaggcaaagacatgaacagacacttttcaaaagaagatgtacatgcagccaacaggcgtatgaaaaaatgctcaatattactaatcataagaaaaatgcagctgggtgcggtggctcacgcctgtaatcccagtgctttgggaggctaaggcaggcgaatcaaaggctgttcaagaacagcctggccaacatggtgaaaccccatgctcctaaaaatacaaaaaattagccaggcatggtggcaggtgcctgtaatctcagctattcaggaggctgaggcaggagaattgcttgaacctgggatgcagaggttgcagtgagccgagatcactccacggcaacagagcgagactctgtctcaaaaaaaaaaaaaaatgcaaattaataccacagtgagataccacctcataccagttagaatggctagcattaaaaagccaggccaggcacagttgctcacacctgtaatcccagcactttgggaggccaaagtggggagattgcttgaactcaggagtttaagaccaccctgggcaacatgacgagaccccttctctaccaaaaatacaaaaaaatagccaggcttcatgccatgtgcctatagtcccagctgttggggaggctgaggcaggaggatcacttgagcctgggcctcggtggggagggtggggtggggtgcatgcagagattgcagtgagccaagattgtgccgttgcactccagcctgggtgacagagcaaggccctgtctcaaaaaaaaaaaaattaattaataaataaataacagatgctgtggtcaggttgtggagaaaagggaatgcttatttagtgttggtaagagtgtatattagttaaaccatcgtggaaagtagtgtggcaattcctcaaagaacttaaaacaactaacattcaacccagtaatctcactacggggtttatacccaaaggaatataaatcattctactgtaaacacacatgctgacatatcttcattgcagcactgttcacaatagcaaaaacatggaatcaacctcaatgcccatcaatggactgggactggttaagggaaatgtggtacatatacctaatggaatactatgtggccataaaaaagaatgagatcatgtcctttgcaggaacatggatggagctggaggccattatccttagcaaactaatgccgtgacagaaaaccaaataccacatgtcctcacttataagtgggaacaaaataatgagaaccaatgggcacaacacagagaacaacagacactggggataactagagcggggagggagagagaggggaagggtgtttctaactatcaggtgctacactcaatacctgggtgacaggatcaatcataccccaaaccccagcacgttacgttacacccatgtaacaaacctgcacatgtactcccaaatctaaaataaaagttaaaattatatctagggaagagagtgggaggagggagaggatcaggaacaataactatcaggtactgtgcttagtacctgggtgaagaaatggtctgtacacgagacctccgtgacatgagtttgcctttgttaacctgcacatgagccccagacctaaaataaaaaaaaaattaagaattttaactcaattagatcatagacttaaatgtaaaatgtaaagtagtaagacttttaggagaaaaaggaggggaaaattttcagggggatatgaagagaggttgattaatgggtccagatatacagtttgatagaaaaaaataagatctgtctgatagatcagtaaggtgactatagtttacaatcatcaatcgtgtatttcagaatagctagaagagaataattggaatgtttctacaataaaagaaatatttaaggtgatggatataccaattacactgattttttacaaattatatgaatattacattactgaatgtaccctgaaaattttaaaaaaatgtatgattaacaattttgagcaaaaaagaaaatatagatgaatgaaaacaaaaacacaatgtaccaaaatttatgggacccagcaaattcagtgaagcaatgctaagggggaaatttatagctataaacacatttaaaaaccaagaaagatctcaaatcaacaatctaactgtacaccttatgggattagagaaaaaagaataaactaaacccaaaactagtagaaggagggaaataataaagattagagcagataaccaaagtagatattagataaacaaaatggagaatagaaaaaggatagagaaaatcaacaaaaccaaaacttggttctttgaaaagatcaacaaaattgacctttagctagatggactaagaaagaaaggagactcaaattactaaaatcagaaatgaaagcaggaacattactaccaattccacagaaataaagattataagagagtaccatgggcaattgtacaccaacaagttggataacctaaataaaatggacatatttctagaaacacaaaatctaccaagactaaagcacaaagaaatagaaaatgagactgagtcagtaattttaaatttcccaacaaagaaaagccctgaactggatggcttcactggcaaattctaccaaacatttaacagcaatacttctcaaacttttcaaaaagaaactgaagaaggaacactccctaactcattctgtgagagcattaccctgatactaaaggcagacaaagacactacaagaaaagaaaaccacaaatcagtgtgctttatgaacattaatacaaaaagcttcaaaaaatcctagaaaaattaatttagcagcatattaaaaggattcaataccatgaccaagtaggatatattcctagagtacaaggatggttccacatacaaaatcaatcagtgcgatacacactaacagaatgaaggagaaaccccacgtgatcatttaaatcatctagaatgatcatgatgcatgatctagaatgatcaaatgcaaaaagtatttgacaaaattcaacatactttcatactaaaaacactctagaaataaaggaaactacatcaacataataaaagctatatatgaaaacccacagcaaacatcattctcagtagtaaaagactgaagtttttcatgtaacataaggaagtaggcaaggatgcctactttcaccacttctattcatcatactactggaagtcttagccagagcaattaggcaagaaaaagaaattaaagtcatctacttggaaaggaagaggtaaaattatctgttcacagatgataatggtcttatacatagaaaactctgcagattccactgaagaatctgttagacctaattagcaaattcagcaagttagcaggatacaaactctatacacaaaaattaattgcatttctgtatactagcaatgaatccaaaaagggaattacaaaaacaattccatttacaatagcatcagaaaagataaaatgcttaggaattgactgaagagacgaaagacttgtagtacaatgaaaactataaaaacatttctgaaagaaattagagaagatataagtaaatggaaaggcattctatgatcaaggatcagaagataatattactaagatgtcaatacccaaagcaagtacagatttaatgcaatccctatcaaaagcctgatgacattttttgcacaaatagaaaaacccatcctaaaattagaatttcaggggacctcaaatagccaaaacaatcctgaaaaagaagagcaaagctggagaactcacatttcctcatttcaaaacttactgcaaagctatagtaaacaaagcattgtgatactggcataaaaacagacatataggccaggtgtagtggctcacttctgtaatcccagcactttgggaggctgaagcagaaggattagttgagtccaaccagcccaggcaccgtagtgagaccccaatctctataaaaagagaaatacacaaacatatagactaatggaatagaatagagaatacagcagtaaatacttgcatatatggtcaactgattttcaacaagaatgccaagaccactgaatggggaaaagataatcttttcaacaaatggtactgggaaaactggccacatgcaaaggaatgaagttgaacactgacttatactaaaattaactcaaaatggatctttgactgaaatgtaagacctaaactataaaactcttagaagaaaacatagggcagaagattcatgacattggatttgccagtgatttcgtggatataacacctaaaacacaggcaacaaaagaaaaatagacaaattggatttcatgaacatttttaaagtttgtgcactaaaagacactatcaacagagtaaaatggcaacccacaaaatgagagaaaatgtttgcaactcatatatatgataaaggaattgatatccagaataaataaagaactcctaaaactcaaccagcaaacaacccatttcaaaaatgggcaaaggacttgaatagacatttctccaaagaaggtatataaatggccaataagcacatgaaaagatactcaacatcattaatcactagagaaatgcaaattaaaactaatgggtgtgaggtacctaatcacacccactagaatggctactatccaaaaaccaaaataacaagagttgatgagggtttgaagaaactggaacccttatgcactgttggtggaaatgtgaaatagtgcagctgctatggaagatgatatggtgattcctcaaaaacttaaatatagatttaccgtaaaattgagagcagtgtctcaaatagatatttgtatacccatgttcatagcagcattattcacaatagccaaaaggtggaagcaacccaagtgtccatcagtggatgaatggataagcaaaatttgatatactcctacagtggaatgttagccttaaaaaggaaggaattctgacacaggctacaacacatgaaccttgaggacatcatgctacatgaaataaaccagtcacaaaaagacagatggtggatgattctacttatgtgaagtacaaggagtagtcaaattcatagagacagaaaatagaacagcggttgccagggactggagggaggggaagggggcgttagtgtttaatgtgtacagagtttgagttgggcaagatgaaaagagttctgaaaattgatggtggtgatagttgcacaacaatgttaatgtacttaataccactgaactgtacacttaaaaatgggtaaggggctgggtgcagtggcttatgcctgtaatcccagcactttgggaggctgaggcaggaggatcacttgagcttaagagttcaagatcagcatgggcaacatggcaagaccctgtctctacaaaaaaaaaaaaaaaaaaaaaaaaatttaaattagccaagctaattagccaggcataatcacaccactgcactctgacctgggcaacagagtaagaccctgtctttaaaaaaagaaaaaaataaggttaggaaaaatatgttagtgattactaattagtatttacttgtttataggtaatttcatttcttataaaatcagcatttttaaaaaacttcttgcttagtagaggttaaatagtctggcttacttggtattttactatagaataaatatgagatttctctatttcttttatctcaatagtaattaattggacttctcacccttgaaaacaaaggctctgaatttttaaatctctgtgattataaaattaagccaagaattaaaatgatttatgtggcaaattcaggcagtaatgatccttttaaaatccaataaagtgttctcatttagagagtaatttagaactttatttctgacctagagtctggttagacaaggtaaccgtgtgtttccacattgatcaggaaggtattcttttctctttgccttatggtttaatttatagtcaaatttcatgctgtctagtgatctcactgtgatgacattcagattaagtacacattagataataaaagactcatctttccctcatgggggtaataggataatgggggacttaagacacgtagagataaattattatacaaacaggctgtgattggtcccaaaaagaatactgaacaagtatacagccaatcacaggacatacattagggagctcagaaagattttcaagtaaatctagctcttggcttacttccagttttcatagtttttgcttgatgtgggaacagatcattcaaagttgtttaatgggaatcttcattgccacattcatttttctctagactattggaataacttcctaaggatctttctaccaccagtttctcttccctgcaacttgggttctacattccttctatattcccaactttaccaaaggctttggtcacgtcattccccttaatagctcatgcattgtttagaggagatcccagttggtagcctgcaaatacaggcatttattaaatttcatggagcgtgataaatgagaaaatactaatagggacatttttaggaatttttgaaagatagaaagcagatgagctcagaactgtggagaaacaagtcagccagaatgcctgctatcacctctgcaatgtatttgtcctggagagcccagccaatgtattataagaaacagaaatgggatatgcaaatattggaaaggcagagatacacttggattacttacgattgtcactaagaaaatcaaagggaattttattagtcaagagtttttgattgccaacaaaagaaaccagccctaatgtaagtagaaaataaattacaaggatatgaagtctcttgtcatgtttacagaagattggaggacatggttgagaaaatgtcctgatgggtatgagctgagaagagagactctcactttactgtagatgcttttgtacagagtgttttaccctaaaaaatagatccatatacttatttaaattgttttaaagaaaaatacagggactgctgatcctgaaaaagttaatgagcataaaaagtaattctgaaaggccgggcatggtggctcatgcctgtaatcccagcactttgggaggccgaggtgggcagatcacaaggtcaggagattgagaccgtcctggctaacgtggtgaaacactgtctctactaaaaatacaaaaaaaattagccgggagtggtggcacacgcctgtagtcccagctacttgggaggctgaggcaggagaattgtttgaacccaggaggcggaggttgcagtgagccgagattgcgccactgcactccagcctgggcaacagagtgagactccttctcaaaaacaaaaaaaatctgaaaatttgtctcttattaccttcacctgacctgttagttgcattgatttgatcaaaattcagaaacacacgatggtgtctcttgtacataagcaccaaaactcaaaagaaaatgcttttgttgactttattttcagttttgtttttcacatattcaagaataaagacattctctacaattattttttttctctagagaaatgcttacaaacagtagccagcaacttatactttctttttttttaacctgttttttaattttaattttgacataatttcagacccacagaaaatttgcaggaatagggccaggcagagtggctcgcacctataatcccagctactcaagaggctgagacagaagaatcacttgagcccaggaggcgaaggttgcagtgagctgagattgcaccactgcacctcagcctgggcaatagagccagaagctccaaaaaaaaaaaaaaaaaaaaaaacactttaaaattagccacacctatatagttctttctactcctgaggccgagtgggaggattgcttgagcccaggagttcaaagttacagtgagctattgatggcagcagcagcccatctggagcagccactgctaagacaccagctgcagcaggagagacgtgtccggggctgcgtgctctacagagctggtgtgggctgggaacaggcaggagccccacctcctactgaattggtagggtgggagccccatgctccctggtgcagctgcagctacccagccacccactctggactgggacatctctgggctctcaggggcctgggaacccccacccctgtcagctcagaagcacctgctcccactccctggcctctctccactcccagtgcctgctcaagtgcagagcaaatttgtggcagagcctgggcactgtcacgacctggccagtgtggcgctgacacaccagccccctgctatctctgtccctccggactttgggcgctgatgagcacaggagggaggcatggtgagggtggctgagggcagcttggcccaggcctgcaggagcccctcagcacaaacagcctgggtaccatggacggcatgttgatggcaggaggtagataggttcctgggcagaaagggccaggtccctgatgaaaccccaccttcaagccaggaacagcctgaagcgtggggactgggctgccggttccaggtgaagtccatggcccagagtgaagacttcactgatgaccgttcagccaattggatggtgctttttccaggcccaccaggaaaatcctcctttctgagcacataaaaaccccaaactcagccagactcatgctgacattgggactaccagctgcgggaaggagttacccacttcaggtctcctcaatgttgacacagcctgcctgtgaaaaggagctatccactgtgtgtctcctctctgctgaaagctggacactcgtggggacaacctgctggcagaaaggagctacaccaggtctcctgagagctgttctatcactcagtgaagctcctctccgacttgctcaccctccagttgtccacatacttcattcttcctggacatgggacaagaacttgtgaacacctaatggtgggacttaaagagctgtaacacaaacagggctgaaacacacctaggtctgggctccccaaaccagggctgtgacaccctctttgggaccccacggttcctggtgtttccaagcttccaggaaccaccacgttcctcagttcccacagtggtacacctggtcagctgcagccttgcatggagccagtgcctgtgctggtgcatgggtttgcccgctctccactgcagtcagcacgcctggctgtgcacagtggctggaccctgcgctcactcacacaccccttgccactctgtgcctggctggcccttggcagatgtgggatctgggccggtagtgtgagctgagtgcagcctgccaggccaagtgggcagaatgagcccagtgggcccgagccaaactcaggcaaagacactaccaaccacagaggtttccagctggaaaagcaacaccccaaggatcctgtgacactatgattgtgctgttgcactccagcctgggcaacagagaaagtccctgtctctagaataaaaaaagttagagactaaaataaaaaaagaaagaaaatttgcagaaataatataaagaagtcccatgtaacctccacccagattcctcaaatgttaactttgtaccacatttgctttatcattctctctatatatatatatttaaatattgaaattatatatgtatatttatacacattttttccctgaaccatttgagtaagttgcagccacaatgtccctttacccctaaatacctaggttgtacttttttaaaatataaaaacattatataagaaaatactaaaaattaaaaagttaacacttatgacaatactattagctaacccagagatattattcaaatgtcactcattttctgatcgctaccctttattaggaaaagaaaatcccaaatcgtgagccacatttagttgtcaaatctctttagtcttctttaatctggaacagttcctcagtgttttcttgtctttcattaccttgatgaatacaagccagttattttgtagaatgtctttccatttgtttatctgatgtttgctcataattagagtcagagttttttgcaggcctaccccagaagtgacgttgtgttgttttcagtgtattatataggaggcatgttatgtttatgtaacccattactaatgatactaatttcttccaggaagttatgattttttttcctttaattagcttctgttaaggagatatttagggctatataaatatccttttactcattagatttttacttcctcacttgctctaatattcattgatgattcttgcttgaatcacgttttactctgctggttgccacgtgttgatttcctcatttcatcatctcttcatatggggactatgtgaagtgcctatgtccccatctttccttgagtactcccttactttctggttcaccaagttgttccaggttcatctggactgttcctgctccaaagtttgattcagcagttttgccaggaagctctggctctttctagtagggattggtttgtagacacccaacatctcagtgctacatgcgctcagttactactaatcctctcagtggccagagccaggaaacatgtatctttatatctgtatatattaaaagcccggccggtggcttacgcctgtaatcccggcactttgggaggccgaggtgggtggatcacgaggtcaggagttcgagaccagcctggccaatatggtgaagccccatctctgctaataatacaaaaattagccaggcatggtggtgcccacctgtagtcccagctactcaggaggctgaggcagaagaatcactcaaacccaggaggcggaggttgcagcgagccgagatcgtgccactgcactccagcctgggtgacacagtgagactccgtctcaaaaaataataataataaaacagaaaccatgttgagagtctttgtttttacttcagtttttagaaacaaaacacaaatattgttaagctagaccagttgatttttatacattaaatgtaagaattccaaaaatcaattcacaaatctataagatcatatttgaatctatgttgcaaaacatttgggccccaaaccagacatgatgtgtcatttgataattcatatgtcaataaatcatgctttctcttacataatttaaagtaagttgaacaacatgtattacttaataagtgtggaaaagttggaaaattgtaatgccatatccaatagtagtgatgtaaattaagatatttttacctgcttaatcacacaccatgcagaagtgacaaaatgtttacgaatattcttaaagagggtataggaaggattattaattgctatgcaaagtcattgaattaaaaaaaaaaaacatcgaacactttcacctagaggataagcttccagttccctttctcagcgtgtaagacccttcatagtctgaccccacttcacccccagtccctctccagtctcttatgcccttctctccctctaagcatcctgtcatctgtgcatattggtacatctcataggtctttatgcactaatatgattgacatgccattctctctcacctacctggaaagatctgatacatctttcaggttccagatcacatactacctgttctacagaatcttccaggaagaattacttcttcttttctcataatagttcttatattatattctaattgcttatctctatattccttattaaatgtgtcttcctttaaaacagggactttatcttccttgtaatcccaacacaacacaatgtcaggcattcaatataagtgtttaatagatgcataatgatttgtcagtttcaatattctaaacctgataatttttaaatgctttagatcacaacatctaaaacatttaaagtgaatattaaggaacctagcactcgcttcagcagtacatatactaaaaatggaatgaggccaggtacagtggctcacgcctttaatgccagcactttgggatgccaacgcgggaggatcatttgagcccaggagttcaagaccagtttgggccacatagcaagacctcatctctacaaataataactttaaaaaattaggtgggcatggtagtacatgcttgtagtcccagctactagagaggctaagtctggaggatcacttgagcccaggaggtcgaggctgcagtgagccatgatcacaccaacctattccagcctgggcaacataggtagaccccatctcaaaaaaattggaacaatacagagaagattagcatagccaattaaaaaacaaattttaagaaaaaatggccaggcatggtggctcatgcctataatcctagcattttggcaggtcgaggcaggaggatcacttgagcccagaagtttggagccagccttggcaccaaagtgagacctagtctctacaaaaaaataataagaagaaagggaacctctggttttcctggagttttctcttgcatagtaatgcctggggcccacccccaaccactttgttttggaatctgaaatgatcccctcagcccagagtcactttaccattctgtcccctccccgtcaccacccactcctgcagcagctcttcagcctcccaggactccatccaggtcactcatttctctggacttcccttgggtagccagtgaccctgagcactaacaagcacccttatgtcatgattatagcaccaagtgagagtttctacagaggcagtgctgctctctagaaggccacacaggctttcagctcttttctgaaagctatcccttctaatccttaaagacttttttttttttgtaatttttagatggagtctcgctctgtcacccaagctctggagtgcagtggcgtgatctcagctcactgcaacctccgcctcccgggttcaagcgattcttctgcctcagtctcctaagcagctgggattacaggtgcgcgcgaacacgcctggctaatttttttgtattttttagtagagatggggtttcaccacattggtcaggctggtctcgaactcctgacctcatgatccacccacctcagcctcccaaagtgctgggatcacaggcttgagccaccacacccagccaaagcatttttgatatttagttcttcttgtaagactattgaggtaaacattctaagaaatacaggtttagagaacatctttctgctgagcttattatagagttgatatagttgagatgaaactgaaactggacatttggttgggtggaaaggaatggaggtgtcactgagcaccagggtagtgaagaggccctcctggaaggagggtgtggcaaaatgactagattggtaaggtctgaccagtcggagggactaggttacagggatgagggaataagcattgggagctcagggtagtaatatccaagaccaaaataaagggagaaactggagtccacccagccagaatccacaaagtaatcttttcctattccttcatcaggacccattgcctcttaattgtcactagtcccatcagatatgtctgttgagtttgacttttacacctttttagctctattataatatttgctcacttgctccataattagtattagttctaccctcccatatgtgtatgactgacatcagtgaaaatccagtatagcttaccgaaggttgtaataaacacactttgaagtatttttaatttaaaaaaatattctatctctaggaatctagtgacaggtttgatataattaaaatttaattttttaatatgcaaaggaagttgtcataactagaatatgatttgacaggtgttggcagttctccaagcaacttattttaaaagtaggtatctctgaaaaagaataggtagaagtaaaggtttgattgaaaactcagtttaacagtggggctgctttaaggtaatgtatgtgtcctttttttctgagtacaatttttttttaacttttaggttcgggttacatgtgtaggtttgttatataaataaactctcatcataggggtttgttgtacagtttattctgttacctaggtactaagcctagtacccaatagttgtttttactgatcctcttcctccatcctctgccttcaagtgggtcccagtgtctgttgctcccctctttgtgtccatgtggtctcatcatttagctcccgtttataagtgagaacatgcagtatgtggttttctgttcctgtgttagcttgctaaggataatagcctccagcttcatccatgttcccatgaaatacatgaactcattcttttttatggctgcatagtattctatggtatatatgtaccacattttctttacccaatctgtcattgattggcatttaggttgattccaagtctttgctattgtgaatatgcaagtgcatgcatgtgtcttttaatagtaaaaatatgtatattatagttagtattgtaaagtatgtatctctctctttctagatcctggttagataacaatgggaaaagtgctgttaaaaagctaaagaacagtttgccacttagaaaagaactagatcgtttaaaagatgaactgtctcatcaattgcaactctcagatatcaggtaagaaagaagagagaacctaatttagaaattgaaatgaatatgaattaccaactgataagcttttcagcagctaaatatttgcatctttaattgctctgataactgagtactcttcaattatctttatgaacatcatgaaatgttcatctgtgtaagaaaactcttattaatttcttattttaaatactgaaataaggctgtgcacagtggctcttgcctgtaatcccagcactttgggaggccaaggtgggaggatcgcttgagcccaggagttcaagactagcctgggcaacatatagagaccccatctctacaaaaacttaaaaaaaaaatagctaggcactatggcctgcacctgtagtctcagctacttggaagggtgaggcaagaggatcacttaagcccaggagcttgaggctgcagtgagctataattgcatcactgcactgcagcctgggtgatagagcaagacttcatctcaatttatatatatgttacttctttcttctatatatagataaagaagtaaggtttgtttaagtactgacatttttggcgtaataaacttttttacataataagtttgtaagaaaaataccctcttccatatacacataatatataaaaaataattatgcccccatcttgtaagatatttaaggccagacacagtgactcatacctgtaattctaccactttgggaggccaaggcaggaggatcacttgaggccaggagtttgagaccagcctgggcaacatagcgagacctcatctctaaataataataataataagtgttttaaaagattagtatttgagtttaaaaagaggaggggagagagaaaatggatgttgtattcttggttttatattatatagcaggactttttaagtaagttttcataaacttggaaattgcagttatataaagatccatgctgaaatttattgtggaatagatttaacagttcttaaaactgtaaggaagggaaaaggagtcaggtcattcagtcactggacttcccatcactagaactaggaaaaatcgtcatccagtcttcatgtttaaacatctttgttactatttgcaatagcctgttttgttgttttcaattctcattattaggacttttttttcttatattaaaacaaatgacttgggtaccataaaaacacctttttttcctgtgtttacagagtacagatagtatttacatgttctgttcttgtataatcaaatcatcataagataattcagaatttcaaagcattcttttagacttccatgtgtggaatgtttgaatgtatgcatatatccattattttatcatcacactaatcattttcagattaaactttattataggggtttcttcccattccatagtctattagcataaacttttctaactaaaaatagtaagatcatttttaaaagtttataagataaattaaggtgcatgcaaataactttttctaatagaaattttaaaagatctgtcaaagcagactggggttaggaaaatgaaaggatttcttaaacaaaaaaagaaataaacattattttacagtatcatggagaaatttctcagctttaatttatattatggtaaatgtcaatagatataacccggccgggtatggtggctcacacctgtaatcccagcactttgggaggccaaggcgggcagatcacgaggtcaggagtttgagaccagcctgaccaacatggtgaaaccccgtctctactaaaaatacaaaaattagccaggcctggtggcacgtgcctgtaatcccagctactcaggaggctgaggcaggagaattgcttgaactcaggagacagaggttgcagtgagccgagatcacgccactgcactccggcctgggcaacagagcgagactgtctcaaaaaaaaaaaaaaaaaaaaaaaaaaaaaaatatatatatatatatatatatatatatatatatatatgtatatatcccacataaactctagttttcaatttttaagagtataaaagggtccctgagaccataacatttgaggaccatgggcatgagggcttttttacttgctaaaaaattagccaaaactccagcaaacagaaacattaactaatgacattgtttttcattctaaacagcctatataaaacaccatttttaacaaaaacagcatttactacctttgtcacttaaattttttaatttcaagtaatcaaaaattaatattctttgaaattatattttactttttaaattgtagtttaaagaaaaaaacaattttttaaacaagttttcattttatcagaaatgacattcatcagaattagtattaggataaaagaagaacctacgtttcttgagcgcctgttttgaatgcctgactccttcacacacattacctcatttgatgcctactatctgtgtagcaggaaacatcctcactttgcaagcatgaaagtgaaaaccttaggaaggctaaaagcagcttgttcaaggtcacagagctagtaaaccacagaattagaattccaaggtgggttttctgacagcactcgagaccggtgctcttcagttacacagcagggcctctgacatcgtgtcagtgtcaggttccatgtgtcactgaggcttaatattaatttataaaatgagcagattacatgatttcatcaaaatcactttctctagaatgagataaaaagaacctgaggtcaggtacggtggctcacgcctgtaatcccagcactctgggaggccaaggcgggtggatcacttgagcccaggtgttgaagaccagcctaagcaacatggtgaaaccctgtctctacaaaaaaatttatttaagtagccggccatggtggcacatgcctttagtcccagctactcgtgaggctgaggtaggaggatctcttgagcagaggaggtcaaggctgcagtgagccgtgattacaccactgcactcccgcctgggcgacagagtgagactctgtctcaaaaacaaaaaagagaacctgataaacctaactggaattcgtagttggaacttgaatctaaaacaaaaccatcgtcattgtaacaatgtgaaaaagaaaaacacttttttcaaagttttcccatttcatcatcttatttttaaatagaaacatcttatatttgcttattttaaatctttggatacctgaacatagtagtaatatttctgccctctggtaaacaattcattttccatttggttgcttttttaaaaattagctagcttagaaacatatgatcaatcaaaacatgttatgtgtgtgcttcaaaaagagactcattggctttccaaggactccagtagttgtggtgggtgctcgctccgtcttcagggtgccacttgttaacatgagtgtgtgctctgttggcctaggtggcagaggagctggggcatcgcccaccgctgtagccagctgcatagtttaagccgcttagcacagcagaatttggaaacacttaaaaaagcaaaaggtaaacattttccattttcttttaaaaaatcacttagctgctatgtacgtctataaattttaatggaaaaaccaaataactttatcacagctgaacttttaaatctgttctttgaataaagcagtggcataaaattagcctttaagcttctactgaatttaatcctgggtttatacactatttgcacaatgctgaaagaatgaagcacctcgaccatgaccaaaggttttgtgttttgtcatcagggtgtacaatcatatttacagaccgttctggcatgagtgcagtgggccatgtgatgctaggaacaatggatgtccatcaccactggacaaaagtaagaaagagccttaaaattaaaaactccttgtcattcataaactttcatttccaacaatgctgtaatgttaagggactaaaaaaaggtttgttgtgtttttgtttttgttttttaatgtttttaatcgcagtatcagctgttttcagatcagatgcttaaataccatgtacttaaaatacttaagaggaaagactgatttttaaggcagtttttatctggtaatattgcattcttttctgaagcacagcctgaaagcctatattctgttttgttttacttgttcttaacagatttattgaggtataactgacatttaataaactgcacatgtttcttgtgtgttatttggtaagttttgacatattatgtatgcccatgaagccattatcacagtcaagatagcaaacgtatccaacaactgggcatatatgtgagcatatggccctttgtaaacactccctcccatcccaccaccccctctccaagcaaccactggtctgctttctgttactatagattagttttggagtttttcataagtggaatcatagggcttgcaaacttttgtgtctggtttctttcactgtctcattttgagattcatccatgtggttgcatgtattgggagtttattcctttttattactgcgtactatttcatggtataaatataccacagtttgtttattcattcacctgttgatgaacatagggtcgtatcactttgtgactattacaaataaagctgctgtgaacatttgtgcacaaatatatggacatatatttcctttctcttgggtaaatacctagaatagaatggctggatcatatggtagagcattttaactttttaaaaaactgccaacacttaactatggtcatctttttaattttagtcagtctaatagctctgtagtacaatctcattcaatgtgtaatttgcatttctctaataataaataatggtgagcatcttttcatgtgcttatttgtcatccacatatcttctttagtgaagcgtctgttcaaatcaaatatttatttggtagaaatatttgcaaaccgtatatctgacaaagacattatatctagaatatattttcaaactctcaaatttcagcaggaagagaaaaaaccaatccaactaaaaaagggcaatctaaaactctcaaaattcagcagaaaaaaaaaaacaactaaaaagggctactagaaaaaccaatccaaccaaaaacggtgacatgaaatgacatgttgccaaagagaacgtacagatgacatgtaagcacataaaaacatgtttattggccgggcactgtggctcacacctgtaatcccagtacttttggaggccaaggcaggtggatcacaaggtcaggagttcgagaccagcctggcaaacacagtaaaacgccgtctctactaaaaattaaaaaaaaataaaaagccgggcatggtggcaggcgcctatagtcccagctatttgggaggctgaggcaggagaatcatttgaacccgggagacggaagttgcagtgagccgagattgcgccactgcattccagcctgggcaacacagcgagactgtgtctcaaatagatacaaagattagatagatagatagatagatagatagatagatagatagatagatagatagataaaaccatagtgcattatcactacacaccaggacggctaaaatgaaaaatagttacatgctgataagaatgcagaaaaaataggtcattcatgcattgctgatgggaatgtaaagtggtacaggcattctggaaaaagattataatggtttcttacaaaactaaacatgacccagcagtcacccttgggtatttacagcagagaaatgaaaaattatgttcacacaaacacctgtacatgaatgtttataatagccaaaaactaggaaaaaatgaattttcttcagtgtgtgaatagctaaacaaactggtacatccataccataggattctactcagcaatgaaaaggaatgagctattgatacatgcagcaactggatggatcttaagggcattgtgctgagtgaaaaagtcagtctcaaaaggttacaaactgtatgattatatttacataacacccttgaaataataaaatgatagaaaggaaggaaagattagtggttgccaggaagtagagagaggggagcagaggtgtcagtgctataaacgggatccctgtgatggaactcctgtgtgttttgactgtggcagtgtcacacggctctgtacacatataataaaatgaatacacgtgtgaaaaatacacaaacgcatgcaagtaaaactgatgaactctgagtaagattaatgaattgtatcaatgtcaatttcctggttgtgatattatggcaataattgtataagatgtactattaagtgaaaggtatatgaatctacaattatctcaaaataaaaagcttttaaaatgtagttaccatatatacatgagtaacccatggaaaaattgaaaaatagggagtaaaattattttccacaagatgttaaaagtagattataaataatttgtagaatttttacatagctattgcttttattatagcagagtttttaatgccttccaactcttctaaaaggccctggcttttaatagaaaatcttaagtccttagtggtccttccctgacccagcccctacgtcccccttcagcccttctctttccactcaatcgcagcaggtcacatgccagccataccaaactccttattgtttccaaacatgctgttccttttcatggttccatatttgcacatgctctttttccttcccccaaaacatcccttacattcatgtgccatttctaaatcttacttaatgtttaagattgattaaattagactcccttagaaacctttgcctgaacctcctctgtatccactcagcctgatttggcatttagcatgctaaattcggatttttgtttccttgtaccccaactgtgagtcccagccaaacagggacaaactcttataatctgtacacttgaagtgtccagctcagtgcttacgtatatggtaggtgcgcaatcatatttattgcacttaattgtatttagttgctttaaagtaaattttgaaggaatagactgagttgaaatacatacactttatttctaaaacttttctttatgccatttaataattctaaactaatttaagattcttacctaaatatttaaatattagtgcttaggattaggacttactttcatttggagcatatttttttttggaacctcacaaattcccatctaaaaatcccaaagatttacagtggcttgttttgaatattaatatttccagcattacattaagtttttttatctcttacttgaactttccttcaatgaaaatcattttcttgttaaaaatgtcttaatgccatttattggaattctaaaattaaattattatagtaacataaaactaattatttctttccctttgttaacactgtagctttttgaaagattgccaagttattttgaccttcagaggaggctgatgattttagaagaccaaataagctatcttttaggtggcatacaagttgtttatattgaagaattacagccagtattgacacttgaagaatattactctcttcttgatgtgttttataatagactgttgaaaagtagaatactatttcaccctcgaagtttgcgtggtttacaaatgatccttaacaggtaaatatctaagatagaaggattacttttattccttcgtctaggtgggttgtgtgtgtaaatgcattaaattgttttgtatttcaatgggtagttcttaggaattaaagaaaaaaatgccactacttgtgttagcaaccctcttctacacactagaaaagccagcatgggaggattgaaggatttaatgtctagaacattctttgaatatattgctgagcagatttactgggcaaagtcaatccaatggaaaacattataagattaaactaatagtaaatcagtagccaacatttgtggtgtatacactgtttgccgagcactgtgctgggtacttatatgcattctgtctttagctctcacaacctcactgtgcagcaggtcacccctggcatgtgacagataaggaaggtcagagggcttgcaagtaggtcgtgatcttctgaagaagtgtgtctttgggggcagcaaagctttaagtcaatgttgctgtacttttgaggtggcttttcttgatgatttttttttattttcctgaagactaataaaatattttctctggtgggggagaggagagggtcagtggtttttcctttaatgtatattttattgcagtgacagatatgctccaagcttgcatgaactcgggcattttaatattccaacactctgtgatccagcaaatctccagtggtttattctcaccaaagctcagcaggcaagagagaacatgaaaagaaaggaagagtaagtactgccagtcttctgtaaagtcagatcattcagtctaactgaaaacctcagatatttggaactcataaatatgggacctggaaacagtatgaagcttaggaaattgactaattattagatattccatatttatttcttccctacctaaattatattaccaccacggacctcagtttgagaagtacagcttcttaatataaaagtcaattcagaaacagaatgaaaaataagaatatcagcaaggaattttccagatggaaaagactgacaacaaggaaaaatattggttatttcttgattaacaggaatctttattgttttaaaattttcaaactgttgatataaaaagaactttatctgtatcttgattaagttgagaagaaaacttaaagtacaaaactcatcttaggcccggcacggtggctcatgcctgtaatcccagcacttggggaggccgaggcaggcagatcacttgtgaggtcaggagtttgagaccagcttggccaacatggtgaaaccccatctttactaaaaatacaaaagttatccaggtgttatggcggtcacctctagtcccagctactcaggagactgaggcaggagaatgggttgaacccaggaggcagaggttgcagtgagccgagatcatgccactgcactccagcctgaatgaaagagtgagaaaaagaaaaaaaataaacgttttaactattgatataaataaaactttatctgcattttaattaacttgagaagaaaccttaaagcaaaaaatcattttaggccgtgcacagtggctcaagcctgtaatcccagcactttaggaggccaaggcaaggagatcacttgagcccaggagttcaagaccagtctaggcaacatggtgaaaccctgggcaatatggtggggaaaaaaaaaaaaaattagccaggcatggcaccatgcctgtatcccagctactcaggaggctgaggtgggaggattgattgagcctgggtggtcaaggctgcagtgagctgtgatcacacctctgtactccagcctgggtgacataatgaaatcctttctcaaaaaaatatatgtatcattttagttcctaagcagtattgtttttatgttgtttgtatctttgaaggagtcctattatagccaacagtttcctgttttgtaggtggtaagatattgcttgataatgttttatgtatcacttgtgaagaaatgaagtcatttacttagccagcatttactgtgactgttacgtgcccaaagctgagatcaatgccattgatagaaagactcagacatgatctctgcctcctggaattgtttctagtaggagatgtgagtgctgtaaatttgccagtggtagctggagcacagtcaagtgggaagagccaaagctgacaccctggtagcataggggacaagggaaggcaacagcagggaacaggatggaagctggagagaatgccattccacatgtccatggagggaagtttcaaggagaagagaagaggacagggtgatggaacctggttgtttagcagggtgccagtggaagcagttctcccgccttaccgttcatttgaggctcagtttccacaaagtactcatttaaaaagccaggaatcttaaatatagagagaggctagatatggtggctcacacctttaatctcagcactttgggaggccgaggtgggcggatcacttgaggtcaggagtttgagaccagcctggccaacatggtgaaacgccgtctctactaaaaatataaaaattagctgggcgtggtggcatgcacctgtaatcccagctactcgggaggctgagacaggagaatcacttgaacctgggaggtggagcttgcagtgagccgagatcatgccattgcactccagcctgggcaacagagcgagactccgtctcagaaaaataaataaatagagagaagggatggcaactaacgatggaagccattcttttagcaagagacagtgagatcattttatatataaagtaaatgaaggagcagcatctcttttgttttcctgttttccttatggaattgatgacaactcggtaggccagatcctatcacaccctacctcttgattggttgttaagtatttgttcatgctatttcttttctaaattttacatctgctttaaccctcaagagcaattctagccaactgttcatcattaggactgattattttgtttgctataacctatcggctgctttttctctttttctctatggccattatatagctttggagtaatgcttattagattgtgagaaaggaaagtaaaaataaaaaaattcaaataggtcaatttgtgaatgttccgtcctaccagttgctcaggcgaataaaaacccatgaatcatcttgattcctctcccctgtctcactccctaccccagtccaccttcagagcagacatggaaagaaactcacctcttctcctttcctttcctgctgcacctggtctgagcctccatcattttgtgatggcctcttgtctggtcttcaggcttccacactcagcatctccccaaccccgcagtggactctcgtcagagcagcagtgggaacctagtcagagctgtcactcctctgcccagtgcccacagaccctctgcccactcccttgcttctctcagctcagctcctgggactctcctctcactcgttctgctccagcctttttatagtcctcgggcactcttgacatgttatccactcctgggcctgtgtgccttcccccagcctgaggcactccttcctcagaaatctcagcttcctcaggccctgctcacattccaccttctctggccacacaactcgaagcatggagtccccaccctctgctgcactcccctctccacctcagctggcctgcctttctccatccacctcagcaaatttgctgtttccttattaatgtattctctctctctccttcccaacagaaggtaagcccactgagggaagacttcagtctattttgttccctccggtgccaactgggatgggtgcctggcacacagggggccttcaggaaataccgattgacctttcacctgcttccttagcctttttctggctctgggccccagagtcctcatccctatacttagcccccaagaagagaaagcacttgctgttggtcccaaccttccttcctgctcagtcatcatcctcatgcccctgactctgggcccaggagcctctcctcgcctttgctgtctttccttcctttgctctgctgtccctgccctagtaagacaccttcattatattcgaagagcagtgatgaagactaacttctttccttcagtgaagcatgttcctagagagtggttttcagatactttttcacttataaggtggattcttaagtggaaacatagtttatttttattaggttggtgcaaaagtaattgcagtttttgccatttttttatggcaaaaaactgcaattacttttgcaccaacctaataaaaaagattaaagctctcagctgttctagttcaaaagaaaaggagccagaggccacccatgctcacagggtcctcacagtagcagctctgctggactctcagcttgctgaatagttagaaaaagggaaaaaacccacactattctaagctagtatgtacaacccacatgaccatcccaaaactgtgtgacttgtagctcctgtctcttggcattgcctggctggcatatagacagtatttgctgcctgtggaacccccagtcctttggaggctggtgataacctagttcacagttcttctgtagggtggtaataacccagagtaacctgcacctgagaatcaaccagctctccctagcaggggcattcctcactttatgtttttatagtaacccactcagatgtttccttttactctatatcatatatttcaaattttaaaatcacttaaataagttggaaacaatcaaaatgtacagtaatagaagagtgtttaagtagttctgatacttgcatgtagtagaaacaatgactaaagggtgggcatggtggctcacagttataatcccagcactttgggaggctaaggcaggaggatcacttgagccctggagttcaagaccagtctgggctacatggtgagacctcgtctctacaaaaaatttaaaaattagctgggtgtggtggtttgcacctgtagtctcagctacttgggaagctgaggcaggaggtttgcctaagcctgggtggtcaaggctgcagtgaaccatggtcacgacagtgatactccagcctgggcaacagcaagaccctatctcaaggccaggcacagtggctcacacctgtaatcccagcactttgggaggctgaggcgggtggatcacctaaggtcagtagttgaagaccagcctggccaacatggcaaaaccctgcctctactatagaaaaaacagccgggcatggtggtacatgcatgcaatcccagctacttgggaggctgaggcaggagaatcgcttgaacctgggaagcagaggttacagtgagccaagatcacgccactgcactccagcctgggcgacagagcaagactccatctcaaaaaaaaaaaaaaaaaaaaattaatctcatgctgactgcagaggcacccaaggatgaggaaaggctggtacacgttattttcctgttgaggggacaaccctgggcaaccttaacaagggctgccttctcaatgcttctctaagattgtacctcagaagaactgatgggttctcctgatataaagcttgtgacccatgggtctgggaaacctggagatgagactgtaggcttctcctaaaaggaatgaaaatgagagtcttgcccagattttaaagatatattgttggagaactatgcagcaacatggtcacactacaaggcttttcacttccaagcatggttgttaatatcttttcttgacaagtgaaaaatccctttacagaaaaagttactcatcccctgctattgatagaagtttaagggttctttctgtctaatcctggagagattagaagcaggcccagctgtgaaacatttgcagaaccatcagccctgactgctgtctgtctgcttgaatctctaagcagcatattctaagtaagaataatcttacagaaaaagcaaacagcacttaagaaagtgatcagtattataggccatgataactaactgctatgaccatttctgttttttactgtctagtttatggaaattttatagtacctacttttctatgcagtgtttaagggtgattaaatgtaagatatttggacattttaaaccaatgaagtattttaaatagactggttcagggacacgaccatggcagttttgctttattcacgttgttaaatgggcttgctgagtaactcatgtgttggtctagatgtagcacattgaatccacttatcaaaacactgtatccctaagcacttgccacctgtgggagaaagtatttgagacactgagttctgcctagagttgtatactttgtagacctgaactgaagcccctgatggaataagagagttgtaacctcaggcagaggggagggaacagacagggggctggtgaggtaggagagtaagagtgaagagaacctgtcctcctcaggatcctggttttctgtgagcctgcttttatctgggaaatctttagacagcattacttcccaagggttaaactttaggtgggtcctaaaactaggggttttatattcttcattttctccttccttcagtcactaacagctgctaggtaaggcaatataagagcttttttaaatttatgttatttttagccctttactgctaaaaacattaacaaatacttttagagatccatgtgacagtaactcaaaagatttaacaatgatggctattggcgtgtcttccaaacgtataatttggcctttgtgggtggcattttcagtgttgtgagtgcacagttagggccccaacatgtaagaatatatttacattgtgtgttcttttgtttggttatgacaatatttgttcttatgacaatatttttattttctatataataggttaaaggttattgaaaatgaattgatacaggcatcaacaaagaaattttctttggagaagttatataaagagcccagcatttctagtatacaaatggtggattgttgtaagagacttctagaacaatcactgccttacctacatgggatgcacctctgcatttcacatttttactctgttatgcaagatggagacctttgtattccttggaattggaagaatggagaagccattaagtaacacagaaatctgttttatttttttaagagataagaaaggaacttaaattaaaaatatttaaatccacaatttgatataacagtattatttacataagaacaaagtttctaactgctgctttaaaagtagacttttttaaaaaaattaatttctgctaggagaggttttatatgccaggcgtggtggctcatgcctgcggtcccagctacttagggaggctaagataggaggatcacttgagcccaggaggccaaggttgcagtgggcccagattgcaccattgccctccagcctgagcaacagaacaagaccttgtctcaaaaaataataatgataatttaaaataaataagtaactaataaaaagattttatatcccagtcttatgatgttggttggcaaggctagataaaaagatgttagaatgaaagaacatatttttagtgatatgtaaatgaaggattctacaatagtcatatatttttatatgaatgaatgttgggttgggctggagaggtatgtgtgtgtaaatataaaggtctcacattcagagtatagctctgaaataatggaactcatgtctacaattcaacatgcatctgtatagttacatctcatgtaaatatacacagacatattttgcagccagtaattgacagttaatgtccaaaacaggtgattgataggtaacagaaattagataaccaccaattttgcccaagagaaagactagaaggactaaaagcagttgaatgtatggtactgacattgtcataagcagtctgataaccagtttattgaaacgtgtgcattaacagagaatttaattttaaacccataatttctcctatccattaaaatattataattgttagtagtatgaaaccaacaggaaatgttttttaatcatttagtgaggtgattcatttgtttcatgggcaaacactatccaggaaaagccttgcttgcctgtttcccaaagagctctaagaaatagaatcaagtgtaaaatggttcagaccattcaggatttcttgtcactcttctcaaccacgatcttcctgttattactgatgtttgaaaccctgtcattagccccggcctggttaaagcccctcagagtcacctctcattcatagcaatagaattcaaccccaagtggttgatggtgtccccagcacagccgagagacctgatctctggattcagtgcttttagctcttcgagtttaccctaagataccttcgggcaatatttttaaccaacccaaaagctcttcaggtcatttctgaagaggacaaggtgaatcttggcttggaacaccatttttgggctcttgctactgaatgaatcagaaaggaattttttctgaagagcattagaaagtaaaagagatgttaaaataagttcttgaagtatgttttatatttatctaaaacactgattttaaaagtttacattcaaatgtgtattcaaaagaagtactgatttgtaattattatagtttgtgtgtatcatcccttttaaccgtgcctaacaactgtacttaaattttgttttctagtgtaacaaatgtttcccataagattttctagagccaaataatgggagtgaaaaattccttaagtgttatataagaaaatatattagaaaatcagctttggattatacgatttctaaaatatactaatacagaatcctcagtaatatgttttgaattggattttttctcagaactgttacataataaataatacatcaaccaga

SEQ ID NO: 91 - DNA, 17817 bp, Homo sapiens
ggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatgtgagtttcccagcctggccccgtaccgccgggtcgcaggcgcgggctgggcttccaggggacgggttggtggcagaagagaggggagagctccgcggaggacttggtcatctttttcgagttgtgctgccttccgtgagttgggaatgtggattgtaatttggggacttgagtctccaactttagtttcttaagctttaaagaaaaatccggtcgtgctggtgcttttatgaattatgcgggttttcctttgtcttcgtggggatgtgagtgctttacttctccttcctactgccgcctcccgataggtttcgcgcccctcgtccccctcgccctccgcccctaatgtatctgtacagtttcagggaacttttctccgttgcgtctcggatacaccctaccctcagtgaactacggcgctgcggaagggtccgtactgtccacccttcccccagcgtgattagagagcggagtggccccagctgcctccacgtgtctcttctcctgactctcctcttcctcccccttccagatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggtaagcagcctccctgtcctcctgacctagtcctccaggtactcactgctcttttaataaggtaggatcttacagaggacaccagcccctcccagcctcccggttggggtttttctcaggcatttctctttggttgcttcaggcctagtgggctgggaagaacctgggggtactgagatgcaggactgtcaatgctgggggttgagagctttggaaccttgtgcttgtgggctttgaagtgtgctgtgctggagagtcagctttccctgaaagagcttttctgtttgagtcatttgcttggctgcctgtcccacccctgccagccacaaaagaatcaaacccctctacctgggaggcatgggaacatggtactaaaccattggctttctagggtttgtgttgagcaatcataggctagcacaagggaaactactcagggagagagtttattggaaagggaggagagagctcattggaaagagaggaaaagagaggttgttatccacaaaactattttgacctgaccccttggccagaccaggcttcttcgttacagaggaagatgaagctcccgtgcaacccaagtcacacaggtgtgtgttgctctgttactctacattccagggtgctgcacataccagtcaacaaaatgctcttagaatgaaatcaggctgaagatatgtttcatgttccatcccccgtccagcctgcttcaggcccccctactgatgccatgaagtgccaagaattctgcaccttccaacaccagtcctacccatccctccttgccagggacatcgaggccaggccagaaaagagagcccggtcttgaggctgctgtaatgagggagacagttcccagtttgtccccgacctgcccttagctcagctctttcagggacctgttggtgtggcctgatggcatggccctgccccctggatacacacatgcgctttgcaggctttttcacctctgtcactatgagcctaagttgggaagggaaagcagggagctctgcagatccaggggccctgcactgctactctctaaggggtggtgagccaggacttctggtgtgggaaactttctgacagctcgctcttgaagggtagttatgcagaagggctggtaggccaagttttagctgtttccctcaggacctcttaggtcttctgaagatggtgagatctggttcattgagcttttgtttccagaaatcctccaggtgctacagtgaaatgcaactgagaagagcccctttgtcaggatctcagtttttctaggtaccacctgtgggcaacagtacttttttaggatggggaaggtagcattccttgggttacatatgtgtcacagccgcagagacagaacaggccaggtgcagatcagttcatctgcataccaggaagagctcttgtatttgtgaggggagggcgacatctgttgtctagcccctctgaggatccagcagaacttcagttgcagctgagggatgaggagcagggatagcattccccaggcagtctgtggatgcctctctccaccctttctccccaagaggatagtcttcacaagtagttttctctcctgcaagctccttccagcctcagcaccccctgtaggtttcctgaagcccagagtttgacccgattgcctctgcttggttatcctcagttgctactgcaaggagcagaattccatcccaaagtgaaggctgtgcctgctacatttttttggtgacctgcccatgggtgtgtgctgtgcccttgggcagataaatgtggctcacagagactagatggtaacttattttactgggccctttggtggatggcttagctgaaagaatgaccatgtcgatgtggggatatcagaactcctctgtcttgagaaacaaggagggtgaggggaggagggtcagaggtctcaacttggacatcttctcttcccaccttcagaatttaggagcttcacctttcttgttttaatccctatggacaatgttaaattagcaactggtcgtgattccagcatttcttatgactgagcacttttgagagccttaaatctctttcattttggagtctcccaaagaagcccttaggagaatgcctctggcaacactgagagccagaggcaaaaccattcaagtctctttcttaaggccagagcaatgagatgttgcttaaccatcaatctggacattttcctcccctggggaggagagaaggaataaatctccaactgatttaagcccttctatttgataggcttagaggtgtttctagaaaaggcaccagagtgcctgagttctttccccaatttccctgttaatataggatcttatatacgttctgagtcaacactgccctagggtcttgcagcaaataacaaccctagaagctcccttgctcattagagagagctctggctcaactgatggtttcccgagtaagatgcaggtagatactgtatctggggagatgtcagtcaccacttggcttgagggcagatcacctggggcctcagtccccactctgagggaatgtggagagagctcttgttggggctgactggctctgtggctctcctggagatcttataggaggaatagaagagaagaaaggaggtagggttggggggaaaaggaggttgtttaggaaacagctatcaatggctgcaaaagaacacaggacaatttgttacaatgtgtggtgtctccaactgcaactaagttctgtggccactgaggatctattgtttctagctgtttccctaggaatgaaacattgttaagagtttctatcaaggccacagcttctgcctgctagagctactgaacagaggaagatatggggacgcccagcagcccacttcccagttagagattatatctggcacctcctgagcctgcaggcctccaggaaggtgagggaagacaatggtggggtgcttcactgacagcttgaagaatatcccaccattgtctagagagcgttgcccggtgagagtatgggctgacagggatgtggcaaaggcgagacagaggagttgtgcatgtatcttgggggaggtggatggtatagctggaacgtgaaatctttggtaaagcttaagacactgtacaaattggatttatgcacagggctaatttttccctgatttggccacactgactgcttgaatatttaaatgcttttttgtaccagttgataaatggccatagtctgaatgccctaagagtcccctacaactaagggcttctcaaattggtcagtgcccagattgtactggctgttattttattttttgagataaggtcttgctgtgttgataaggcttgagtgcagtggcgcgatcttggctcaccgcagcctcgacctcctgagctcaagagatcctcccacctcaacctcttgagtagctgagaccacaggcaggtgccaccatgccaagctaatttttaaaattatctgtagaggcaaggtctccctatgttatcccagctggtcttgaactcctgggctcaaggggatcttcctgccttggcctcccaaaatgctgggatgacaaagtggttcatactacacctggccctctgctgttattttaataacaccctggcttatgggttctgagctctgcaggagtagtttgtggcccttaaaaccttagagaaggcctagatagaggtgaaaggagatagctaggccctgggagaatgcctttaagatgaagaatgagtggtaagagcactattctctctcctgcctttctgactccttagttcctgggattctttagcttatctttttttcctgggttgagaggttggggggtgatatttttcaagtggtaaaatctaagggatgtggttatccctagagttcatggtaaagccagttctcacccaaagcctgacgaagacagtttctagcatccagagagtgtctctggcatcctttcccagatggaactcacactgattggtgactcccccactgtcttctcctggcaggggtattctactattttgtcagtgccctgggcataacagcaggagctcatcgtctgtggagccaccgctcttacaaagctcggctgcccctacggctctttctgatcattgccaacacaatggcattccaggtaagaagttgtctctgctcagctgtttgtcctccacactattaatgatccggggacagaaaggagggatcagcaccagagaggagccacacctgacagccatttcactttcctctctcctgtagtcacctcaagttccagttcagtccttaagtccataaagcatgaagagacttctgagtcttggaaaagggaactggaagataattggaaaatactcctgatgtgtaggaatatttttgatcctaaggtccctgtgttgtcacacaatctggccgttgtggctcttcatcataaggggctttggcacataagccagagactgaccttagattcctgggcagacactggacaataaattcactatttaaggtaaatatcttagggaggcagagctgggaggatcactggagcccaggagtttgaagctgcagtgagccatgatatcaccactgcactccagcctgggtgacaagaccccaactttaaaaaaaaaatttcaaaagtgaataacttaggactccaccacagtgggattgaagttgatgttcccagactcgtgaactcttattttgagataatgagagcaaacacttttattgcactgactatgagcctggcactattctaagcatttgatataaagtcctcacaaaaatcttaggaaataggtactattatccccattttacagatgaggaaaccaagttacagagagattagatagaccagcccaacattgtggccctttcttgggctgccatggtggctaagtaaaacattgaggtttgttaaggcaaaaaacaaacctgggcacggtggctcacgcctgtaatctcagaactttgggaggccgaggtgggcagatcacaaggtcaggagatcaagatcatcctggctaacacagtgaaactctgtctctactaaaaatacaaaaaattagccaggcgtggtggcgggcacctgtagtcccagctacgtgggaggctgaggcaggagaatggtgtgaacctgggaggcagagcttgcagtgagctgagatcgcgccactgcactccagcctgggcaacagcaagactccatctcaaaaaaaaaaaaaaaaaagtttatagcaaagacagaatgaagggaaatggggaaagggaatgcatcatagtcattaagctgtagcaatgggcaaatgatagcatgtggcgtttggcttagcttggagcaagaggaagaaaggaaaccaacttagtggtggcaatatcccaagaacttgccacatttgcatgatcatctctgccatagcagcttataccttgaaggcttccaaagttgtcctgtggagcaaaaggaaggaagagagatattggtacattctttaagggatggaaaaagtcatgaagaagcccagaggtcgtttgaaaatgcagtcatgatcacgagttgcatgcctggccttgttattgggttgtatgagctcttttgcaaggcaccagaatggtgcaccctgcagctgcagcttatctactgattgagaccctaggacacaaggctgcctgcctcatgttccccatgcctagggattaggtaccccatgaggatcttttccaacattccttgcttaaagaattgcaatgttctcacttcttgaaactctctgagctctgtatgatttacctccgttccacccaccatataactttcaagaaacagcagttctattgctatggtcctgggactttaagttgcttttttctacttaagcttcagtggcaagttgggagaagaagggaggcaactccatgactcctttggagcccagattcctgggtattttgtgaggttgggctgagcgccttgggctcttgatacctgtccattgggattctcctaatagggtgtctatcctcaagccttacattcctcttctctctctccccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtgagtgaagccctgatggaggtggggatatggccctggcacctggtcattagggaccccattttttctcctgagactttcaaaatataagctgagaaatttgctgggtttgcatgttcacaatcttaatttaaaatcccaatttttaacatcccacgggcccgtagccatagactattgctccatttctttctctctgactatcttaattaaacccattacattcaagagatgtttattgtcctaggacagtcatagattcaaagatgattatagcctagttgcctaggtttgtttgtttgtttttgtgtttgtgtttcaacagtctttctctcttgcccaggctggagtgcagtggcacaatcatggctcactgcagccttgacttcccaggctcaagcaatccttctacctcaacctcctgagtatctgggactacaggcacacaccgccatgcctggctaattttttgtggggacaaggtctcactcactatattgcccaggccggtagcttagttcttaccttcaaaaagtttgtagcctatcggggtggagagataagccaagtatccagataaccatggcataaggcagaatattttctgtactatgagaggtacaaaggggagggagattgctcaatgggcaacaccaaggaagtgatatgaaataaatagtgttggaatccaccaacggatagaaatttttacaactatgtgtggggagagacagtgcaaacagaagaaacagaatgagctaaaacacgaagcatgttccagcaatagagtccttttgcttgaagtatagggtatgggaagaagtaagactggagagactaatgccattcttgtcgagtcctaaaagcagacttaggacttaattcaataagcaataggaagccattacatcttttgaactgcaatgtggcatagttacggacgtgctttaggaaggctgcttttagaacaagtgtaagaaaccactgagccaaagtgagaggtagggacataagttaggtaatgaggacccctgctagcgaagcagtggcagaaatggagaaaagagttgggtgcagggaatgtcagtgatgtaaaagtcaaagacttgactgctgaaggaatgtagggaatcagtgcccttggaatgtcaatggcctggtctacattgagaatgaagactgagaaagggcttcctgagggacagagagctgcaggtgatcaaggacactcaatgggtctctgagggaaaagaagaccaaagaattagggagtagctagcagaaaatggaggcatgacactaaacacagactgaaaaagagtgctgattagaaagagaaaggagcccaaaggcagatgggaaaaccagccaaggatggagagacgtctgttcattagtttgtagtttggacctcacctatcttaccaatgtggtattatgctctagtaaaaagtcagcgatggccgggcatggtggctcatgcccgtaatcccagcactttgggaggctgaggcgggaggattgctggaaagttcaggcattcgagaccagcctgggcaacatagtgagacctcatctctacaaaaaattaaaaactaaatgggcacgatggttcatgcctgtggtcccagctactcaggaggctggggtgggaggatctcttggcccaggagttcaaggctgtggtgaactaaggtcacgccactgcactccagccttggcaacagagtgagaccctgtcaaaaaaaacaaacaaaaataaataaaacaatgaacttagagtcagacaagcaattcaacatggaagaaagacagcccatcccctcccaattagtgtggaagatccatgtaggtgtggagtccccctccattgacctggtgtctggtctgtcaatgtaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtaagtcagctgtccaagtaagactacatccagtggtctgctgattaggggattaggctaggagccagaaaaactagataaatctgttttttatggctactttgtatctcagtttttccactataaaattagggggcagtatactggaaaacgcttttgagagtcaggcaacatgttttatgtaaaaatgaaaggataagaaacaaaacacaaaaaaacactgattttgattccaggttctaaaacaatttccaaatgccatgtatgctccgggcccggcggctcatgcctgtaatcccagcactttgggaggctgaggcgggcaggtcacctgaggtcaggagtttgagaccagtctggccaacacggtgaaaccctgtttctattaaaaagcaaaacaaacaaacaaaaaagaaaaccaaatgccatacatgatgagcaccttagagttttcctttctttcatcaactctgggctggactgcagtcttgcttgaggcaaggaatgcataaatagaacaatgggatcatctgagtggccagtaagcctggtgttttatgaacttcaagtatgcacacaaagtattttttatctttccactctactcagatatgccttgctttaagagtgtgccgtgccttactgtttggtgatgccattatgaagggcatcaaaataactgctggtggccctttactaccacctaccctcttgtctcctcttgtcctctatttttctctcttctacttctattctgggctaggaacatcccttcccccaacatgccttcaggaatctcccaataaagcagtgtgatcacaagttcctgctcaattctctaatgttgatcttatcttttctcttttctttcctttcattttctttcttttcttttcttttcctttcttttctaatgagacagggtctcaccatggtgcccaggctggtcttgaaccctgggctgaagtgatcctcctgcctcagcctcccaaagtatctacatttttttctctgtccctctttccaactgaatatagactttcaccaaggccctgaatgaattttccttaaatagatctggcgacctcttctttccagtaattggtgctattggtcattcaataatatctagacaaccacactactccacacatttaggcaggtcattgcctaacactcattttctttttctctttaaaaatcttcctttatattctcaaccttaaccatctttattatcttttaaattgttgttgagacagtctcactctgttgcccaggtttcagtgcagtggtgtgatcacagctcactgcagctatgacctcctgggctcaagcgatcctcggggttcagcctcccaagtaactgggattacaggtgcatgccaccatgcttggctaatttttctatttttttgtagagacatggttttgccatgttgcacaggctggtctcgaactcctgagctcaagtgatcttcctgccttggcctcccaaagtgctggaattataatagccgtgagccactgcgcctggcctactatgtttattaaaaggatttattgcctgtaatcccagcactttgggaggccgaggcgggtggatcatgaggtcaggagatcgagaccatcctggctaacaaggtgaaaccccgtctctactaaaaatacaaaaaaattagccaggcgcagtggcgggcgcctgtagtcccagctacttgggaggctgaggcaggagaatggcgtgaacccgggaagcggagcttgcagtgagccgagattccgccactgcagtccgcagtccggcctgggcgacagagcgagactccgtctcaaaaaaaaaaaaaaaaaaagatttatttgtctaggcgtggtggctcacacctgtaatcccagcactttgggaagccaaagtgggtggttcacttgaggtcaggagttagagatcagccaggccaatatggtgaacctctgtctctacttaaaaaaaaaaaaaaaaaaaagtacaaaaaacttagccaggcatggtggcacgtgcctgtagtcccagctactcaggaggctgaggcagaagaatcgcttgaacccgggaggcagaggttgcaatgagccgagattgtgccactgcactccagcctgggtgacagagactccatctcaaaaatatataataaaaataaaagcattttttttctctctttttaactttcacatatctcttttcaggcaccttcttaccattgtgcctattcttactttaacccatgattaaaataaatcatatacactgtataaatctgagattatcataggaatggagtttctggcatgagatgtttcctgtatcgcaaatggatctataatgaccttccccacctccagcctctgggtggccatgagttcaaagtggctgccaatatctgacctgttgttgttatcattcactcctccttgcctgctgctttcctcccttatcacctcaccctttgttctcctccagctctgtttcctgccaccctaatctttttgtttcttgaattacctcccccactgtcacatgctcatcttctctgccaaattaaccttctcccttgagcctttcttgggctgtctcttgctgccccagttgcaaagtcctgtcttctttctacccgttgaccctcttctttttttttcctcccttgtctctgtgtgcatctgattccattttaaatctggtaaccaaaggcctggctagtgcttacacacagcccagctgcaaaaccattaatggacattaataatcctcagtacctttattcctggcattctacccccctcctccccagttcacactgcagatcatcaggtgtcacagagagaggacataccttgaaatgccctagatgatgtcatttactttgcaggacttccttgccttgcttctgattaatgtcatgactggtctgtctgagggtactgttatctacaaagagccaaatattagctcttagtagctattctttatccatgcctgattagggtcagtattatttttggctgtggttcagaaagaagagtcctgccaagcgttggcaaactctctatctgtcgagtttccaaagctttacacgttagagaaattgctgtgaatccagaatttgtttgttttcctccctccagcaaagtgaaatgttcatcccaagagtcctcaaaatctcagaggttacagggtatttttcttcctcagagagcttctgttttatcagcacctcccccacaccagggtcaaagctcaaaaaagttggagcagcccctgggaactgcagtggctgaggacattccagcccctgggctggcctttcttctgatctttggctgcagggcccactcttttggaacctcccacccctagaggtggttccagtgtggtggggaaaggtgtgcttctttactcatttttttaagagtcatagccagagtgcttcattctgcaaggacgtgcacatgcacatgcacacagagccttgagggcagggccaagagtgaatttggaattttccaacctgatacccattcccaaaagtaggagcttctctctagtcattttatcctctgagaaactgtcagttctcctcccacaaggctcccagacagccacgggtgaccagggtctccaatcactccttaagatgcctttgactggctgggcgcagtgactcatgactgtaatcctagcactttgggtggtcaacgtgggagggttgcttgcaacatggcaagaccccgtctctacaaaaaaagtaaaataataaaagtaaagatgcctctgaggggatctgtttggttcatattaaaagagactgaattcatccattcaacaatagcgagtttctcccaggtgtgaggtaccctgctagctaactggtgtgcacaaatcaagaaaacctcaatgcaccgtcactccataacttctcgcttttgtttcaggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttttgggttaaaagatggttgtagcatttaaaatggaaaattttctccttggtttgctagtatcttgggtgtattctctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgattgca

SEQ ID NO: 92 - DNA, 726 bp, Homo sapiens; identical to SEQ ID NO: 78

SEQ ID NO: 93 - DNA, 14792 bp, Homo sapiens
tgcgcaggcgcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccaggtgcaggccggcgggggccggcgggggccggcggggcgggcggcggtccgcttggcgcggcgcgtgggcacctttctccccgggcccgcagtggcctcccacgcgcgcgctcttcatccgcgagttcaggtcgcaggaggggaccctctctctccgggctcgggcgccctgcacccgaggagtgggttgttaaattgcagcttgtgcagctcagcaggtgcgcgtggggtggagtgagcgagcccgcgagtgcttttatgtaacttaaggtgcagagacctacctgctgccctgtctcaggtcaaaggccccgcagtgacgtgggtggggctgggcgcacaggcccgggtgccctgacctcataaactaggcttaagcagttttcctacagccctgaatagtaatcacgaataataataataatgacagctaaaatgtaggtagcagttagtcttaagtgttttacgtgggtaatccttactgcagtcctaaaaggtaggtactgttatcccctggctgtagatggggaagcaagctcagagaggttaaataatttgggaggccacacagccagagagcggtgggtgcagaatttgaacccaggtcgcccacttctccctttcaacctcagcaaatcggctctatctgcttgcctgtgggttgcctattccgggaaggtcagcagcccagatctgtactctgaggactgtgaatgactgagcttctcttgggttcctttcagatagccatccgagcttgtttcctggggtttgtgttcggctgcggcacgctgctaagttttagccagtcttcttggagtcactttggctggtaagaattccttcggaaatactggttttcaggcgagggtggacagatcagagggtctgtagcggcatttcctcatccctgtctcatctgtgaccggcagaaggctgttcagggttctctggaaacgaagtctcctggcttccccctagttgctcacatttcagcccttgtgatttcgtgcctgtgggttgattgtgaatcaggcagaaacagatctccctggcacccccaaaggtgctgtcatccgcagctgtggtgacagcattccgtaacttgagcagcccttcccggaaggggtgcaggtcctcggtggcgggcaggggcagggctctggcttgtcttcatgggcctttttcatctctaatttctattaggtcacatctagtgcatccccacagccactgtaggatttttccctacactatgatttcagtcccttgagccttctagtctgacctggatatgaaccagtggcttcaaggtaaaaagttttatctcctcttatcaatattttgagccatctaatccttctttgccggaattatttcagttttgttaaattttgtatccgacatacatcactcctttatgttgttatctccctctttcatgttttattgtgtgtagtgtcatttttaacggacagaagggcccataatgcctctgtgacctatgggtttgttttgcctgtgacattcaaaaacagtcccttgccgggcgcggtggctcacgcctgtaatcccagcactttaggaggccgaggtgggcagatcacgaggtcaggagttcaagaccagcctggccaagccaggagttcgagaccagccttgccaacatagcgaaaccctgtctctactaaaaatacaaaaatgaactgggcgtggtggtgggcacctgtagtctgagctacttgagaggctgaggcaggagaatcgcttgaacctgggaggcggaggttgcagtgagctgagatcacgcagttgcattccagcctgggcgacacagcgagactctgtctcaaacaaaacaaaacaaaacaccagaaacaaaaacagccccttaaaaactccactttttgcaaacctgaggtagtagatgctgcagatgggtacctgtgtccactctcagacaggtgagaacagggcctcatagacttagggacagctcaggagacccagatgtgcacttatggttaacttggttctcttgtcccaacttaactctctttttgtctttaaataggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccaggttcgtgtgccttatgtccccctctggaggggaaaagggtggctcccattcaggctgaggacagtgacattgattcacctttcaggtctaatctcccccaagcgattttccgcagacctctatcctcactaagctatttataaaggatgagctccgctcatgaattctgcctctggatattgactcgaggacgtgctgaccttttgctttaaagtttgcatcacatagtgcaccatctaatttgaagccccaaccttgagtagttgtgattctaattttataatcagatgatatttagacgtttcatgtaagagtttactggccgggcacggtggcgaacgcctgtaatcccagcactttgggaggtcgaggcgggtggatcacaaggtcaggagttcgagaccagcctggccaatatggtgaaaccccgtctctactaaaaatacaaaaaagccaggcgtagtggcacatgcctgtaatcccagctactcgggaggctgaggcaggagaactgcttgaatccgggaggcggaggttgcagtgagccgtgatcgcgccactgcactccagcctgggtgacagagcgagactcccatctcaaaaaaaaaaaaagagtttactaacaaggtcgggtgcagtggctcacgcctttaatcccagcactttgggaggccgaggtgggtggatcacatgaggtcaggagtttgaaaccagcctgaccagcatggtaaaaccccgtctctacgaaaaatacaaaattagccgggcctggtagtgcatgcctgtaattctagctacttgggaggctgaggcaggagaattgcttgaacccaggagatggaggttgcagtgagctgagattgtgccattgcactccagcctgggcaatgagagtgaaactccgtctcaaaaaataaaagcctccgtatgtggaatgcactctgaaattgaatgtctcacagccaatgaaatgaaatacatgtggctcctgggattcagggtggaaaccttggacccttttttgcttctcttagctatacttgtccccagatgaaggactgagcatgtggccgggggtcgtgaaccagagagcccatcagctgtagcaggagagcatctctttaccatgatgctttcattgtgcttattggtgttttaaagtaaattgatgaacagcataacttaggggaatgtgttttcttatgaaattttaatgtgatgacaaatgctgattgcccagcagcacattttctgtttctgtcttcgggaaaataggttaattttaagcagtgcgaaggggagctcaggccagtgttttcactccccgtgtgtcgttgatgtctctctcccacagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtataatattaaatatgacactgcttttcttttttttttttttaagtaacattttaaacgtgatattcacgtagcataaaagtcaccatttcaaaatatacaattagtggttttcagtgtattcatgaggttgttggtctcctttaaataataggtacatgttcttcttggcgcgtttcaagtgataatttaataaaagtcaagagaactaatgtagtccttaatgcttttcactatgtgcccagaacctgggtgcgtaagtccttggtgattcttggtgctgttagctacctgctgtatcccttcatcctgtttctgcctctgtttgtttgttttcttttttctttttttttttttggtagagacagggtcttactgtgttgcctgggcaggtctcaaactcttggccttaagtgatcctcccacctcagcctcgcaaagtgctagcattataggcatgagccattgtgcctctccctttctctgccccttcaacctattaatagatctgaagcaccccagagggggtgaggacagagatggggcttagggaagggagtgccctctgtcactcatgtggcagcttggctagttttcatcagaaataggtattaatggggccgaggccatgtgttagtgagctgtgtgagccatggaggtttgttctgtctcaggctgaagaaaaggccttgtttcgtttcttttcttttctttctttcttttttttttttgagacctagtcttgctctgttgaccaggccagagtgcagtggtgcgatcttggttcactgcaacctctgcctcccaagtagctggaactgtaggcacgaaccaccatgcctgactacttttcgtattttttttgtagagacagggtttctcgagttgcccagagccatcttgaactactgagctcaagcagtctgccttcctgggcctctcaaagtgctgggattacaggcttgagctacagtgcctggccttttttttttttttttcctttttgagatggagtctcactctgttgccctgttgcccaggctggagtgcagtggcatgatctcaggtcactgcaacctctgcctcccaggttcaagcgattctcttgcttcagcctcctgagtagctgggactacaggcgcccgccaccacacccggctaattgtttgtatttttagtagagatgaggtttgactgtgttagccaggatggtcttgatctcctgacctcatgatctgcccgcctcggcctcccaaagtgctgggattataggcatgagccaccgtgcccagcttttttttttttttttttttttaaagacaggatcttgctgtgttgcccagcctggagtgcagtgttctgatcatggctcactgcagccttgacctcctgagctcaagtgatcctcctacctcagcctcccaagtagctggaatacattacaggtgttgccaccacgtccggctaatttttaaattttttgtagaggtggttctcctggacggttgcctgtaatcccagcactttgagaggctgaagtgggtgggtcacttgacatcaggagtttgagacaagcctagccaacatggcaaaaccccatctctattaaaaatacaaaaattagttgggcctggtggcacatgcctatagtctcagctactcgggaggctgagacctgagaaccgcttgaacctgggaggtggaggttgcagtgagctgagattgtgccactgcactccagcctgggtgatggagtgagactctgtctcaaaaaaaaaagagatggttcctcctttgttgcccatgctggtcttgaactcctgggctcaagccatcctcctaccttggccttctaaagtgctgggattaggccaggcatggtggttcttacttataattccagctagtcgagagactgaggcacaatatttgcttgaacctgggaggcagaggttgcagtgagctgagatcacgccactgcactccagccagggtgacacagcaagaatctgtctcaaaaagaaaaaaagaaaaagaagtgtaaggattataggtgtgagccactgcacctgctctatgtgtgtgtgtgtgtgtgtgtgtgtgtgtgtgtgtgtgtgtattttttttatttatgtatggttttttgttttgttttgaggcagggtctctcacccaggctatagtgcattggcatgatcatggtttactgcagcctctacctcttgggctcaagtgatcctcccaccttagtctcctaagtatctgcccaggctggagtgcggtgtcacaatctcggctcattgcaacctccgcctcccgggtttgagtgattctcctgcctcagccttctaagtagctgaaactacagatgtgtgtcatcacacctggctaatttttgtattttttaattaatttatttttttgagatggagtttcactcttgttgcccaggctggagtgcaatcatgtgatctcagctcactgcaacctctgcctcccgggttcaagcgattctcctgcctcagcctcctgagtagctgggattacaggcatgcgccaccatacccggctaattttgtatttttagtagagacggggtttctccatgttggtcaggctgttctcgaactcccaacctcaggtgatctgcctgccttggcctcccaaagcgttgggattacagacatgagccaccatgcccagcccctggctaatttttgtatttttgtagagacggggtttttccatgttgcctaggctggcctcgaactcctgcggttgagtgatctacccgcctcggcctctcaaagtgctgggattacaggcgtgagccaccacatgtatttctttttctttcttttttttttttgagacagagtctcactttgtcgcccaggctggagtgcagtggtgcgatcttggctcactgcaacctccacctcccgggttcaagtgagtctcctgcctcagcccccgcgagtagctgggattacagttgtgcactacctcgcccagctaattttttgtatttttagtaggtttagtaggggtttcactgtgttggccaggcggttctcaaactcctgacctcagatgatccacccgcttcagcctcccaaagtgctgggattacaggcgtgagccactgcatccaacccgcatatttcttttttaaaattactatttggctaggcacagtggctttgggagaccagagcaggaggattgcttgaggccaggaattagaaaccagcttggctggccgggcatggtggctcatgcctgtaatcccagcactttgggaggctgaggcaggcagatcatgaggtcaggagatcaagaccatcctggctaacacagtgaagcctcatctctactaaaaatacaaacaattagcctggtgtggtggcacgcatctgtagtcccagctacttgggaggctgaggcaggagaatggcgtgaacccgggaggcggagcttgcagtgagccgagatcgcgccaccgtactccagcctgggcgacagagcgagactccatctcaaaaaaaaaaaagaaaaagaaaccagcttggccaacatagtgagaacccttctctccagaggaaaaaactaaaaatatatctggaagttgtagtgtgcacctgtagtcccagctactcaggaggctgaggcaggaggatcgctttgattgctgctgtactccagtctgggcaacagagtgagaccctgtcttaaaaacagaaaacaaaattatttatttgtgtattaaagatgagatctcgctgtgttgcccaagctagtctcaaactcctgggttccagcagaccttctgcttttgtctcctgagtagctgggactataagtgtgcaccaccatgcccagctaactttttgttttttgtagagatggggtcttagtgttgcccaggcagattttgaactcctgggctcaagcagtcctctcactgcagcctctcaaaatgctgggattacaggcatgatccaccatgcccaacccaaagccttatttcttttttttttctttttgagacagagtctcgctctgtcgcccaggctggagtgcagtggcgcaatctcggctcactgcaagctccgcctcctgggttcacgccattctcctgcctcagcctcctgagtagctgggactacaggcgcccgccaccatgcctggctaaattttttgtatttttagtagagacggggtttcactgtgttagccaggatgatctcaatctcctgacctcatgatccacttgcctcagtctcccaaagtgctgggattacaggcgtgagccatcgcgcctggccgccttatttcttgaaactgtttcttgattctttactcttggtcctagaaaaacttggccaaagaatgtgaatagatcttggaaaattcacgaagtgtttgggaaaagtctccaagtctttgggcaaatccagagatctctcaggcatcccatcagcaatgcatggtccttggtgactctggtgacccctaacggtataggtggggcaaatgatcacatagcatttacaatttttgtttctgaaacatgtaaaaccgccacattaacaatcaccttccctgggaacaaattagttatgactgaataatgtaatttgccataaatgcttgcttcctgtatatgtgtgtgcactagaaccaaagggttttccatacctttttgcccatagattttttttacattgtgctccagcacttgtgtgtgtatgaaaggaacatgtctttcctgatataatacttacacttactgtttacaaaatcctgttttctatcttattatttcaatactgttcataatgtactaaatgatttcatggcttagtaacaggctgcagcctgctatagagaactcccactgtagggtatccccagcaagctatgccagatgtgagggtacaggccccggagtcactgactgggccagtcctgattctgacattcactgcttggcctccttctcctctcatgttaaagtgggggcagctagacatagtggcacatgcctgtagttccccctactctggaagctgaggcaggaggatggcttgaggccaagagttcaagtccagcctgggcaatatagtgagaccctgtctttaaaaaataataaaattttaaaaaaaacaaagtggggatagtagcgtgccctcaaaggtttgccatgagagttgaacagggtaatgattgtaaagggcttagcatggcgctgggaacatagtaagtgctcaataagagaaggtgtgagaggtcaggacatgagcctggctctccgggtggctgtattggagcctaaaatatatattcagaaaacatacagaaaatgtatgttggggaagatgcacatccacaggggaccagtgggcaggtgtaggtgagtggttccctgaggagctggggaatgcttttggccttgaaggactgtttggctggagatcagtgggaaggatgttctttgttttttttgagagggagtttcgctctgtcgcccaggctggtatgcagtggcgatctcagctcactgcaacctctgcctcctgggttcaagcaattctcctgcctcagcctcccaagtagctgggattacaggctcccaccactacgcccagctaatttttctatttttggtagagacggggattcgccatgttggccaagcttgtctcaagctcctgacctcaggtgatctgccctccttggcctcccaaagtactgcaattaacagacatgagccaccgtacctggccaggatgttcttaaaggtggaagaaagggccaggagttcgagaccagcttgggcaacattgtgaaaccccatctctacaaaaaatacaaaaattagctgggtgtggtggcatgtgcccttagtcccagctacttgggaggctgaggtgggagaatcacttgagcccaagcagttaaggctgcagtgagccatgatcacgccactgcactccacgtgacagagtgacaatctgtctcgggggaaaaaaaagaggcaaagtgggcacagcgtggggagggcaggagactggggaagtgggcgaagtgctgctcttctggggttggaaacccagactcagggggtggggttcagtctctggagctctctgagcgtggaggtaatctgctggaaggggcatttcggaagctgagttttgtggcactgtatctcgtgctgaagcagaggctgtgggtttaggaggcagaggcccaggcagctgtggtgtaagcgaatgcatttgtggtgggagggtcctgggcaggaaggcagcgtgcatgggacctcatgttggggagctcacacctggaggtggggggcattgctgtcaccccaagctgagggttgaaatccaagaggttgatcttgtgatttacagatctctctcatgtaagaggagcaacaggaaagcacgtgagaaaggcctgcagcactgagtgctcagggctaaggtgacagtactgctcccagagaccctgacggtctcagcagggcatgggcacagaaatcctctgggtattagagacagacgcctaccaaagcacagggcgtcatcccacggtcaccctgatgagcctggtgtctccctctgttaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccaggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaaggatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaacttgacgtactctgctttggagaggaattccaggggtagggatggtgggagaacattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattacaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 94 - DNA, 2939 bp, Homo sapiens
atggtgacagctccaatcactaagttttacggaggtgacttacttacctattcaatatatccaaaacctcaattgcaattttcccccagagagctctgggttcctagatgaagaacaccattgaaggaaagctatctagtgttaaccatttaatgatatggcctgtaccacaggagtggggatttgtggttgtatgctccaatgactcttatcatagatgtttgaacttttcccatatttttgggtacaaaaccattctcagcaaatttctgaagatgctgtgaatgctccttgagcgtatacctgagaactgcccaaatttcaccaccataagctctccaagatactttcctctacttaaaaaaatcgaggccaggcgcagtggctcatgcctgtaatcccagcactttgggaggccgaggcaggcagatcatgaattcaggagatcaacaccaccctggctaacacggtgaaaccccatctctactaaaaatacaaaaacttagctgggcctggtggtgggcgcctgtagtcccagctactcaggaggctgaggcaggagaatggcgtgaaccctggaggcggagcttgcagtgagctgagattgcgccactgcactccagcctgggcgacacagtgagactccgtctcaaaaaagaaaaaaaaaaaaaatccaggtgtaatcaggtgtaatttatattcactaaaatgcccagagctcgtgtttagtttgatgaaccttgacagttatgtatgcccatgtaagtagcacccaaaaaatgtattggtcatttccttcactgcagaaagttcttttctgcctgttcttagttaattccctcccctgcccccaatttaccctggtaggcagctactttctgatttttattcccacagaattttcattttattcctatattttcttaatttattcttctaagatctctgtggttctggatatatatttaaatataaaatcattctgaactgaagttttgttcatggagtacagaaggattgaccattgattgtctctattgtttgttcatttttctatttcatgattttctttgtttttattatcagcttatgtttattaacttgggggttgttttactcctttttttcagggttcttattataaaagcatatataattgactttagtcctttgctcatttccactacaggcatttaaagttgtaagtttctctctaagcactgtgtcagctgcagccaacattttgatgcatcgggttatcatcactcagttaatgatgttttgaattttttcttgtgagttcgtctttgacccaagtgaccgataccaacagagtatgtagcttgttttctgaaattgggaatcttctagatatcttattgttttgaatttctaattaaatactactgtggccatagcatatactctgtatgattttgatccttgtgtatatattgagacttgttttatggtgcagcaaaaggtctgtgttggtgaacatcccataaacacttgaaacgaatgctttctgcagttgttggaagtaatattctacaaatgatttgctttgaaaccccactctaggtcttgccctcctcccatgttgaaaacattcaactgctacttgggacctgactaccaatgcttcaaacccacttgcctagaaaaggttggccctgtgctgcaagatgtagcagcttgttctccgatagctacaggccctgggtcttgctgagacatgtggagcactatctgaaccacccaggtgcatcacacacctttgcctgctatagcacatgctagagtgcaccttacagatcccatcacctttcggatggggccagacattccctatgctgttgagagttctggaggctgatagatttcagccagtgtctcttggagtctctgagtggaaccgataaataaaagccctaaagaaagtgagaaattaaacaaagggcaagactgatgggggccacactactaaatttcttttgtttttaaacagctttactgaggtataattgacataacattcgcttgttttaagtgtgcagttaaattattttcagtaaaattttagacttgtgtgaccatcaccatgatcctgttttgcaacatttctatcattcctaagaaatcccctatgttcatcagtcaccaccactttttcccagtccccagctccaggcaacctctaattgactttctgactctacagatttgccttttctggagaccatataaatgaaatcatgcaatatgtggtcttttgtatctgtcttctttcatttactttaatatacttttatggttcatgtatgtggcagcacatatcaatattttaatcctgttaggggacaaatcctattaaattgtatggatagctcccattagtttattcatttatcagttgatacatatttgagtgtttctactttatggacaattatggataaagttgctatgaatattcacattcatgtgttgtgtggacataggtttttttcttctgggtagatagctagaagtgatagtgctaggtcatatggtaaatatatcttcaacattttaagatactgccaaactggtttccaacgtgactgcatgtcccatcaacaatgcgtgagtgttttagtttttccacgtcattatttcacttcccccaggtgttactgtccttttttattatagcattctagtgggtaagaagtggtgtctcactgtagttttgatttgcatgtccctgctgactgatgatgctgaccatcttttcatgtattttattgtctattcctacacctttttgatgaaatggttattcaaatattttgcctattttaaaattgggttatttatctttttgttgcgtagttgtaagtgtatttcatattctggatatgagtcctgtattaaatatatgatttgaatttttt

SEQ ID NO: 95 - DNA, 28682 bp, Homo sapiens
gccaaagtgccacgttgggcccggcggcggcgtgaagactggcggctgcgtgagactccggctccaggcgttcgcaccgtaatgcccggccgttggggccgtcggtaggcgcgaggcgagtcgaggcagccggccggtcggcggccgccggcgggaacggggctgaggcggcgcagcggagtctgggcggcggcgcgtcccgcccgagggcggctctggctgagggcggaggggccggggaagagcccggggcagcggctgaggcgggacggcggcgggggccgctgcccctagaagacccagccgagatgctggcggaaaacctggtagaggagtttgagatgaaggaggacgagccgtggtacgaccaccaggacctccagcaaggtgagggcgggggcgccccgcgggcgggcggcggcctggcccgggaggcccccgctgcgaaactgttaaaaagttgctttttgtggcggcggaggatgcaggtgccgggaagggctcaggctcacctggcggctgggccggccgtgcccgcggatcccgcccgcaggaagcctcggcacggggcccacggccttgctaatgcgcagttgaatatcagccccgaggcgcgtgggggccagggacgagccaggcaccgttttaagcgctttccgtggattagctagtttaatcctcactgcattcctccgaggcagacccgggtgagccagtgtgtcccgcagtaagtggcatagcccgagaagccgccccgtcgcaggctgtctagcccagcgcctttcatggccagcgtggagggccggctgctgcaggtggtagttgttttgcggcgtagcgggagctgtgcgctccgcaccgtaactccaggagacagtaactttttaaaaattaatgtttgagggtacatggtaggtgtatatatttgtggggtacatgagatgtttggatacaggcacgcagtgtgaaataagcacgtgatggagaacggggcgtccatcccagcatttatccattgaggtacaaacaatccaattacacacttttgttatcccattttccatatgaggaaagcggagattaaaacggtaaagtggcttgcctaaagctaagtgtgggagggagtgttttttgaacccacacactcagaagaagagttgtagtcactgctcaaaccccatctcttccttaccatcctagtttacagtttttttcagttgggcgttaagctgttaggcatagttcaccagatgccaattgaaacgacagaagaaagagcgcatctatctctgccacttttcttcagtttgcacgccagctttcacttagaaacaggcctgccgatggtgtctccagagaacaatcgtagagtagcccactctttggggccagtggggcccctgtttttcttatactaatagcaggagctagcagttggggaacactttttatgtgcctaacactgataggcccataacacagttgctcatttaattctcccagtaacacaatagaggtagtaatgttggggagtgctagggttctccttaagactccagagcaaacgttcttaaccgctatactgagtactgaacaatcctcaggaatttttccaggcatcttcagtttctgcaattctgtgtaaatgctctcagctctaatcttgcaatgaaaattaacatctcatttagttgaatattaaatgatcatgttgcttgttcatgctaaccactgaacatggcagaagaaaagaatgtagacctgaataactcagaaaaggaaaataaaatgagcacctcttttggaggaagataatttcttaaattaacatgcaatcactttaaccaaagtaattcacctttattacacttacagagtccaagctacttagtggttgcagtgcagtgtttggcaccatcttctttatgtccaagagacaaatttattatacatattaacaaacctgttttcagatttccccgtaaggattgatggcctagtttgatagtttctccaggatttgtgaggcaaccactgtaccactgcagtacttccctataatttaatttgtatcatcacaactaaatatttctctttcctgtatttaagaagcattaatctttaagggcatagagggggcaggttcttttttcttgtgtttccagcatctagcataatacttggcacatactggaagctcgattttaatatttgttgaactgcactgaagcactcgcacagaattgttttcatggctctcttccatcaggtgccttagtccacgctgcattctcccgctgtgggaggttgttaggaacaacagctgtaacacttcaatctaccgagcagcaagtgcaacgtgtcagggttacacgaggaattctctttaacctctgatcaaaataaagtcatcagctcttcaagtttaaccttaaaaacacaggtctgggctgggcgcagtgactcatgcctgtaatcctagcactttgggaggccgaggcgggcatataacctgaggccaggaattcgagaccagcctggccaacatggtgaaactccatctccactaaaaatacaaaattaggtgggtgtggtggcaggcccctgtaatcccagctactcgggaggctgaggcaggagaattgcttgaaactgggaggcggagttgcagtgagctgagatcgtgctattgcactccagcctggatgacaagaacgaaactccctctcaaaacacacacacacacacacacacacacacacacacacatatctgaacctctttactgccagttgcatttctgtgtttttcaaagggctgttacgttatcacagtggactttgacttaaccctctgtgtcataaccaactatatggagtacgagtagaagatgtgaaattccaacaattgtaacttgtgaatatggcctgtcaaagaataaaggctacagtgtgaataaaagggtatcctttccccagttttgctaagttatatgttaactcctaaacttttaacagattttaaaacttgttcatttctcaaaaatgtattatctgctctttgccaggtattcgcctgggccctggggccacagcacctccccacatgagtggataggtaggattcctactcccatagagtgaatgttccaggaatctgttcactagagaagcctggaggtgccgcctcatgggatgtgcccactacagcgcctcgtacattgtaggccctcagtagacacttgctgctgaattaagtttgggagcaggtctgtcctgttaaacagattattcagcaagtctagtgggattttatgtgcaggcatctgtccgttttttaacatcctcattattattactgagcaaggcttatttggagagaactgcttaaaactttttttttttttttgaggtggagtctcgctctgtccccaggctggagtgcagtggcacgctcttggctcactgcaatctccgcctcccgcgttcaagccattttcctgcctcagcctcccaagtagctgggattacagacacgtgccaccacacccagctaatttttgtatttttagtagagacggggtttccccatgttagccaggatggtctcaatctcctgacctcgtgatttacccgcctcggcctcccaaagtgctgggattacaggcgtgaaccaccgcacctggctggaaaacaacttttaatgatcctgttctcagtatcttacaactatagaatgttttcctttagcagtagtaagccatgctctgaatagattgaatctttgtatcaaagtttcctagggtatccgtttttaaattgaaattgctggaaatttctaacctcagtaaactctggtctactattcataccttgttagaaacatgtaaagcttttgtgtaggcaggaggagaaaaccctttgctgttacaaaactctttgatgaagagactgtcttttgtcagagagctgagttggctcagtaggaatactgacaataatctctgtgggtaagatcttttctgggacagcaggagccttcagtgcaggtaatgatggtgcttgctttgaaacatgcccctgagaacaaggtggaaagacttcagagactggattttcttttaaaccagctgctattgtcatttggtgagctgtgcaaacttagaataaggattcaggtttctgttatgtggatcagtaaatgaactcttagtttaaaggaatcctaaaattgcaggatgagtacatcctccttgtgtacaactattttgctgaatcactgtttggagggttattaaaactgacaacatcatttttcttgatatttatattcaggttttctgctttcccaattatagtaacattggcaacaggagttaaacagaagcatcactaaatgacgcatttgactttgtaataggaaaaactttcagccttactgttagtgaattactcctacagactacagctgccagtactaattttttgcctaaagcatagagctgagtatctgtttaaagctaacagtttacaccattaaaaatatattattacctgcaaagactcattagtgaaagaatattcaacatatgaaggtattgatatgttgaaattctcaagcctgcaataaatctacagtatttttagtagttgcctaaaccaggccagttcaataggatttagagaagaccctcttaatgaaaattcattttgtaatcctgtagagatgaacaggtgtataaggcttcgaaactatattatttccttttcttttgtgccttaattaaaactataagggacattcaatattctattccctccactaattatttagaaaactttcttgggcttactgccagcttttggcctcttttggttatggaagccagctgctactcaacaggaaatgaactttttttaaagacaaagtccggtgtctttaagctaacagatgaagtaatatcctgttatacagtgtgacttcacaggagctttcttgtagttgggacttgttaaaattctatccttaacagcctataaatatttaggagatcgagacttcaggtttctgagccaggctggtgctttgttttactggaaataaggtttgagataaggacaagtctcaaattcttttttgtttgctatctactaaagagtgctgtccttggtatctctttctgcaggagcagggaagaggttcctggctactcttaagtagcacaggtagttccataactgaatgaaagtggtgatagtctcaagacagtctggattctgggagaggtttcagcccagttgggttttgttttttttcttttttttttttttcctgctaagagacaaggtcttgctatgttgcccatgctggtctcgaactcttggcctcaaacagtcctcctgccttggcgtcccaaagtgctgagattacaggtgtgagccaccacacccggtccttggctcaggctttgattgctggttaagagcatctttggtgaatctgagccttcccagtgaggaattaccacttcacacatttaagaaggaaagacttaagtaatacctaggtaatgtttttatactttgtctttaatacagtgtggtagcttccatatgggtctatgtatacacattacacactctgtgagtacaaaatcattttttctggaacatgttgagccatacatagttcctttttcatttggtgaaaacagggtattaacttgcctggggttgtatgtgctttcactagcagagcaggcaataaaaacccaaatagttgaactctaatttctcattgcaatctgtgaaaacaagtagaagaaattaagtacctcaacaaggggaacatttgtattctctaccttaaagaagcctgcggacctctctttcaattgccttaaaactctgcagatgaagataacaaagaatcgtgatgagagtgagagtgagaacctgttgacctaagagtttctgtttgatctgtgactcaccttggagcttgattaggtcaattaacagttttgtgcttcaggctgtctcatctgagaaactggactaaatacctttaaagatataaagactaatgtctctagaaaacaaaaagtaggctgggggcagtggctcatgcctataatccccagcacttggggaggccgcggtgggcggatcacttgaggtcaggatttcgagaccagcctggccagcatagtgaaaccccatctctactaacaatacaaaaattagccaggtgtggtggtgggtgcctgtaatcccagctactcaggaggctgaggcaggagaatcacttgaatccaggaggcagaggttgcagtgagccgagatcgcaccactgccctccagcctgggtgacaagagtgagagactccatctcaaaaaaaataaataaataatgacaagaaaaagactaatgtctcttaaatgctttgagctatttgtaaaagttctgtgttttgtaaatacaagttatttcatagatttaatggaagtctttattttttatttttttatttttgagacagggcctcactgtatttttggtagagatgtaatttcaccatgttgccctggctggtctcgaacttctgagctcaagcagtccatctggttcaccctcccaaaatgctgggattataggcatgacccactgcacctggcctctaaagtcttaatgaatgtaatgactaatagacattgttagttttgaaatcacaagagaatgtattttagcacctatctaccaacagtatactgttttattttaaatgggtgtaaaatgtttttaaatgatctggagttgggtgtggtaggttttgctgctttttccagagtgaaaactaaccaagtagaatactaattatgcacttgagtggacattacaacaactaatgctgttgttaccatttactcaatgctaagttttactatgagtagtggtggatagccattaagccttatttgtcaacctctaaaaattaagtttaaaaatcattatgtagtgagtttccttgtttttatgataaatttttttcataatacttttatgacaataactgaggctactttccatcatacctagaataaaatttaaactttacctaccatgggctataaaatcctatatgatctgatccctcatgcttctatcatactggctgcttgtcaggttgtagaatatgccaaattcatggcaagttcttcatccttcaagcttcagctaaaaggtcttgtcagaccttccttatgacctccctttctaaattgggccctaggctgggcacagtggctcatgcctgtaatcccaacattttgggaggctgatgtgggaggatgtgttgaggccagaagtttgagatcatcctgggcagcattgtaagaccctgtctctacaataaatcagtaagtaagtaagctgggtttggtagtgcatgcctgtagtcccagctgtttggcaggctgaggcaggaagatcacttgagcccaggaatccaaggctacagtcagccatgagtgcaccactgcactccagcatggcaacagagcgagaccgtgcctaataaagagacagaaaaagaaagccctttgttcattatcaccaaatccaggtttttctcccccgctttatcttttagactttatattgaattggtcaacaaatcctttagctttactttcaaaacatgtcagaattctgcccctcctctcccatcttcatctctgccaccctggtccaagccaccatcatctctcacccagacgattgcagtatctttctgtcactctgctcccacctttgtcccattcaccctgtataacagcagccggagtgatcctgttaaacctccattggattccttcatttggagtaaaggccaaactcttgacctctttagttaggccctccgcaaactggccatcttggagcccctctgatttgagtcttccccctcccctccctgcccaatacattctgctccaccctcctcagcctccttaatgactcagtcatgcttcctcccaggtgctttgcacttgccttgcctctgcctggagtgctgtttccctgatggatacacatgggtcacttattctgttccttcacacattgattctaatgtggccctggtcacatgttcttaaatttcagcctcccacatccacactcctcctgtacttcttccttgctttatttttttctctttagcatttatcgctatcaagttttattgtgctgtttctcccagtagaatataagctccatgagggcagggatatttttttaatgtgagttccttatggctcctgggcaccatcccagtgcctagaatagtgtctgatattattgagtatatgcatgcatgcatgaatactgtttatcacagtatgtgagtttagttactcatttgtctggcttcctccactaatctgggaatgtcagcaaagcaggacttcattttattcactgttctatagctaatgcttagcatagtgcctggcaacaaaaacattcatttgtgaatcaatgactattaatagtactttgcgtgcgtattgcaacttagtttgtaaagtactcctttatgtattatttcatttgattttcacaatcttatattgataagacagtcatctctctaaacaagaatactaactataggggccttaaagtcaccatattgaaagtgttctggtaaatgatagaactgggcctgagacttacctgcccagagtgcagtgcatttcccactgtatcaaaggactgctccataagatttactatgcaaagaagtatttcaatgacgtatgttacaactagtgtcctttcttatattgttaactaaattttcatttctgggagttgagtataatataaacaaatcctgttttatgggcattatacctaagaatagagagagttgaaaaatgaggtttaaaataaaatatggttctgtgctaaatggaagtatgagctactgacatgtaattacctcaaaaaccacatttctgttttgcttttctagttgctcatcttacagaaggacacgaagagaagtagagtgacctggggcagtgttcttaatgctgatgtatttttccttttcttgacttaataaattttagtccccttaggagtccaggatatatgacaataaactttaacagttgtattcacagcaggcaaattcatgggaactttaaagatttttgaaagctccacctataccttggctcaagggtccattcaaaaaagtagactgtcaggatatgaatacattcattgtactagcaaataggattttagaagtaacactgcggaatgatcattcctgaacaaataactgcatctccataaagtagatgaccatttttcacttcttacaagtatgggtacataagagaatacattacctgctggaggcgtcagtttaactgaattttaagtagaactcgggtttccttctgtgccactccaccttccattgggatgtgacttaaactacatgttcttttttgaaggactgggttatataaattgttgatgtgagatcatttgtattattctaagattcatttgttgtgctagatcttcaacttgctgctgagcttgggaagacattactggatcggaacacagagttggaggactctgttcagcagatgtatacaaccaatcaggagcagttacaggaaattgaggtaattcacttggcaggagagttacacttttgacacttcgatgtgttgctgttatgccaatcacatactggtaaaaaagcacttgcaattagatgcagcattttattttttaacacaaacttttttgagaatgagaaccgcctcccgagtagctgggattacaggcgcctgccaccacgcctggctaatttttgtatttttggtagagatggggtttcactgtgttagccaggctggtctcgaactcctgtcctcagatgatccacctgccttggcctcccaaagtgctgggattacaggcatgggccaccacacccggcctaaaacatgcaatatttaagatatacagaatggggtaagagaacaatacagtgaatacccatatatccaccacctagcttaaaaaagaagactgcccacactcttgaacttcccaccggagagggaacttatacctcctccttggtgacatatccctcccacctactaccaaaccatatcctaaatttgaaaaaaaaaaatcatagttcctgatttcacagtgtgttcagatgttttgctccattcaaataatcataaaatacatgttgctttctctctgctgtgatcttgatttgtttacatttttgctggatattttattaaaatgctacatttttggctgagtgtggtggcttatgcctataatctcagcactttaggatgccgagggagacagattgcccaagctcaggaattcgagaccagcctgggcaacgtggtaaaaccccatctctacaaaaaaaaatacaaaaattaggctggtgtggtggcgtgtgcctgtagtcccagcttacttgggagacagaggtggaagaatcacctgaacctgggaagtcaaggctacagtgagccaagaccgtgccactgtactccaggttaggtgatgggagcgagaccttgtctcaataaaaaaataataataatataataccttttgcccagcttaacaaactaaaatgaaagatgctagactagggcattaaaatggccctctatgctgctaatcttataaatagtccccttcaagtagttcagttatgtgtaggccacttgactgtaaagataatcacggatattaaccagtgtcccatcagaacacctttctccatgtcccaacccatgcttcccccaaaaagggtctgtacttaaattataagctcctcccccttaaattggtacagtagacccaggacttttgtgtctgtgcacagaaaaatgtaaaagactctagaacagtgaagcagttcatcataatgagtacttactaaagctttgattatttcctgaaccaggtgctgggaattcaaacaagcggagaattacacagtccttccttagaagtgatcacatcatacagttttaaacttttgaatacaaatctatcatcaaaacaaaggcaaatgtgcaatctcagtatccattaattttacctagtaacataaaaggtgtatacagtagaccctccccttgagcaggatttctgaaatacacttttataattctaggaaagtatggcttgcaatgatattgaagtcaccaggtaccatttttagcatattctacatcaaaagagcgtacaatatgttttacactaaattgaatttaatgacctactgtaggccgggcgcgatggctcaagcctgtaatcccagcactttgggaggcagaggcaggcagatcacttgaggtcaggagttcgagaccagtctggccaatgtggtgaaactttgtctgtactaaaaatacaaaaaatatggcaagcacccataatcccagctacttgggacactgaggcaggagaatcacttgaacccgggaggtgaaggttgcagtgagctgagattgtgcagttgcactccagcctaggcaacagagcaagactccatctcaaaaaaaaaaaaaaaagacctactgtagagtttgccagaaacctaaaatgcagagaaactaggcatttaaaaactattaaactaggctaggcatggtggctaacgcctataatcccagcactttgggaggccgaagtggaagaattgcttgaggctagggtttgagaccagactgggccacaaagtgagaccgtgtctctagtctaaaaacaaaactattaaactagccaaatgttttacgtggtcaaggaactctttcctactttgtttcgtagactttgttttttaactcagtgggagatttcagaatagtcctaaacgatcatcactgtttgtatttgtgtagagacatagtcttaattgtattatcgtagtctatgaggtttatccgaggcctgattattgctaatagttaataaattgtattgatgtttcctgttagagcatttataaaacactataactggtacttattttagcatatctttcaagtgtagctgaaagaagtgtaaatatttgtaagttgggagaatgatgcctattgattagcataggagattacaaacaactgctttgttttctgtggtatcgaggatgattaaacatttaagctagatcattggtattctgaaagtatccaaagatatctgagattctctaaatctacaaataacactttattatctaatattatccataagatattgcaaagcgtcatggaaatgaaataatccagttcagaccttcatgattaaataggtataaaattcagccgggtgcggtggctcacgcctgtaatcctagcactttggtaggccaaggcgggtggatcacgaggtcaggaaatcgagaccatcctggctaacgtggtgaaaccccgtctctagtaaaaacacaaaaaattagccgggcgtggtggcgggcgcctgtagtcccagctacttgggaggctgaggcaggagattggcgtgaacccgggaggcggagcttgcagtgagccgagatcgtgccactgcactccagcctgggtgacagagcgagactccatctcaaaaaaaaaaaaaaaaaaaaaagtataaaattcatgtataaaactattcaggagatttagcttggaatatttcgggaaacatattcatgagtctcttgttcctgtaatatgtagtccactggttcctagatctgagcattgcacaatgcagtattttactctttatccaaagctgtttttggctaagaataattactctcttaggtttcttcaccaccattacagttgactttcttttttctttccttttataagttgcttcatgaaagtaagtttccagtctcagtaggggagatgagatggcagtaatggctaagcccacttaccagccaggggattcccacagactgtccttgctgcctgctccatcacaactgtgcctgggcagatgtagagatcacgatgtagatttctgaggtctctctaatagcctaaaagaatgccatgtgctcttgtaaaagtaaccaggcagctaaagagcctacttccttgctaaacaatgacccttgcatatgttcctcttattgcaaccttcaggaggccccctaaactttataagggccctctccttaatttgagccttttcaacgtgtttctccttcccttaaactttttattgaaatctacattacagaaaagggcataaatcctaagtgtatagtttgatgaattttcataaagtaaacatgcccatgcaacctattcctagataaggagttgagagcattatcagctcatctggtcaccacccggtgagctagcatcctaagtttagcttgtttttgacctttacgtgaatggaatcacttgtacaagttttaaagtaactgtttagaatgtttattgggaattagattacaaagtaatacacagcttggcgcagtggctcacgcctgtaatcctagcactttgggaggctgaggcggatggatcactgaggtcaggagttcgagaccagcctggccaacatggcgaaaccctgtctctactaaaaatacaaaaagtagctgggcatggtggtgcatccctgtaatcccagctactcgggaggctgaggcaggagaatcccttgaacctgcagggcggaggtcacagtgagccgagatcctgccacttcactccagtctgggcgaaagagtgaaactccgtctcaaaaaaaaaaaaaaaaaaaaaaaaaaaagatcatttttttaattcagaaaaatatatagttgaagaacaaaaagtcagctcctatcccaccaccagtgaaatttaaaatgagacagtccagaagaatggtctgggaacaaactcatctgagcgaatgaaaaatagtgcagagaactggtgaaaatactaggacaagatccctaagattctgacttattatggaaatagacaacttggacactgccaaagggtattttgtaagtagaaccacaaatattctttcaaagactcttggagggtttcaaacaatcctcctaaaaattgatcagtatttttggtaggcatcatttttaatgtaaaaacgaaaaaaacaaaaatttccttttatgtgaaaacgaaaaaagattaaactattcaaaataatggttaaactggcttcagagaagcctgtagcctgtcttactttttttcagtgctaatttgaaaaacttagataattttttaagaatccagagcaagttttttctgttctgggtggaaggaggggaggagagaactcttacttgggagagtaatgagatcagacaccattggattcatttacactttgctacaaccgtgtaagcagcctacagccttgtgttttggttacttccctgcttagacacctgcattatcccctacaggagttgtgcctagcactcaaagtagtctggccttcaaggcatcccttctttcaagagttcatgccctctttggaaatggaaaaatattttgtgctgcttttactgcatgtatcaatattctactgcatatgatacttaattgatttgctttattttcctttccccttatttcccattgcaacagtgagcactgttgtgtttattcatggtctttcacacatactaggtaatcaatactttgttgaaatcagtattttaacagaggagaaacagcttacaaagctcttctaataactcctaaactttgggtttccacctctggagatttttaaggcaggcagaaggggctctggcctctgttttaggagattcaggtttaaaccctcaattttaattgcaaatagctagagaatttagacatatgaattacccctcagattctctttgctccgttatggaatggtgataatgcttacactgctttggtgtaggagttttctgaggggatgagattatggaggcatatatattttgaacagtataaattgttactttggtataggatttttctgaggggatgagattatggaagcatatatattttgaacggtataaatcgttgcatagtttaccaatgttttaagaattttagtagtgagccggtggcggtggctcactcctgtaatcccagcactttgggaggctgaggcaggtagatcacgaggtcaggagttcaagataagcctggccaagatggcgaaaccccatctctgctaaaaatagaaaaattagctgggcgtggtggcgggcgcctgtaatcccagctactcaggaggctgaggcagagaattgcttgaacccgggaggtggaggttgcagtgagccaagattgcgccactgcagtccagcctgagcaaaaaagcgagactccgtctcaaaaaaaaaaagaattttagtagtgaaaaaagtctttaaaaatttgtatggatatataacagctttacatatatctggggcgcctgtgacgttttgatacaagcatacaatgtgtaatgatgaaatctaaactgagataaccatgacctccaacatttatcatttctttgtgttgggaatattgcgtatcttttctagctattttgaagtatacaataagatattgttaactatagtcatgaaagaacttaaattctgaaaaaataaatcttccagaattactggaaatagactttaaaaacaatctaatcccacaattttaataatgggattataggtggtttctattttcatgttcatgcctcccgccaccaaatttctacaggggaaatatatttcatcaggggaaagagatttttcaaaagtaataggaaatatttctttattattgtggaagttcattttgatagtaaattcagaggatttaggctgtaatccttaatttcaggataatcccaacactgcttacaagccagatttccactccatttctatgcatttttacttggggtcgtttgtttctatctttccctgcgttccaggttaggattccacaattgcaaataggtatttatgtaattctgctggcctttgttttttaaagatttaccttaattgtaaaggtggcctgtttgtagcttttgtgcataactggaaccttgtactcatagttgaggtgacagtctgtgcaaattcctagacagtgagataaacccaaggcattttgctataagttgacatttttgcccacatttctgctaccccatgacccccttcccccactgttttgctttaaatgtctccctttcctgtttactatggcagtcagattcattggaggctgtgtatcaaagagaaaaccagcatgtcagcagcatgtctgtaccttgagatgagaggtaggaaataagctaacccatttccttctagattcagaaaaaaaatgaagcactgactccatagacctagatgtctggccttacatcagtacgtacttagagagctcatcatttttctttaagttgctgactggttttgtcagactcttctgtaggtcccctataactgaatcttggagaagtgaagggcttttctgattaattttggttttatataataagattaagctcctaccatgtgaaaacaagctccttgacattctttagattgttgttaaagccaagtcatctaaaaccaaaatatcacaagttcttaaatggtttcattatgttgttatcacaggtatcacaggtttttatatatcaaacaaggaactttctatagtttcttaaatggcctgtttgtacttatttgcatattgacttgtttcctgtatgttggccacaactctaacttgaacatcctatctgtaagagaacaacaacttgagacccatctggtatctggtaggaactgtaaaagtctccccctcagattaccggggcaattgctgccatgggaataaatacagagaaataatctataaatggaaaagcggggagagaattcatggttaataggctgttttcccaagagggctaaagccaaagcccttctcaaaacctttcagttaaatcccccttgacatctcacagtctgagtcatgccaagcacaataagctgttgtgaagaaaagtctagaaactgccagttcgccagtatttttttgtcccctactgtgtgtcaggaatggactagatacacaagagccttccattcttagaagactacagtactggcctggcacggtggctcatgcctgtaatcccttcactttggcaggccgagtcaggtggatctcctgaggtcaggagttcaagaccagcccggccaacatggtgaaacccagtctctaataaaaatacaaaaattagcctggtgtggtggtgcaagcctgtaatcccagctactcaggaggctgaggcagcagaatcacttgaacctgggagaccaagattgcagtgagctgagatcgtgcctccagcctgggcaacagagtgagactccatctcaacaacaacaaaaaattgaatattattgtattgttttgagagaaatcaatttagggtaccttgggaatgctgccgctttagacctgctttaaggtggtcttcttttttttttttttttttcttttttttttttgagatggagtcttgttctgttgctgaggttggagtgcagtggcatgatcttggctcactgcaacttctgcctcgcaggttcaaacaattctcctgcttcagcctccccagtagagtagctgggattacaggcatacactaccttgcctggataatttttgtatttttatttattttattttattttttagacaaagtcttgctcttgtcccccaggctggagtgcagtggcgtgatctcggcccactgcaacctccacctcctgggttcaagtgattctcctgcctcagcctcctgagtagctgggattacaggcacctgccatcatgcccggcgaatttttgtatttttagtagagatggggtttcaccatgttggccaggctggtctcaaactcctgacctcaggtgatccacctgcctcggcctcccaaagtgctgggattataggcatgagccaccacacccagcaaatttttgtatttttagtagagacggggttttgccatgttggccaggctggtctcgaactcctgacctcaagtgatctgcccacctcggcctcccagagtgctgggattacagccatgagccacagcacctggccaaagtggtcttaaaaggcttctgaagaggttatgtttgaaatgaggccagaaggataactggaatttataatctttctttggtgccatggatccctttgattatctaatgagatctaggataatcctcttaaaattcattgaattacaaaggaaacctgttagaatgaaatacctgtcaaatattgaaaaaagtaaatttgtgatgtaatatagatacgtattaacatatttaataacaagatctagaaactaccatgatttcaaatagtgatgaatgtaggcagtaaatcaagatttctgcaactatagtgcaatatgaaaatacctgtgatttctgttgatgatgaagtcacagataaacctaatactactagtggtttattgcctctgtcaaaagaaaaaattacgacaaacatagtataaagatcttaattagcttttatttgagattctaaagttgggcaacacctcattcttagagaatgagggtttcaatgagctgagcagaggaagttggttttatagacaggggctgaggaaagcagaaacagaaaacaaaaaatgggtggtttcaaagttaatttatttgtaaaggttaaagcagagggaagtcccttatgctggctaaaactggcatgtttgggggcttggctattatctcttctaatttctcagaagtcagatgaacaactttgctttggcttgctgacatggaactttagcacaagtgactccattttggtttggtttgttgggcctagggcagggactcagtccaaaccagtggtctcctataaattttaacagatctattagtacttgaaagaaatgtcaaatttcatttagaagttaacaaaaatgaagatgtagctgttcagaccctttaaattcatccatgttcacagaccctctaaagtctatccatggaccccaggctaagaactgctggcttaggtggagcagccaggagaactgcatccccccggataggggatcgtaaaggcattagaggagggaggcacttgccttgcagtggggcaactccaaaaaaggcaaagatatctcccctaagtgtgaaattttaaaaaaatcaatagctaacaaatgaagctggaaaaaccacttgagacaattgggaaaatattaatgctgaaacgtaatagatgttaaggaattattgagtttttttcccttaggaattgtggttaaaataaaacgtcctagaaatgtatgaagatgtatacttgagatgccttggattagctttaaaatgattggaggacgaggaaagtaggagagtagagatgaaataagattggctgtatgttgataattgttgaaactggttgatgggtacgtgggagttcattaaaccatttctctgcatgtatatatgtttgagattatccacaatagaaagttttatttatttatttatttttagacatagtctcactctgtcgcccaggctggagtgcaatggtgtgatcttatctcactgcaacctttgcctcctgggttcaagtgattctcatgcctcagcctcccaagtagctgggactacaggcgtgtgccaccatgcctaactaattttttttttttttttttaagtagagatggagtttcaccatgttggccaggctggtctcgaactcctgtcctcaagtgatccacccgccttggcctcccaaagtgctgggattacaggcatgagccaccacacctggtccacaatagaaagttttaaaatgcagtggataagattagccatctgtagaaattcagtatttgtttggactgagaagttaggaaggatcactcaagcaaggttaaggtaactagtttgtaatttcagggaattaatgattgttaagaacataccaaagtgaagcgttatgatgatgaatgctgctgtggtacagttaaaatataacctaatcttagtggataactgcatctaagctgagccctatgcagggagacggtgagcattaagctgaagagtcatcattgatccagtgaatgcctgtgtctcctagacccaagagaaaaggacattggtcagggcaggggacgtccaggattttccatgtccaagatcaacatttctctaagtgtgatctctggactgcctgtactaatatcacctgggtttgttgctaaaaatgcagaatcctggctctactccagtctcagccgtttgaggggaagggacccaggttcttacactttaataaatcttcttccaggtgaatcttagcacatgtaaagtttgaaaactgtagctttaaataaagatgacagtagcttctccttattgagcaatttaccatctgccagatctcatgctgagctctctacatatattaacgtttttgtaaattatatatttgtatatgtcagggaggaaaaatatttttttcctcaaccttcatgagtgcttagttggaaaggacccctgcaacaaaagacagattaacaagagaaaaacaagcttactaacatatctatttcatttatatgtgtgggagatacccaggggatgagtcattctcagaggtggctttgaattccagcttatgtagtatcttcaacaaagaatggtaattttttagagaagtgacaagacaaaggggaagaactttgtctaggggcagaacttgtgggaaggcaagtaagtggtgataaaggcccgttagcaaagcttgttagtgtggattcctctggtgctgtcttctggcccataaaggtctaaagttgttagtggttaacctttgttctccctggtagagagggaggaggcaggaacctttttatgccaaagacgcatgctttggggtgacatagtccagtctctcccacacacatatttatctttacagccttatgaagtagttgatgaggagaactcacattagaaaaatgtgcttgctgtaggttacccagttctaaacagcaaagcaagacctcaaaccaggttctgactccaaagcctgtgctcttagctactataccactgcctcccatcagactcctctgatcccatgtctaccagagactctcattcatgaatcggcctttcacatgccctttgtggggcagctgtgtcctaatagaggatgtgaatattcttgtcactgggcaggaacagttcctgttgtatattaataaattaatgtctggcttatgcattagcctttttaaaggtagttctgagtcctaaagaatacttgataatttatacttgatataaagaagcttgaaacatttctgcagctattatatatatattcttgtgattctaagccttttttccgctcctgtggaatctcatcaattcctaagagattgaacatgttcccatcaatgacaagaacctactatggaattactagcccgagggcaggattaagggcctactcctttagttctgagaaagcttcacgcatgagaattagtggttgatttccaaaggaccagaagaagctggtgggagttgaggcagtgaagactacacacaggcttttatagaccgtgccatgtgctcacctttctcatttaattctgccagttctacatggtaggtactaacagatccacttactaattccgaactcaaaaagctctataaagcaagattttttttttccccttaaatttgcaacagattcatttggtagtagatctttacctgaactgatgtgaggctgtttatagtcttagttcatactttttgatgcagaaatattaatgcttgattacagggtgctgcccagacctcacaggtattataaggtgtcagctgtgtgtcaggtatgagcgccatgttgtctttctaaaatttaaagaattttccaaaacacttttgacttcaagagtttcagatgagaaagttgaagttaggttaagtgtttgttcaactctttgctgctgagttatgtaaatggatttgaaaaaaaaaaagccatatatgcttttttcaacactttaagggcccgttgagtgtcatttagcccattgtttgttagccttgcaaatccttctagagttgtagaaaaagcctcaagaagagtgtgttgtgttgtgtttgagacagtctctgtcacccaggctgtagtgcagtggcacgatctcggttcactgcaacgttcacctcccacgttcaaaagattctcatgcctcagcctcctgagtacgtgggattacaggcgcgtgccaccacgccggactaatttttgtatttttattagaggtgggtttttgtcatgttggccaggctggtcttgaactcctggcctgccttaagcaatctgcctgttttggcctcccaaagtgttgggattacaggtgtgagccaccatgcctggccaagaagagtgtttttaaagtcaagttctgagtcttttacagtttgatcatcagtaagcttcaaaccatttctcccctctttctggttctgtccagggaaatactgtgactttttcctttggaatatatactgtgttttagtgtcttcaggtagagctgagcagggagggaatcaaggtgacttacactgcggcattaaggttgggattattcccctttatccttggccatttaggaagcagtcttagcaggaccagaataaatcatctgataaatttctcgtgaataaggaggataatggtgataaaactctcataaaattaaaaataacaggagtctttgaagcatattaagctaaaatatatttctcgtcaaagcaacatacttttcattttttttggtccagaatgcctcattcagagaaagagattgatttttttttccaaattaagatcctccacatagaaataggaacgttttacactgttggtgggagtgtaaattagttcaaccattgtggaagacagggtgtcaattcctcaaggatctagaactagaattaccatttgacccagcagtcccattactgggtatgtacccaaagtatcataaatcatgctgctataaagacgcatgcacacgtatgtttattgcggcactattcacaatagcaaagacttggaaccaacccaaatgtccatcagttgatagactggattaagaaaatgtggcacatgtacaccatggaatactatgcagccataaaaaaggatgagttcatgtcctttgcagggacatggatgaagccggaaaccatcattctcagcaaactatcacaaggacagaaaaccaaacactgcatgttctcactcataggtgggaattgaacaacgagatcatttgggcacagggtggggaacatcacacactggggcctgtcggggtggggatagcattaggagaaatacctaatgtaaatgatgagttgatgggtgcagcaaaccaacatgtcacatgtatacctatgtatcaaacctgcacattgtgcacatgtaccctagaacttagagtataattttttttaaaaatcctccacgttaggctttatttctgttaaacatgatgtttttgcttaaactttgatcacatgttccatgttttttgtcttaagggattgttatgtctcactttagattttttagttgaatattaattttatgcatggtatatgctttggaaaattagcctcacaatgcactggggtattggtgagcattagaggagctaagcatataaaggacagcctgtgctcatttcttatgaagacagggagtttaatttcttcttttcttaaaataaacatatggtattgtggtataataaaaattatatatttggtctttgtccctggtttctggcatagaactcctaaaacccttggaatttcctgataggttgaggtctggtcaccagagaaggcaaccacatgattagagggttagatctatcagtcccagccccacaacctctggatagagggaagggttggagcttgagttcagtcaccaatggccaataattgaatcaatcatgctgatgtgagagaagacctggagaaaactgaaatgggtctaaaggagcttctgggcagtgctgggaggccagtgagcccagagatggagactctatgtcagccccaccccaacaagagttggtgctgacaatcggagaattggtgttggaacagcagaacagcaggtatcttttttttttttttgagatggagtttcattcttgttgcccaggctggagtgcaatggcgccatctcggctcattgcaacctctgtcttccaggttcaagcaattttcctgcctcagcctcccaagtagctgggattacaggcgtgtgccaccacacctggctaatttttgtatttttagtggagacggggtttcagcatgttggtcaggctggtctcgaattcctaacctcaggtgatccacacgtcttggcctcccaaagtgctgggattacaggcgtgagccaccgcagccagccaagaaacagcaggtatcttatctgtttgtgtcacctggtcctgatcttctcttacagtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgaggtaaattttctagaatctgacaaggaaggactagggggaagttctttagtataaactagaatagaacatggctgcagtgggtttgggtcaatatgggataaggtttaatttaattctttttggagaatggagattaaatagacatcctttccaattaagaaagcccagtgtgagtggtttgcacctaatctctcctcaccgcttttgcccttgattcaatatgacaagcagcagtggcttctgtctgttcctcacagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccagtaagagcctgcctttctgtggagttacagcagggactgtctcatgtcattggcacattctgatttccagtagattgaaagtaccattttaagaaaagtcacttagctattaagctaccattggtttgaacaaaatcacttaaacatataaattacagagttcttagatattagtagttctcattttgaaagtcttggaacacttatttcagtgtttttaatgtattaaatcatagtttaagatgaattctgatagactagatttgggagttgtgttttacattagagtgaagaaaaacagaaatactggtaaaacaaaaattcaagcgaacaggagattttttgcttaaagaagtacctttataatttagagttataagtctgaatctttaagaagtatttatggaacacttgtgtggcaagctgtatgctagacccaagggttggcgagcaaaatagtttctacccctgtgagctttcagtctaacggaacggcagataagcaaataaaaacacaaataaatagtcaaggtgcttcagactgagcaggagaaaccaggtggttcatttggtgggtctcaaccttggctgtacatcagatcacctgtggggtttttcaaaatgcaaataccaacacatttcctcaggcctaaatcagaatttctaggtgcgggtaaaaagctgcccaggcaattctgatgaacattcctggttaaaaatcaccacagcaacagtaatttgctgtagtgattcaatcgtagttacatattatgaatcatttggagagcctttagaaaccctcaggccaggtagcagaccaactaggttggaatctgtgggttgggacccaggcaccagtactttttaaggtttcccttgtgaggtcattgtcatactgctagaatagatgttctctagtacttttaacattaaaaaaagatttgtcacaaaaattgagtttgctttcatgtgtttatttaccagcctcacacaattccattttagccactgctccaagtgtggctaaaaaccaatcactgttggccgggtgtggtggcttacgtctgtaatcccagcactttgggaggctaaggcaggaggatcacctgaggttgggagttcgagaccagcctgaccaacatggagaaaccccgtctctactaaaaatacaaaattagctgggcgtggtggcgcatgtctaaaatcccagttactcgggaggctgaggcaggagaatcgcttgaacctgggaggctgaggttgcaatgagctgagatcgcttcactgcactccagcctggcgacaaagtgagactccgtctcaaaaaaaaagaaaaaaaaattagtcactgtcacagctcctcaaatttatttagttgaaaaaaaatcaccagtcttcctctcgtcattttcagtggacctgtgtaatatattctttcaatatttttttccctagacacttcgtgtatgatcatgtgttcgctgagaagatcacttccttgcaaggtcagccaagccctgatgaagaggaaaatgagcacttgaaaaaaacagtgacaatgttgcaggcccagctgagcctggagcggcagaagcgggtgactatggaggaggaatatgggctcgtgttaaaggagaacagtgaactggagcagcagctgggggccacaggtgcctaccgagcacgggcgctggaactagaggccgaggtggcagagatgcgacagatgttgcagtcagagcatccatttgtgaatggagttgagaagctggtgccagactctctgtatgttcctttcaaagagcccagccagagcctgctggaagagatgttcctgactgtgccggaatcacatagaaagcctctcaagcgcagcagcagtgagacgatcctcagcagcttggcagggagtgacatcgtgaagggccacgaggagacctgcatcaggagggccaaggctgtgaaacagaggggcatctcccttctgcacgaagtggacacgcagtacagcgccctgaaggtgaagtatgaagagttgctgaagaagtgccaagaggaacaggactccctgtcacacaaggctgtgcagacctccagggctgcagccaaggacctgactggagtgaacgcccagtctgagcctgttgccagcggctgggaactggcctctgtcaacccagagcccgtgagttcccctacaacacctccagaatacaaagcgttgtttaaggagatctttagttgcatcaagaaaactaagcaggaaatagatgaacagagaacaaaataccgatcactctcctctcattcttaattgaacctctagctctactactaatttgcctattgcctatcgcctctctctcccattcagacaagtgtttgtagactctgaagcctaatgttactcatgacgtttgcctcattgctttgcttatttagcaaatgcatacaacgaggaaaggaggtggctagtggtatcagttctctgatccacttccatttaagctccccaggaaatcccatgacaaactggcctctggctggcgcgctgattagacttcagttcctgaaaaggaccagtggagggaagagctatacttctggagaagtaggcctggagttactacagtatgggggaaaagggtcgagttagaacaaagctaaggcaattcctattgcttccttgcgcaacttctcaaaacgatgaaagtcagaaggctgtcaaactcaaatatctttgcaaacagtttgaatactgtgaattcattacgaagaatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgacttgccagccacaagctgctcttgcagagttcttaccattcctgtaaatgttttgacttgttgcagaaattcctatctactttattaagcagtattgatctgactgtggaaacatcctctcacttgcattcttttaacttaaaactatttaagaactgatgttccgattattgtatatatttttctaaaaaccaaataaagctacctatgaaaatgaa

SEQ ID NO: 96 - DNA, 36384 bp, Homo sapiens
gcgctgcccgcctcgtccccacccccccaacccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggtgagtgcccgccccagctgggcagccgcgcaggggagctggtcgggcagggccggtggcttttgtctccccttcccctccctgaaggctgacaggccccggtccctctgtccacgctgcgcaggacaggtgcccagcctccccggggtgcgccgggggcagctggcagccaaggggcagggcagctagagaagggtggtgcccatcagacctccaggccagaggagcgccttgggtgcgcctgcgggagaagtgggcagaggccagtggctggtagccctctggggctgggcccctccagggtttgcaaagaaggtggagtagacaccagcctgagtgctgggcccagcccatcatggcgcatctaatgataaaccaacattcctgacttttatgtgaaatttcgttctttctaacattggctcctacttttaaaagccaccctgagaggcagacgccatcccggctccaggcagggcttgctctatgcggtgccacagtccatctggggctggggagtccctgattttccttttctcttggccaagcacaggcctgccttcctcccaaagtcagccccaggcgccttccttcaggaagctctacaggcctcacccaccagccccagggctgtgcccaacactgccacctcctgcagcatccgccctctttcccatggctcagcctctggggtggccctctggctgggactggggctctggggctcctggtgactcccaggagcagggacagggcttctcctctgcccccatggccttgccacaccctgaggacaaggaccaggcacaggtggcatggttgttgctgtccgaaacagagctggcagtgaaggcttggagtctccatcctgggggctgagggaaggacagcaggagggacaggaggggaggtatgtctgtctactcgaccctgatttctcagggagacagaacagccaagggcctggggtccccagacttctggccagctgcctctctggggcgaggaagggcctgggtccctgaggggaggagatgtgacagcgggagaggatagtggacaggagcaggtgtgcccagaggggtccccaggggttgggatgggggccaggggagctctgagcctgtgggtgggtgggcatggcctgtgtgtgtgtgtgtgtgtgtgtgtgtgtgtgtgtccctgtgggggggaaactgcctgtgctgcagtgtgatggcattcagggtggcagtcacacactccagggacctgctggtacataaagtcggggcagcctggtggggtccgggccgcctggagagtaggtgtcctgagcgctgggcccagcccatcgtgatacatctaatgataaacacaaattcctaacttttatgggaaatctcgttgtttctaacattggctcctacttttaaaactttctaaacaaatgaagccaaacactcttgggtgcctcgccaaccctctaactgccattttgtagcttctgcgtggaggctgccatggaggttaaaggcagggcctgcagagcagggccctgtcctggccctcccagtgctgtccgcgggatggggaagttccacagccttctgtgcctggtctctcatctgggaaacgggcagaatgaaatcatctcccgccgggctcctgtgctgagcaatctcctccgtgaagccctgggctcatatggcagtcacagtgtgggaatcagcactgcctgaggggctgtggccagggacagtgggaggaagagctgggctcagctctccaggcctgtacctgcctgtgtaatgatgcctgggaggcctgagcctgcagcctgtattgtgtagcatgtgggtgtggcggctacaccccgaggctgcaaggaagtcatttccctctaggaaccctgctgtccccaccctttccctgctggctcagggctgcctcccagtccctgtgccacaacaggtctgacctgcatgtgttggcgctgctgtggcctcctccaggctgcacgccttagaagcaggctacgccttcctgcccttggcctgagaagggcttctccagcacctcggggaccccagcccccagaccctggggtggccactgccccagaagccgggctgagacaggattcaatggggagggcccgtgggcagggcagaggcttgggcccctgggagacctggccctagagaaagaggcgcggtgctcacctttgccccggccttgcaggcctggatggctctgccgccagcctcttttcttgtccaggcttcaggctgagcatctcttagagggcctcagggatgtccagtcctgccctgaaggccgctgaggacttaggatggtttaatactgaacccacagccgctggggacgccttgaggggagccacagtgtgtgtgcatgtctcactctgggctaacttgtgaaagggtgaacagctcaggggcccagaaaacttaactctggggcaggcagaggtacaggggagggcagatgattcagaccccaccctgatgggccgggcagtcactgcagaacccaacccggtgcagtaagccactgcgggcagctgtggcccagccccaggccccagatattgggaggggcccctctcctcccggctgtgccaccctcaccaaagggtaagtgggccaggacagaaggagcaggaggcagagctgcggccccctctcagggaggcaccctcattggatgaccctgtcatggccaagcctgacccaggctcactgggagctaaaaggcaaagaagaataaacccacatctgccctcagggagcccagtgctgagaggcctggcactgggacaaactcgcaaaccagagtccttgagggctggagggggcctcccggggcagggcataggccactgcagggatggcacggaacagggcagcggaaaaggcaggagtccgaggcccagggccctgcctctggcggctgggcgcccttggtcacattgttggtgctcagagcctcagttcccacagctgtgcagcgagaggaagctgacggcaccgaccatggctgtggaggcctcatgtgtcaattgttgctgttctgcaggaggaagaggatggcagggccacgccccagcccatgggccaggctgctcctggcagccttgatcagcgtcagcctctctgggaccttgggtgagtccacgttgccctgcagccccctcctggcaggatcatcccttgggcaggcattgcccttgcacggggatctcacggtgtctcacctaaacacgcttggccattcagcaactgaccactgcccaccttcagggctggaaaacttgaggctccaagctcttcagcctagagaagcttgagccctgaccacggggcctgagaataggagcgaaggaggctgtgtctagaggaaagaggagacacccacccaggactgaggcacccagaggatgcactgaggccccagaggtgtagtcaagagggttataggaatttggagaagagaggcactgctgacgtgtcacttgctctctgagtgtcactagtggacaaatcactggagccagctcctaccacttgaattttgtctgttagagggggtcctgctggtggcttgaaatagaccacgacagaaatgtttacaccacagaaattggcaaacgctacacgtcaagcaccagagaccagagccgttgttatttttttatttaattcaatgtatatgtagaaacatgctctcactctgtcgtcccggtgaaatgcagtgatgccatcgtggctcactgcagcctcaacttcccaggctcaagcaatcctcccaccttagcctcccatgtagctaggaccacaggcatgcaccaccatgcctggctaattaaaaacaatttttttgtagagacagtctcactatgttacccaggctggtctcaaactcctgagcttaagcaatcttcctacctcggcttcccaaagtgctgggattacaggtgtgagccatcgcactggccaccacagccattgttaaacactgaccagcacaccattgcctgaagcccaggagacctcttactgtgtacaccaggtgcacacagtaggtcctcactgtgatttttaactgagcagagccaaagggaaatctagagttttacttcattcgttactgaggacccactgtgtgccaggtgtgccgggtgctagggctaccgtgataaacaagacaccattcccttcaccctagaaggggctcagaggacagacaggccatgtggcagtggtctcgccgtgaggcacaagctgtgatggaggaggtacctgaaaagggtgctaggtgcagctcatcaaaggtaatggggaaggctgaggaccgtctggctggacctgaggaggcagcaggccagggggtggccagggtgtgccagcaccgagtgtgccagtgccactgtctcagtccccaccttctgtccttctggcttgagtgggaagtcccaggtttgaaatcacagcttgtttctagctgtgctacctggggcagatcacatacccctggcctctgtaaaatagggaacggctgggtgcagtggctcacgcctataattcccagcactttgggaggccaaggtgggaggatctcctgaacccaggaatatgagaccatcctgagcaacatagggagcccctgtctctacataaaataaaaaattagctgggctacttgggaggctgaggtgggaggattgcctgagcccaggatgtcgagactgcagtgagctgtgatcatgccactgcactccagcctgggcgacacagcaagaccgtatctcaaaactaaataaaattgaaatgcaggttgggcacagtagctcacgcctgtaatcccagcactttgggaggctgaggcgggcagatgatttgaggtcaggagttcgagaccagcctagccaacatggtggaaccccatctctactaaaaatacaaaaattagccaggcatggtggtgcccacccattatcccagctactcgggaggctgaggcaggagaatcacttgaacctgggaggcggaggttgaagtgagctgagatcgcaccactgcactccagcctgggcaacagagcaagactcgtctgaaaaataaagtaaaacaaaataaaaatacaacaacaacaacaaaccaaaataaatacataaggccgggcccggtggctcccacctgtaatcccagcactttggaaggccaaggcgggtggatcacaaggtcaggagatcgagaccatcctggctaacacggtgaaaccctgtctctactaaaaatacaaaaaattagccgggcgtggtggcgggcgcctgtagtctcagctactccagaggctgaggtgggagaatggcgtgaacacgggtggtggagcttgcagtgagccaggatcacgccactgcactccagcctgggcaacagagcgagactctgtctcaaaataaataaataaataacataaggagggaatccccatctctccaggtgaaggtgcaggtgggaaagtgcttgcctttgctgagcgcctccccattcatgtgcccacatctgtccccccagcaaaccgctgcaagaaggccccagtgaagagctgcacggagtgtgtccgtgtggataaggactgcgcctactgcacagacgaggtgaggacctggcccgggttggtgtggaacaggcaagggtcgggaatagctggtggaaatgaatctagggttggggcagccagggaatgggtgctgccccccagtgaccccctgtccttctggccagatgttcagggaccggcgctgcaacacccaggcggagctgctggccgcgggctgccagcgggagagcatcgtggtcatggagagcagcttccaaatcacagaggtgcctggtgtggggactggggtgggggctccccatgctcagcctggctatttatgggggtgtatagtgccccttggccgggctgggcccccatcgggcctccggagtgaccctctagccagctgtccccttccactggctgcaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctgggtacggcagggccagagtggaggacagcagggcaggagggggacaggtgggcgtctgcttgggaggccaggactcaggacagctgcacccacccagaaggaaacactggacatttgagcccccaaaaaccttcccttccattctcaagggaagaatctcggtcagaccctactcaccactggggacttctgagaaggcccagggcaggcgggcagtggagccatctggccctgacaaggagggcaccccctgccacgaggctgtggggaagcttctgctcctcagagctgggctgcattcccagccaccctgcccttgctgtacgcataactccagacccccagtcccatttccctcatccataaataggaacagacaatgttgtgagcatgaacctttgtccagcatgcaaagcgttaacctccctcttcctcccttctgagccagcccttggtggggggcccgtgtttatgccaggcatcagggctcagctatcccctctctgtccttttgacatccagctcgggtcctgagccagctcaccagcgactacactattggatttggcaagtttgtggacaaagtcagcgtcccgcagacggacatgaggcctgagaagtaagtgactgtgtgggtcccgcaggtgggcaagggtccaggccatgtgacccccactcctctttcacccacaacttaaaattatccttctacggctgggcacggtggctcatgcctgtaatcccagcactttgggagaccagggcgggcagatcacctgaggtcagaagttcaagaccagcctgggcaacatggcaaaaccccatctctactaaaaaatacaaaaattggctgggcgcggtggttcacgcctgtaatcctagcactttgggaggccaaggcgggtggatcacgaggtcaggagatcgagaccatcctggctaacacggtgaaaccccgtctctactaaaaatacaaaagattagccaggcgtgatggtgggcaccggtagtcccagctactcgggaggctgaggcaggagaatggcgtgaacccgggaggcggagcttgcaatgagccaggattgcgccactgcactccagcctgggcgacagaatgagactctgtctcaacaaaaaaaaaaaaaaaaaaaaaattagccaggtgtggtggtgggcgcctgtaattccagctacttgggaggctgaggcaggagaatcacttgaacccaggaggcagaggttgcagtgagccaagatcgtgcataccgcacaccagcctgggtgataaagcgagacttggtctcaaaaaaaaaaaaaaaaattctccttctagttgaaacgagccaggggcactggggtctgcggcgtcttccccctgtgacactctctctccctcccacctctgcccaggctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacggtgggcactgggaagggtgctgccagcctaggccaggggtgagcacttctgggcaagggcctgagctgccccctggcctgctctggtgccaggctcacaggccctgagggaaagcctgggagcctgcaaccccttcaccctgagacaagctcagactctgtgagtaggtctcagttacaatctgagttcagatgtgcctggagccacggtcccctggcctgagcagtcacagcctggtttcgtatcagctaccaaggcagacctgggctttagcgttctggaatctttagtaccctgaacccaccagctgcccagactccacctgttctgggcatccaaataagccatttcctttgatatgtacatccatttgttcattctgaaaatgacatacccatattactaggttagaaaacaaagagctagccaaggcgtggtggctcacacctgtaatcccagcactttgggaggccgaggcggggggattgcttgaattcaggatttgagaccagcctgggaaacatggcaagaccctgtctctacagaaaacacaaaaattagctgggtgtgatgcacgcctgtggccccagcgccttgcgggggccgcatctccagctcctgtttctcagcgttgtcactcagtcatgtgccgtcagatgcatctttcatgagggcacttgctgtgaatccagtggcttaagcccagccccatgttgggacccgcgttccccgtcctacacgacgccgtgatgcgtgtcagcaggcagcctgctcagtgggcacgccccgccttgccttccccagagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgaggtgcggggcccaggtcccacgggtgggaggtggtcaaggtagggggtccatggagcttctcagacacctctccctccctccctccctccctccctcccttcctcccttcctccctccctcttttcctccctttccttcctcccttcccaaagcctttagaccccccaaaatgtgggccctagtgggaaggggaggtcatgtgcccatcttccaccccaactcccaagcaggtgggggctaagagggcaggctctgcgacaccacagtaggttccaggcctcagtttccccatcctcaaagtgggaagaatcctagagctgttcagattcatggagatgcttagcctgagacctggccttctctcccgcagaagcttcacacctatttccctgtctcctcactgggggtgctgcaggaggactcgtccaacatcgtggagctgctggaggaggccttcaatgtgagggcagctcaggctccagagtctgagcccttctggggcagggcaggaagtgggcagggtgggcaagaggtgtcttggatcacggtggagaaatgggtctgggacagaccagtgaggaagggtctctagctatccctgaggccccgaggggccacctgggcctggccctggctcctgcaggctctgtgataccccgcatgatgccagccacacttggaggttggggtggagcacagaggccccccacagagcactgatcaacctccttcctcctttagcggatccgctccaacctggacatccgggccctagacagcccccgaggccttcggacagaggtcacctccaagatgttccagaagacgaggactgggtcctttcacatccggcggggggaagtggtacgcctctgtgggggcagcggggtgggggataggcacagcgccccacaccgagtggaatcgtttaaaacagcggtcaagagcgtggcccctggagtcaggcaggcctgggtgcagatccctgggcctagccgctcggatgagcctaggttgctcctctgcttgttggtttcctcggcatgcaagcgtcgagcccggaggcttgctggggcagtaaatgggttagtgtcacgaagcccagaggccctggccactgtcattgtcgctatgattgtgactgcgctgggaaggagggagtttccagccctgagggaggtgagcaggagctcatttcagggatccagacatctcctaggaacttgggggccgagggccttcaggcatcgatggccccctggtccttggggctgggcctgccttggctgaccacggggcccctgcagggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctggtacaacgcagccccgcagggcgggaggggagagctgagccaagcacccagggaccctgaggaatgaagcaggactcctgtgccccatatcccttgtggggtttcccgaggcacacaggagagcggaagtgtccagtggccccggtcctgctcccccgacgcaccccaccatggtctctctcattccagcaaaaagaggtgcggtcagctcgctgcagcttcaacggagacttcgtgtgcggacagtgtgtgtgcagcgagggctggtgagtggggaagggagttgggcacccaggacaccagtggcccctgatgggaaagctgggctcctgcaggggcctggccctgggtgcaccttgtacacctggctgggggtggggcggcaatcaaagaaacggctaagggcggggcacacccagttgttggtcaaacccaggtcaaagcactttgaaatacagagatatatgggctgtctctagaaagaggtgtgaggattgagacggggttggctgttggggctggggtctggatcttgggggacaggcacacgaggcttcctttttgctccatgcctttggtattctgagtcctgtgtcatattgcctgatcagaagagagctcgtaaatgcacggcagtaagggctttagcttcaggacactgggcgagcttgccacaacttgaggcagagcagtggggaaaggacactggaaggggtgacatgacagggcactggggtttaggtctcagctcagccacttctgtctgcatgactgggagctgcctcggccctctcagagcctcagtttcctcatctgtaaaatgggacagcaggccaggcgaggtggctcacacctgtaatcccagcactttgggaggccgaggtgggtggatcacctgaggtcaggagttcaagaccagcctggccaacatggtgaaatcccatctctactaaaaatacaaaaaagtagctgggcgtggtggtgcatgcctgtaatcccagctactcgggaggctgaggcagaattgcttgcacctagaaggcggaggttgccgtgagctgagatcgcgccactgcactccagcctgggcaagaagagcgaaactctgtcttgaaaaaaaataaaataaaataggccaggcgcggtggcttacgcctgtaatttcagcactttgggaggccgaggtgggcggatcacaaggtcaggagatcgagaccatcctggctaacatggtgaaaccccgtctactaaaaatacaaaaaattagccgggcgtagtggcgggtgcctgtagtcccagctactcaggaggctgaggcaggagaatggcgtgaacccaagaggcagagcttgcagtgagccaagatcgcgccactgcactccagcctgggcgacaaggcgagactccgtctcaaaaaaaaaaataaaataattaaattaaattaaattaaatgggacagcaaaagccccagctttcctcctgggctgtttcggggaatgaccagttcctccttcaggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatggtgagcacaacaactgcggccaatgctgatggcggggtagggagtggacagcaagcatgactttcccgtcaggacccaggttgggagagccagacttggaatcagaatccccaagttcaggcccagcccactctggatgccctgagggccgcccctgagtcctgccccaacctgggcctgacttccctcatctgtaacgtccatgcccaaggtcactgttggcaggactttcccctggttttaagattccaactcccctgaggttctctctggaagttcagttctatgcccaccccacttctccacacccctatctcattagagtgggtgccacccagctcagccctccaatggctggcaggtatatggcattatgatctttcctctctccaaagatgctaaatttctgtgggttttttgttgttgttgctgctgttttttttttttttttttttttttttgagacagagtttcactcttgtcgcccaggctggagtgcaatagcacaatcttggctcactgcaacctctgcctcctgggttcaggcgattctcctgcctcagcctccctagtaggtgggactataggcatgcaccaccatgcccagctaattttgtatttttagtagagacagggtttcaccatgttggccaggctggtctcgaactcctgacctcaggtgatctgcccgcctcagcctcccaaagtacacatctgtaatcacacctgggattacaggtgtgagccactgagcccggcccaaagatgctaaatttctacctggaaggcctggagcttcctctgtattcccatgggtccaggccataggcatacagtctggccaggaacatcagagctgggcaggatcacagaactcagacaaggggacatagggaaggattggtagttgaatggaggaggatgaatgaaaatctactcatcaaatacttatgaagccctcactgtatactttccaagcccctgcttttctactctttcttctgttcttgcttttgttcaccatttcttctcttcgactgtctgtccctgagtgtgctcagagaaacagaagagagaactgggcaccactggagaaaggcagacaagtggcacagagggaggtatgagagaggaagggaggaaggtgcctctggggaaggaggcagggccagagtacaaagggcttcggttctagtccagagcaggacttcatcctttggacaaaagggggtcactggaggttttactttcattttctaactatttgcatattaaccttgtatctagtcaccttgctaaacgcacttatgaaatctaataatttgtctgtagattcttctggatactttgtgacatgttcctcacacttgcaaataaagacaattttattgattgattgattgattgatttttgagacggagtcttgctctgtcacccaggctagagtgcagtggcatgatctcagctcactacaacctctgcctcccaggttcaagcaattctcctgcctcagcctcccaagaagctgggattacaggggcccaccaccaagcccagctaatttttgtatttttagtggaaatagagtttcaccatgttggccaggctggtcttgaactcctgagctcaagtgatcctcccgcctcggcctcccaaagtgtgggattacaggtgtgagccaccacgcccggctgacagttttatttcttttttcttttctttttttttttttttttttgagacggagtcttgctctgtcaccaggctggagtgcagtggcgtgatctcggctcactgcaacctctacctcccgggttcaagtgattctcctgcctcagcctcctgagtaactgggactacaggcatgcgccaccatgaccagctaatttttgtatttttagtagagacgaggtttctccatgttggccaggatggtctcagtctcttgaccttgtgatctgcccgcctcagcctcccaaagtgctgggattacaggcgtgagccaccttgcctggacttatttcttaccttctaatgcttatacatcttatttctttttctgaccttattgcattggcagggacccattagaggttcttagccaggggagcaggagccacatgattggatttgttttgagataattactcaggctgcagagtggaaggtaggtaggatggaggcagagatggagggaaggagattccaggaaagtgaggaagagatgacttctaccccaggctagcggcaccctggctcccacagctctgttcccacaggccctccctgccaggtgggcagcctggactacaggcacagatgtagctctcatctcccttccttgtccctctctgcagaccgaggacgctgctccatgggccagtgtgtgtgtgagcctggttggacaggcccaagctgtgactgtcccctcagcaatgccacctgcatcgacagcaatggggtaggcctgggcataagacagacagtgtctgtcagcaccacccaccctctccagagagaaccctatggagagaggagagggagcaggcagggatggggcacagctggctcactggtgccccctcctaccccagggcatctgtaatggacgtggccactgtgagtgtggccgctgccactgccaccagcagtcgctctacacggacaccatctgcgagatcaactactcggcggtgaggctaagacctacgaggtgtgggcgtgggaacagggcaggcacagggcagtgtgggcaggaggggctaagcctgatgccacaggagctggccaagggcaagaggtttggggagcgggggtctggcagaggcccacccaacacagtgcctgtctgccccgcctttccccgccaagatccacccgggcctctgcgaggacctacgctcctgcgtgcagtgccaggcgtggggcaccggcgagaagaaggggcgcacgtgtgaggaatgcaacttcaaggtcaagatggtggacgagcttaagagaggtaggggcaggggctgagggttggggttgctgagagcctaggcagcgggcatccaacggggcaagggtgtcatcacctggacgggggcttgcagtctgggctaaggtcacacagtccggacaggaactccagagctgggagggaccacagaacccagatagaggacaccgaatcccagaaaagggtaaaagcctgagcaggaggcacagaacccaggcggtgggacacagtctggcccaggaagggaccaagagtcttggtgggaggcacctgacttgggcaggggcatgcacccagcaggggtacatggtcacgctgtggagacacgcagcctcccctcctcgagatcagatacgttttctggaccctgagttcctgggtgatgtccaggtcagggaagtgggggaggtaggtttctaggctctgatgctcctgagcaggggagcccccaccacacccgttcctgtgcctggtgagagcacggctttgcaaggacttccactcttccccaggaggccctgccgtgggtgaggcagatcgcagagtaggggccccctcaccagaccctgggtcctctggggcggaggggtgtggctggggtgccctgctgactggctgtgggtacagccgaggaggtggtggtgcgctgctccttccgggacgaggatgacgactgcacctacagctacaccatggaaggtgacggcgcccctgggcccaacagcactgtcctggtgcacaagaagaagggtgagctggtggggccgggcgcagggagggggcgtgtggccagagctcggtggggaggacaggcaccacctccccctgcctcctcctctccagactgccctccgggctccttctggtggctcatccccctgctcctcctcctcctgccgctcctggccctgctactgctgctatgctggaagtactgtgcctgctgcaaggtgagcacccagggtgcctcccaaggccccacatcccagggtccccaccccaacagggcccccaccctccaccagggtccccagtccccgcctgagttctcatctccccagggtccccaaccccttcctgggtccccacctccccagggtccccatcccaacagggtccccatcctccaccacggtccccacctccccagtgtcctcaaccccctcctgggtccccacctcaccagggtcccctctctgacagggtctccaccctccatcagggtcctcctcagggtccccaacccccaccagggtccccagcctctccacccaccatccccactcctgcagctttctagccagaggcttcagcccgtagagtccagctgtctggattctggtcccagctctgtgaccttgggcaaattacttaatctctccatgcctcagttccctcatctgtaaaatgaagatcatagaattgacctcagaaagtggagctgaagcttaaattagtgaagttcagaagggactgacccatagcatgcaccatcgcccccacccccaccttggcaagacccacaccaaccccatccagcttccggagtgacagtaatgatgatgacacccatgagctcttagcccgagtcatcctggagccccagcccccagctcagcccttgccagcatccgttctctgcttagctcagtgttcctctttgtgctgtcgccacagcatgtccacgtgactccatttccccgccccccatcaccccatgaggtcagtggggcaaggtcaccatgccctatgacagatggagaaattggggctgagaggcaggtgataaatgcacagtcctcagaaggggctgaggcaagctgagcccacatcttccccagctctagtgcccgcccaggacccccactccatcagccatcagtggccagatccctgagagcacctgctctggggtcagccacgtgcaaaaggcctgggagccacaacagggaagaaagggccctgcccgcccgcagctggcggtcactggggagaacagacaagagaaagcgtggaggatggcatagctcagagtagggattgtaggcggcagaccacactccgtagtaacccccagtgttgtgggatattaatgtgcattacataggcaaggagttatgtgatcaaataggtttgagctaggcacggctgcgcgtgcctgtagtcccagctactcagaaagctgaggcaggaggatcacgagtctgggagtttgaggctacagtgagctatgattatgccactgcactccagcctgggtgacagagtgagactcaaaaagaaaaaaaaaaagaaggtttaagaaacaagtttcttaaatttaagttacagtggctcacacttgtaaccccagcactttgggaggccaaggcgggtggatcacttgaggtcaggagttggagacaagcccggccaatatggtgacaccccatctctactagaaatacaaaattagctgggcatggaggtggatgcctataatcccagttactaggggggctgaggcaggagaattgcttgaacctgggaggtagaggttgcagtgagccgcgatcgtgccactgcattccagcctgggcaacagagcgagaccctgtctcaaaaaaaaaaaaaagaaaagaaacaagtttcttctctgcaggacttctcagaggctttgataaagtcctgtgcctaacctgcaagaggggcatggggaatgaattcagtgcttcccaagtgaacctgaccacagaacctttacagagcacccggcaggatgagagttccacggcgcaaactttgggaaccctctgcccccatccccctctatgcccttgtgtgccatgcttacaccctgctaccacctggatattctggtgtctggggaggcactgtcacccctcttgaccattggcatggggcggggtggctggaagggcttacctgggccagggcagctgtctcaggcctcaccctcacccaccttgtctcctaggcctgcctggcacttctcccgtgctgcaaccgaggtatgggcctggcatcgcaggggcagcaggggctctgactgctctttctctgagctggggtggagggaagctgaacctggaacggcagaggctggaggctctggggtcccacctgaagaggttgggctgtgcgggtctagggaggggtgccgtgctgaggaccccatcctgcaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctgggtgagggcggggctgggcgccacagctctgggcagtgcccttcgggccctctgttccagatctgggatcacagcatgcctcttctctgggtgtggggtgcaggcacagggctcagccaccttttgccctgtgctgatggtgctatgaacctcatgcctcggtgtgcgtggcctgctggccaggcatcccctgatcctagcatggttgctggagggatgctctgtggtgcctgtcatgcagggggctgaccacctccatctcaccccctcccaccgcctttccttagtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtgggtatgagggcgggtgaggtgggcagggcagagcgaatgcggtcgtggtaccgagattcattaactaggggagaggggtctctctggacctgtgcctggcagggggcatcctgggatctgtttccagagggcagaaggccagagcctgggcccaggatgctgccccacggggcatgccccagccaaccctgaggatctctgggtacagaggctgcctggctccctgggtccccagcctgagggcttgccacggggtggcctaggcccagcctcacgcccctcccttgcctggcagctgaacgaggtctacaggcagatctccggtgtacacaagctccagcagaccaagttccggtgagtcccggggtgcccgggttgggtgggggagccgctcctaccgggactccaggagccgaagcccccaggccgatcaggcctccacttcagggctatctagctcacagcgccctctttgtccccacaggcagcagcccaatgccgggaaaaagtgagtagaagactcgtgggtgagagggcccccacttcctgcccgcctgtccccagcccagccactgcctcgtccgtccctactccatctccatcccataggaagggagggtcagatgtgtccgtcaggttcggaccttcattcgttcctttgaccatttcttcaacaaatgctaatgtgaagtgcttgctatgaagtggcccctggactagagcaggcaaaagcaaatcaacccagtccctgccctcatataggtgactgtccagccccccacccggtaccagcgatagcaggtacccatctccatccgctccagtgtccaagaccctgatcttgggtgcacctctggggaccaggcaggttaccgagaggatgggccagcaggtcacacaccttttttcccaggtcctacatcgagtcctggcccttcatggggagagagagggagtgaggagggggtcttgatgcagggacagaagagctagaatctcagcacatgaccatcagtaagaaccgttggctgtgcgtggtggctcacacctgtaatcccagcactttgggaggctgaggcgggtggatcacctcaggtcaggagtttaagactagccaggccaacatggtgaaaccccacctctactaaaaatacaaaaattagccaggtgtgttggtgggcacctgtaatcccagctacttgggaggctgaggcaggagaatcccttgaacctgggaggcagaggttgcagtgagccgagattgcgccactgcactccagcctgggcgactgagtgagaatccgtcttgaaaaaaaaaaaaaagaatggctgaccagcatttcttatcctgctacgggccaagcattgtcctaagggctttccgtgtgtggtcatcttatccaaccctctcgtcaagcctgtgaggtagagatcactgctgttcccattttgcagatgaggaagctgaggctcaaaagggttaagtgacttgcccaaggttacccagctatcgagaactagaaccagggctagggccgcggcagcctggcctgagcacacacacccttagcatctttgctgtccagcccttgatgaggtgggcagagaagcccatttcacagaggaggacgctgaggacagggaggcgccatggctgggctgaggctgcagggtaaagggtatggggctggcataggcctggagcactgcctgcctctgaagaccctgcacttcttgctgtcttacatcctggcccctgaaggggagaagacaggcaggagggacagggcagcaggtgccagcctgacccctccgctgcctgaaccttccaccctcgacccaggcaagaccacaccattgtggacacagtgctgatggcgccccgctcggccaagccggccctgctgaagcttacagagaagcaggtggaacagagggccttccacgacctcaaggtggcccccggctactacaccctcactgcagaccagggtaggagggcgggtccgctgtgccactgcctcgcacctcccgcctgtgtggccctgtgacccacctctgaccacctccgaacccccacccagacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaaggtgggtctgggtggggagagtggggaaggcagacgggggctcgggggcactggttcctcctgcttaagtggaattgcgacctggccacgtggcctgggctagtcacttaacctctgcaagccttggtttctccatctgtaaaatgggtaagggctcttttacggaatgcgtggctgttcacctcgccacagtgcctgcctggtggtgagcgctcagtaaatggaagcttctgttgcatcctcataagggccagccccttgctcctctctatctagaaaaagggttggccaaggcatcacaccgtggacatctgacccctcctcccacctgtgccggaagccacaggcctcaggcctgttcctgctctcctccagccctggggctgaaggctccatctctggtcctgcccgtgactggcctccctcctctgcctggcccttccaggatgtctgctggacactttgttccagaaccacttttttttttcttgggacagagtcttgctctgccacccaggctggagtgcaatggcaccatcttggctcactgcaaccgctgcctcccaggttgaagtgattctcctgcctcagcctcccgagtagctgggattacaggcactcgccaccacgcccagctaatttttctatctttagtagagatggggtttcgccatgttggccaggctggtctcgaactcctgacctcaggtgatccacctgcctcagcctcccaaagtgctgggattacaggcacaagccactgcgcccggcccctcatctttttctggaaggattttccgtttcgctcctgtgcccttcccagagggcaatgcatagagggaaccaagcggactcctggattctgggctgggctgggcagggtcacaggagagcaggaggtgggaagggactgggcccagcacactctgacaaatgcccgggctccttgcagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggtgaggctgcgccacagggtcgagggtgcagcccggggggctgcgtgggcaccgcattgggttcccaagacaaagcagcacatggcagctgcttgagtccctggatactggccgtgcccctggctggcctcccaaggacacgtccacctgctcctgccaccctgtggcaggggagtctcacctgcccagggtgccagtgacacgctggatgaggctccattgctgccagggactcaggccaagagggctcgctcttttttttttttttttttttttgagacagagtttcgctcttgttgcccaggctggagtgcaatggcacaatctcagctcaccgcaacctccacctctcgggttcaagcgattctgctgcctcagcctccctagtagctgggattacaggcatgtgccaccacgcatgtctaattttgtgtttttagtagagacggggtttctccatgttggtcaggctggtctggaactcccgacctcaggtgatccgcccgccttggcctcccaaagtgctgggattacaggcgtgagccaccgcgcccggcccaagagggctctttcttccttcatgggccagggacctgcccagaccattcctgtcccctcctacaactcaggatccacagggtagccaaacctcttggagataaactccccctatatgccccagtccagggggctttgggtttcttgagctgggatcgaagaccccatgtccccaggccagactccccaagggctgtcacaatttgccaagcagcaggagcaacccttcaaggcagggagtgccatggctggaccagcatcaccttcactgctgagccccagtgctggggtacagccaaatcaggtggcacacaggctggactgggtttacaggcttcatagttttgtttcttttgttttgtgtggggattttttgcttcttaatttttgggggagacagggtcttgctatgttgcccaagctggtcttgaactcctgacctcaagtgatccacccacctcggcctcccaaagtgctgggattacaggagtgagctaccacgcccggcctagtttttgtatttttagaagagatggggttttgccatgttggccaggctggtcttaaactcctgatctcaagtgatccgcccacctcggcttcccaaagtgcagggattacaggtgtaagccagtgcacctggcctttctagtttttaaatgttggcaacaaatccataattaaaaacaaaggcggggcatggtggctcacacctgtaatcccagcactttgggaggctaaggtgggagaatcacttaaacccaggagttcaagaccagcctaggcaacgtggtgagaccatgtctatacatataatttaaacattagctgggcatggtagtgcatacttgtggacccagctacttggaaggctgaggcaggaagatcacttgaggccaggaggttgaggctacagtgagccatgttcatgccactgtacttcagcctaggcaacagagtaagaccctgtctaaaaaaataataataattaattttttaaaaatcaaacaaaaaaacaaagaaacaaaacctggctcagtgcagtagctcatgcatgtaatcccaacactgtgggagggcacagtgggaggatcacttgagcccaggagttgcaggccagcttgggcaacatagtaagaccctgtctctattttaaaaaaataataataataataaaggccaggcgaggtggcgtatgcctgtaatcctagcactgtgggaggccaaggcaggtggatcgcctgaggtcacgagttcgagaccagcctggccaacatggtgaaaccctgtctctactaaaaatacaaaaattagctgggcatggtgacacgtgcctctaatcccagctacccgggaggccgaggcaggagaattgctggaaaccaggaggtggaggctgcagtgaaccgagatcatgccactgcactacagcttgagcgacagagtgagactctgtctcgaaaaaagaaaaaaaaaattatctcaaaagtaataaagtctcgcctccctgggcccacaggcccattcagcaaacataggggagcgcgtagtcagcaggcccgggctgcctggccacatcctaattttatttacttctttttattgacaggaactgttctcattatttttccaatgtccccccataaaaattccaaagaataatttttttcttttaagagacaaggtctccctctagtccagggtggagtacaggggcacagtcctagctctctgcaatcttgaactcctgggctcaagcagtccttcaacctcaacctcccaagtagctgggactacagatgtccaccaccgcacggctaattttgtatttttttttctttgagacggagtctcactctgttgcccaggctggcgcgatctcagcttactgcaacctccacctccagggttcaagcgattctcctgcctcagcctcccaagtaacagggactacaggtgcgcaccaccacacccagctaaattttgtatttttagtagagacggggtttcaccatgttggtcaggctggtctcgaactcctgacctcgtgatccgcccacctcagcctcccaaagtgctgggattacaggcatcagccaccgcgcccggccattttatatttttagtagagatagggtttcgccatgttgcccaggctggtctcaaactcctaggataacatgatccttttgccttgccttctggctaccctgttacacttgtataaagatgctttgaggctgggtacagtggctcatgcctgtaatcccagcactttgggaggccagggcgggcagatcgcttgagatcaggagttcaagaccagcctggccaacatggcgaaaccctgtctgtaccaaaaatacagaaaattatctgggtgttgtggtgtgcacctgtggtcccagctactcgggaggctgaggtagagcccagtaggtggaggttgcagttagccgagatagtgccactgcactccagcctgggtgacagagtgaaacccctgtctcaaaaaaaaaaaaaaaaaaaaagctttgatatttgttttttaaaacattttaatttctcacctttttatttttaaaaacttcaacttacagaaaaatggaaggaacagtaaaactagcacccatttaccctttacatagattcaccgattgctaatatttgctttctctctctttctatatagatagcaacatagaaatataaatagagatgtggacatctgtatcttcacattgattatactagtacctaaaattagtccatattccagccaggcgtggtggctcacacctgtaatcccagcactttgggaggctgaggcaggtggatcacctgaagtcaggagtttgacaccagcctgaccaacatggagaaaccccatctctactaaaaatacaaaaattagccgggcatggtggcacacgcctgtaatctcagctactagggaggctgaggcaggagaatcatttgaacccagtgggtggaggttgcagtgagccaagattgcgccacttcactccagtctgggcaaaagagcaaaactccatcccaaaaaatatataaaataaaataaaataggtccatattccaatgtccccttgttcggatgtcccaataatgtcctttatagcgtttttccccccaatgcaggaactaatcaaggatttggcattgacttttgtcacgtgtcttgactcctttaatctagaaaagtttcctggctttgtcttccgtgacactgacttttgttaagacaaggtctcgctctgtcacccaggctggagtacagtgcctcactgcaacctctgcctcccgggttcaagcaattctcctgccttagcctcccgagtagctgggattacaggcaccggccaccatgccgggctaatgacactgacgtttttgaagtatccatgtaggttgcttgcaggcagctccctggtttgttttttgtttgtttgttttacaactatgggtctcactttctgagttgggtggcatgaggttgcctccccagccatcgccctggctgctgcgcctggaattgaaatcttgccctgaagtgccacctagtggtcttctatgtgaaggattttctttttcctcccagttcttatcctggaaagctcaggcatgctccacggcactgaaaggaagatgggtggctcacgcctgtaatcccagcactttgggaggccaaggtgggcggatcgcttgaggccgggagttcaagaccagcctaggcaacatagggtaaccgtgcctctacaaaaaaaaaaaaaaaaaaaatagccaggtgtggtgcacgcctgtagtcccagctactcaggcggctgaggggaaggatggcctgagcccaggaggtcaaggcttcagtgagctgtgattgtgcccctacactccagcctgggtgacagagtgagaccctgtctcaaaaacaaacaaacaaacagaaacgtggctgggcatggtggctcatgtctgtaatcccagcactttgggaggccaaggtgggaggatcacttgaagtcaggagttcgagaccagcctggccaacatagtgaaaccccatctctactaaaaatacaaaaattagctaggcgtggtggcaggtgcctgtaatcccagctactcaggaagatgaggtgtgagaatcatttgaacctggaaggtggaggttgcagtaagccgagatcatgccactgcactccagcctaggtgacagagtgagattacgcctcaaaaaaaaaaacaaacaaaaaaaacacaaaaacctgaacctcgtgtaagtactccacccagcaagcagggatggtctctgcagtgtccatgaggttgggagggagcgtgtggccatgactcttgcctcagcccccagccatgaccctgaccctgaccccctccactcccaggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccaggtaggcagagcctgggggtcggcttaagcaggaggagagggaagactggggggtctctcaactaggtctgtcagacttagcaaatccaaacacaggacgcccaggtaaatctgaatttcaggtaaacaacatacacgttggtaggataagtatgtcccatgcaatatttggaacatacttatccttttttttgcaaaatgggctgggtatactggctcacacctgtaatcccagcattttgggaggccaaggtgggaggatcacttgagcccaggagttctagaccagcctgggcaacatagtgagacctcgtctctacaaaaaataaacaaattagcttggcatagtggtgtgcacctgcagtcccagctattccggagactgaggtgggaggatcacttgagcccagggggtctgggccgcagcaagctgtgatcgcaccactgcacagcacctgggccatggaatgagatcctgtcccccaagaaaaaataatcttgttgtttatctgaaattcaaatgtaactaggcatcctgcattttatctggcaaccctacagctagagaggctgttgtcaccacacaataggaattctcccatcagaccctggccctttggcttcagcctcaattccaactaacatgcagatgcttgtggaaggaaggagtgggccagttagttcctatcagccctcagcctcccaactgggagaaagcctgccaggaagatgggagaggagggagatactcagggtacagtgtggagatggggtggggagcaaatgttctcatgtggaatgttccctgagctgccaagggagaaaggggcagaccaactccctcccgcttctgttcctccagagaccctcctgggtcctccgccaagcttggcaggatgctctatgtggcagcaatggggcaccaccaggtctccagagacgcgggtgggcaggtctgagttgaatgcgctgggtagagcgccctgggtgttgaagtgggtctctggcgccccctggtggtgaagggggatctgagtggttgcccggccccaacctgacccgttagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaggcggggggctgagggtcacgacaggtggatgggcggtctggcaccagcactcacagaagaggtgggccgtccaaggccagggccccctgagagagagcagacagtggaacctagcacaggtggtcagagggaaacccggtctgtgctgggaaagagggaagacccattcctgagtttatcagacatttgccctccttcctagaatggggccccctcccacccccgcatgggagatacccccacctgctctgccctagtcctgacgtgtgcacatggcagatctctcagcccctccctcgggcctcatctgtgcaaagaggacagtaagggcagaggtcagaggagggacaggcagcttgggtgcctgctgctccctgctgaccaggacccctgtccctgggggtaggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaaggtgaggcctcgccatgtctgtccatttgtcccctggctgccctgatgccagcatgcccagacctccctccctctgccactgacagcactcttcctgtattccccgctccctagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgtaagaaccagatccttctttcctgcccacagggagaacagccatggaaggggaggggacaaagctggagggagctcttggtcactccctggacctgctgtgcagggcactcgaggccttcatcctggtcagcggataagcctgaggcatctttagggttttggccagatttgggctgggttgcattctaagaccaaacccagaaggttgcagggtgggtggttacctatgtggagtgaggtcacaggcccaggggtacccctccccatgcaggtaaccagggagctcacacgtgcatggttttcttagggtgagaggaaagttaccggatttagcaaacagaaatacaggaggttctgaatttcagatagcactttaaaagattattttgtacattgagaggccgaggcaggtggactgcttgaggtcaggagttcaagaccagcctggctaacatggtgaaaccgtttctactaaaaattagacaggcatggtggctcatgcctgtagtcccagctagtcaggaggctgaggcaggagaatcacttgaacccagaaggcgcaggttgcagtgaaccgagatcgtgttaccgcactccagacagggtgacagagccagactccgtctaaaaataaataaataaaaaggattattttatacattattttatctagcagcccgagatcagaggtgcctagcagaacagttatttctccagtcctggaagggaggcagggtgggcaacccctatgcgtgcccttgccttgtgtggaggcaccgtggatatatgggtagaggtgacatcgaggccaacttgagtccagccctggctctgccacttactcagcagagtcccttggaggactggtgacatatgtccacgccagtcatgctgacgctcagggctccgcaggcggcaattcagcagtggctggctttgccttgcttccccagcccctgggtgccatccaggggatgcacggccgtcctgctgtgtcaggggtggtgttgggaccaggctgggacctgggtgaccctctgaagcactctctctgccccaggacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccagtgagtggtgggcagggaggtgaggggcagaccgggcaggggggcagggggcagcagccagggccctggctcactcccctgccctgcagtccccatcatccctgacatccctatcgtggacgcccagagcggggaggactacgacagcttccttatgtacagcgatgacgttctacgctctccatcgggcagccagaggcccagcgtctccgatgacactggtgagtggagacctgggacccacaagaggacagtgggggtcttgggtacagagtgagtccactgggtccagagagggcaaaggggccagcaactagaggacatggaggttaaggcagccttggacaaatgcaatggagtgcacatctgtgcatggggcacaggaaccagtgcctgggggacagacacacacagccttgtgcaagcgcacatgagttcatgcccacgggaccacgaagaaacacagcttcacaagttgaaggttcaccagctgtgccatgcacacaggacactcaggccaccccccaggggcaggcctggcccaggagccctgggcagccaccaggcggccacctggcaggggtaggggagccaaggagacaagaacacccccaacagctctgtccttcctccttgattcccagcacaaagtgctgcggagcccttagctgggcctcctgagtgctcagtgtcagctgtggctccacctgtgggacatcagatgaatcactcatcctttccatgcctcacttttctgctctgtataatgggataccaatcacacagtaccatgagtggaaaaacctctggggcacgtatatcttttgtattttcttctgtccctgccgatgcctcaagctgcccccggtgaacacatactggcccccacggggctcagcttgggcttaaggagccattttgaggggttcaggtggagcgcagctggtgtgactctggaaccccagctcagctgcttctaacactacctgcgaagcgctcggtggcttgcggaacggtccctgggaggcgggcaggggcaagattcctctctccattgtacaaacgggaaactgagtctcggagaggttaagtaaagcaagggagacctcacagctggtgacagagcccagacttcccccaggtttctggcgggtccgggggtctctcctccccagctgtgccgaggctgcactcgctcatctggaaaggcttcagccgcgcaagggtttcacctgccgcggccttcccgctccggccgtgcgcatctacccccgcccccaacacacaccccgggatcccgggagctggagacgggctcccctcgcagagcctacggccttcccccgcctggccctgctcggcccggcgccccccggcggtgccaacgcggcccttcgttgttcccaaggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggaggtgacaggctcacccgccgccccccgatccgcgcccacccagcctcactcgcgcctgagggcctggggtgggcgtctgcgctgcctcgggggccccagtttcagccaggcccgggccttggcggctgggagcacagctgctcagaggcagggcccagtgccaggggacgcgtgaggcaggcgcttgggcccttatggtgcctgcctggccagggggtgcaaattcagaagtctgcccgggaagcggaccctggcacccaagtagacccctcaggggcctcaaaggacaggagggaaggcttggggatctccccagggcagagctgactgcagacgcagcaaacccccgccactgccagggtcagcagtgctcacaccgatagagtggccggccagaggatatgggctgtggaagcctgggtggcccttgggctcctgcagggacagagggcctctgtccctagtggtttgagggaaactggttgtatttaagcaaaagccacccagagggtgggtgaccaggaatgtgcagggcccagcctgccccacggggcccgggtctggggcaggcctgaccaagggaccctgctctccccctgcagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggtgagtgacctcagccaaccctgcctctcccactaacccttcctctcttccagctcctggagcctcgggcttctgtctgctgtccccaccgcccattctccaacatacacacacgcatgcacacatgcacgcacacacgtgcacacgcatgcacacatgtacacagacatgcatgcgcacacgtacacacatgcatgcacactccctgctcctctcactcttgttttgtcctgccctaggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccaggtagtacaggggtggccatcctgtctccacagctgtcctgctccatctgtcatccagccaccatagcagccgccagctgtgcccactgcttcccctccattccatccacaggacccccgcctgcccacaggcgctaaccacctgccctaccatcagtgctgatgcctaactctgcctctgccctcccagggggcggggctggggctggggcaggagaggggccaggccagctgagcagttgagggggtggggctggcagactcacggggctcactctcttttggcacaagcagggcctgcaccctgctggaggatgtgcggtaggtgctgggcagcctggacagggtgttgcagggtgagtgagttgtccagccagcggtcagtgtagacatgccagctgagggagggaggtcagggggcagcactgtgactcccactgagaccctagcccctgcatctctggctgactgcggcctcctgtccccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgaggcatggtggctgccaggctgcggggtgcagccctgcaaggcctggccccagtgtgacacatagggtacctcagctgtgtcaggaacccacccaagtcccttgagcgctaaagcccccatccagcctgagagggtctcccaccccattctccaccccacttctttgcctcccctcttctgaggtctcacccacctccctgggcctctctcctggtcattctctgctaggttttgcctaacaaggcccctttgggctgggatcctagggcctctgctggcctgagatgcctttgggggaacaaggaagtggcacttccctgggcaggcacattcaaagcagcatgaccaggatgcaggatgttgcctaaacatgagtgggattacaggctccactcttgtatagtacacaatctgaacaaccagccataccatactgtacccaacctgtacccaaaccacagctagtcctgggtgggtgataactaggtctcgatggcagcttagggacgaggaggatcaggccaggggtgggagtaacactgcactactgtgtgcccccacctgatccccccaggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggtgagttgcctcccccagccccagagctgcccccatcatgcccaccacccacccacaggctgatgctcttcctctactgcccccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggaggtgctgcccaccccgggggcaggagtggccaggggaggggtaaagagggggccgcagacgctgaaggcatcttccctgctcagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggtaggcacctgtcctttccttcacccccacccctcctcgggccgtgcctccttctggcaccaccctctgactggcctatctgcccaccccaggacccttcccgcagctgggcagccgtgccgggctcttccagcacccgctgcaaagcgagtacagcagcatcaccaccacccacaccagcgccaccgagcccttcctagtgggtgagcactgagggctaggggatcccggctctcctgggacagggagctagcagagggagaagggcagaccccaagccaggtcatctaatgcctcctcctccacagatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 97 - DNA, 32933 bp, Homo sapiens
gggagattcgattggaaggctgccggcgtgctactgagttcggccggtccgagtcactgtgcgtcgcctgggcccgttcctggtcttctcccccaggtgagctgggtaaaggggttctcgggaagccgaagagccggagactcctaaggaggctcttaacttcattatgaatgagacccacccagagcccggcgcttgttttttcacaagtggttctctgtaaacgggcagccatgagggtaacagaatataaacgtcagttattttattttagactcagtgcttttgcaatcacctaacgaacgtttattgaacacttacagtgccatcgagctagactcggagtgagcttttagaatcggaaatagagaggaaaaggcgcgactcttgcttctgtaatgtgcaaatacgtattcagtgggccactgtgcagagtagtacgtgctgaaaggggatcttccaaaatgctatgatggcttagaaggaacatattttaactgagccatgtgcttaaaccagagcttgaaagttttcttccttttcacatccagccagtccctaccagcctcttgaatatctcagatctgttcacttctctccgttttttactgacattattttggttcgaccctatgactgctacatagctgtgacagtaacccccccctcccccgccgccccagctggttctcctgctttcaatcttgctaccttccagtccagtctccacattgctgggctgataaagttcatatttgaccgaggcactccccattgaaaacctttcagtcgctcctatttgccctcaggtttaagcccaaactctttaacatgacttacagactctttcctatctgacttttgcctggctcttcagccctagtggttttccaccgctccagccatatagaatgtcttttgtgttcctgaagtgcactatcctccttctcaccccaaaccgtcttctgaccctgtccctgacctggctaattcttagtcagtttgcaaagccttttaaatcagaaaccctttcctgaccccacaggactggatcacagagcaccaagtaattatttgtttattctgcagatagttaaatgcttctttcgtctgtgccaagaattgctaggtactgagatccaatgatgaacaaggtagattcctgttctaatggaacttaccttttatggatggaattaaggagaatttacaaggaaactatgtgaattagactggtctaagaagacctttccaaggagttgatactgatgcctaaaagatgagcgtgatccaaccatgcaaaagagggaaagaaaaacattctaaacagagtgaacaggttgtgcaaacgtcctgaggcaggaaagagcttgacatgttaatgttcaagaatctaaggaaagaccagtatagctggaatatatttagaaaggacagttgtatgagatgagtctggaaagatgggcagagaccggatcatggttaggaggttaatccagcaccataaacaggagataatggtgatttggattaagatgatggcagaatatatgagggaaaagtgaatgatggtttctaagtatggaagtagattcaagtaccttctgatgagtgtgatgtgggatatgaaggaaagggaggaatgacaaatgactcctaggtatctggtttgagttactggttagtgagtagtaccatttactgagatgtgaccttctccatccctgtaataaatgtctcataaatgatatcaatggaaaaactgtatcgtactaagattttcctggttcatgtttttaaagcatttttcatcagtatttctcctttcactgaagattttgtctctttgtttttttgcttacttaattttcactctcctgcctgcctctcttacttttctagaattttcgtgtcaatgttactaaattattttttagggacttattatgactgcctttagaaaaattaaacaagtatgtgccattggaggagaccattagacagtgttaagaaaacaattcaaaacagccacccttcccatagctgaggcctcttggcctgtaaaatatgaaacagaaaattggagaattacaaggtgacaaagattttcatgcaaggcaagaagggtttggagaggaacgaagaaagggagaaaaattagtcatactttcttttctttatgccattagaagtggaactagttttttaaaggagtaatttcatcctttgggcacagtcttgaagcaaatacacatagtttctttcaagtgtgaagcttgagcaaagagagtaatggactagaaagactggtaagctactcatcagaaggcatgagttccagacctgattaacttctctgagtggatcagataatgttgcaaaagcactttgcaaactgtaaagcagtcaaatgaactcaaactggattatgaactttaagataggattcacatcttatacttttatgttctcttcagccccatccccagatgccagtttacactaaatacttaattgaactttttctctaggatctaacatagaataagaattagtttagattttctaatctaacccagtttttctagatcttctagtctagccggaagaagaaaaaaagatgtgttggtatgtgcatgtatgggcacggtttttcataaatgattaagttgccttctgagaacttgattatgaggtagttaagctgaaagatcaccaaataatggattagagtaaagaattgcaaaatcatccaaatgagactaagatgctgtcaggccttggggatttaactataaccatgtttatcacaagtgttacacaccatgagatagtctcaatgactaggctactggttttcaagtgtgggcaatttggccattacctgggaacttaaaatgcagattctcaggcccttatcccagacttactgaatcaaactctggagttggagcccagcaatctgttttatcaagccttctgggtgattttgatatatgataaagtttgagaaatacttgtctagtatgaaaatgggatgcagaggttgtaatcaatgagtttatatatctggtaccactgacaaaaccatctctagaatgaaaaatgcatcaggcattagcttgattccattaaatagttgattcaccaaacagctcttcttcaagcaactttctgtttataattttagtataatatgaggttataccaaatatacaaatatgggcttctgatatgtcccttccctgtgatggtaatttttcgtggtaaattagtagaacatctttggattacagttcagctccccatatggcttgtctaaaaggagagaaagcaagtattccagaatatcccatggtaaattagatatgtactatagtgtgtccacatggaccccacatattttaataagcataagtctattggagccttcattcctggacattgacctaggtaatccctggtatgtgccctttgaaaaatcaaaggccaactgaggccttaattagttctgccccaacacttacacttttgtccctctttctaccctcatttctacttttatgtgtgagagatttaaagaaagcaagattttctttgtatattattgctaatgtccctatccagcatttttatagtatttattgatttttttctaattataaaagcaatacacttagattgtatttattgattttttctaattataaaagcaatacacttagaaaatatcttaaatatataaagaaaataaaaatcgcccttaacactaccaccctgagaaaatactttttaaaaataagattatatactttcctaactatcctcttctctttccccattcctcccatcaaaaactaaattagtccccctgttatattttctcatggcactatgcatttccaaaatagaatttgccagaattgcagttaaattttttgtgtgattattttaatgtctgtctcttacactagactgtaagtctagtgactaggtagggaccttgtctgtttgtccatcaatcacactatccccacctagcatttagcagctgcacaactaataactgatgaataaataaatatgttcgcatattaaattgggatatggtttgctgtgatggagctgaaagaaatgtaatactatatcatcatccttcccaataaatgtgaaaagaaagataaactgcaaaagataccacatatgaaattgttcccaagtgtatcatcatatcttcctaattttagtatttacttattcctgatgtttcattcaattattcatcagacatgcatccactatactgcaagtcaagcagtagagagagacagagaaataaaacaaagtataaaaacacccccagagcctaggtaaataaataaataaatacaaaaataaactaggtggcaagtatgaaggaaatattatgaaaacaccaaaggaaattaattaacagtaactgtctgaaacgatcttattctattattgtccaacagacaataaatgggaagcctttttgccattttctggggttcaccaggtgaaatacaaatagtaaaaatactaatgatccctttcattacagttctcaaatttgctgtttttatagatttttagacttacttatttgatccactagagggcagtaaacccttaaataaagacaatgtaaccaaccttcctttaaaagtatagtaataagtgctggcacaattaatttagaaatgaacccaaaatttcctgcttatttaagtttttcatttattagtgagttgtctgcccaattagcaattttttttaggacagacagtatcttattttcacttagcccagtgtacgagtcatgttacaagtttattacatttcctaaagtttgaataacaattgtgtaaagaacatgatttgatgaatgcccatattgttgtggtacagtataaaattctgttttagagccctaaagaaaatagtctctgctcacaatatgaacagaagtaaaaaaattagaagtgaggataagatgtaagtaatgattaaaataagtatgaaataaggtactatatatgaaactaggctgtgtacttcgtatacaaatagaagataattttatgatttggtaaaattgtgttttatatttaacgctatgtgacaaaattgtggcttgggaagaggaaatgcaaatcatgaagattaatatctgaagttcagattgacaatttctgagcttggcactgaagatataaacagatagtccttctacgatcttactttgagtccaggaaaaacaagccatattgaacagataaatttaatataatgtggcatgtgatgaattaaagagtaatttaacttctgggaaaacgtcctagaaaagaagacttctaagaaggatcttaaagaataataagcattaccaagagaatgaaagcattttagagagaagaatggaaaaaagcaaaggcatagaaatgtgaaacatattgtgggggtggggaagcaaggaacacaactcagattgtttctcttggcataaattactagcacataaagagcaaaaagaaagttaagagaataggcattagggagaataaaaccaaatagacaatacactacaatagacaaaacaaatggtaggactacagaggtacaatagtatatggtgtagaaaaaaagaaaagccattccctttgttaataaagaaagactttttaggggaacttcaaatgaaataggaagaaaattctggttatcgtatggcgtctgcctactctgttgtaaaaattttcttgaattgcaaaattctgcttatagttcttcattcatgcaataaattttgttttgagactagtctttgttgcccaggctggagtgcagtggcgcaataccgcgcactgcagcctcaatctcccagactcaagtgaccttcccacctcagcctcctgagtagctggaactacaagcatgcaccaccatgcccagctaatattttttattatttgtagagatgagttcttgctgtgttgcccatgctggtctcaaactggtgggctcaagcaatcctcccaccttggcctcccaaagtgctgggattataggcctgatccaccacacctggccccattcaataaatatttattgtgaacttactgtgtactgagcactgttctaagcactggggttacagtagagaacagggtggactaggtccccgtctttatgaaacttaggctagtgatgggtagatgaacaaaaataagtaagcaaagacatacataggatgactatccagcagggttagtaccatgaaggataaaacaggtgatgccatagaaactaagaggaaggaggattctacttgagctaaagtggggctctctgaagggataacattagagttacagattgaaggacaataaagaaccgactattccaagacctaagggaagaatatcgtagccaaagagaatagtaagcacaaaagcctgagaagggaaatcgtttggtgtgcttgaggagcagaaagaaggccagcatggcttgaaatacagtgattgaggaggagagtggtacaaagtgaggtcagggattggcaagatctacatgacccagggctgcacagaccattgtgagatattgaggcttcattctaaatagcaggattttaagcaggtaagagacagcatgttcaggagtgagctttatgctcttttagctcccctaactcacaggtagatgtacctccatactaaaccctacactaaattggattttagaatgtggaggacaatgcctttgttgacataacatcatttgttatgttaactaaaagttataggaggcctttgttttggactaagctcctgcactaggccccagtggaccagactaaaaatcaaaatagagtcatttatacttaaagttccacctcaccaaatcaaaactacattgttatctgaccttcctagaactcagaagagagaaataaccaaatttcccacatgtgccagtttcaattgtcataacaacgaacttcgctctgcctttgatgcttacaacaaaaagtagccttatgttaaccagttattcctgtatttttctgttcctctgttcccactttaggaggaaagtaactttgaaatgaccaagctgctttttgttctttgtttctactttctttagcccttctctttctgtaaaactgaacttctctgctcagccccttgggtcacttactctattttatggaataaagtatttcccgattctagaattgttacaggaaagtagtcccaattcagacccccagagaggcttctttgatctcgcacaagaaagaattcagggcaagtccataaagtgagagcaagtttattagggaagtaaaggaataaaagacatagaacagccccgagggctgctggctgcccatttttatggttatttcttgatgatgtgctaaacaaggggtggattatttgtgcctcccccttttagaccatatagggtaacttcctgacgttgccatggcatttgtaaactgtcatggcgctggtggcagtgtagcagtgaggacaaccagaggtcactctcatcaccatcttagttttggtgggttttagcaggcttctttactgcaacctgttttatcagcgaggcctttataacctgtattttgtgccgacctcatatcttatcctatgacttagaatgccttaaccgtctgggaattcagcccagtatgtctcagcttcattttacccagcctctagacaagatggagttgcttttttattcaaacacatctgacagaatcataaataaagccaattaagatctttcacaaaattgttgtaattttgtcttttgacagttgcaatggcaaggaatttgaggttttagcacttacaatggcaattttctttgacccttctttctgcctttcctttgtatcctgtattacctaccctaccatgtcctttgagattgccatgtagcctaaggtgacaaccaaatctaggaatacataatcggctttggcagaaccttactaatgtatatataagagtcccaacaaggatagcaaaaaattaggattagcgttctcttttctgtgctcccttcagtaatacagattagtgatttatttaaattatttatctttcatctgtaaatttccatcttattaccttgagtggcaagattttatttttatagaaatgttattttgattgactatcagaattagtatcactttaacatctcccttccatagtcaccacatttctatgtttgtcatcatctttagagtactataccgaaaagattttattattttaaaaccagtgacctccactttgtcagtttgctgatgccagtgtcaaaaacagcatcacccatttcagaattgaaagtttttgccatgtgtttaaaaatgaaagtttcttaatacagctttatctcaaacagttacaaagacctttgttgtaaggcatgtattttatgttatatgttttatgttatgctaatccatttaaaaaattagtaaacaaaccaacctttttttttttttttttttgagacagagtttcactctgtggcccaggctggagtgcagtggcatgatctcggctcactgcaacctccgcctcccaggttcaagcaattctgcctcagtatcctgagtagctgggattacaggtgcacaccaggctaattttgtatatttttgatagagatggggtttcaccattttggtgagactgatctcaaactcttgacctcagatgatgtgcctacctcggcctcccaaagtgctgggattataggcgtgagctaccacaccctgccacagatcaagcttttaattttttctctctctctctctttttttttttttttttttttttttttgagaacaagtctcactctttcacccaggctggagtgcagtgccatgaatacagctcacttcagtctttacctcctgggctcaggtgatcctcccacctcagcctcccaagtagctgggaccacaagctcatactaccacgcctgactaattttttttgttttttggagagatgaggtctcaccgtgttgcccaggctgaatttttaaaaagaaagtataaagaggagaacattgctacaggcataccttggagatattgtgggttgtgtttctgaccactgcaataaagcaaatattgcagtaaagcaagtcacacaaattttttggtttcccagtgcatatattaataaaatgtttacactatactgtagtctaagtatgcaatagcattatgtctaaaaaatacatcttaattaaaaaacactttattattaaaaaatgttaatgatcatctgagccttcaatgagtcataattttttgtggtggagggtcttgcctcagtgttgatggttgctgactgcttggggtggtggttgctgaaggttggggttgcagtggcaatttcttaaaataagacaacattgaagtttgctgcattgattattcctttcacaaaagatttttctgtaccatgtaatgctgtttgatagcgttttactcacagtagaacttctttcagaattggagtcaatcttctcaaaccctgccactgcttatcaactaagcttatggaatattctaaattctttgttgtaatttcaacaatgttcacagcatcctcaccaggagtagattccgtatcaagaaactactctctttgtttatccataaaaagcaactcgtcataagttcatgccttatcatgagattgcagcaattgagtcacatcttcaggctccactttttaattctagatctcttgctattccaccacatctgcagtcacttcctccactgaaggcttgaacccctcaaagtcatccatgaggactggaatcagcttcttccaaactccaattagtgtggatattttgacttcctcccataaatcatgaatgttcttattagcttctagcatggtgaaaccttttcagaagattttcaacttactttgcccagatccatcagaataagcattatctatggcagctatggccttaggaaatgtgtttctgaaataataagacttgaaagtcaaagtgactcattgatccatgagtagagaatggatgtgttaacaggtatgaaaacaatatcaatctccttgtgcatctcatcagagctcttgggtgaccaggtgcgttgtcaatgagcattaatatgttgaaaggaatctttttttctgagcagtaggtctcaacagtgggcttaaaatattcagtaaatcatgccataaacagatgtgctgtcatccaggctttcttcttccatttctagagcacaagcagagtagattcagcataatccttaagggccacaggatttttggaatggcaaatgagcactggtgtcagtatcaagacaccagctgcattcacccctaacaagagagttagcctgttctttgaagccttgaagccaggcactgacttctctagctatgaaagtcctagatgtcattttcctcccatataagtctgttgtgtctacatttaaaatctgttgtttagtgtagccaccatcatcaactagttaagatctacttatcttaactagatcttttggataactttctgcagcttctacatcagcgcttgctgctttaccttgcagcaagttatgttttatgttttggaggtggcttcttttcctaaacttcaagaaccagcctctgctagcttcaagcatttttttctgcagcttcctcaactctctcagccttcatagaattgaagagcattagggtattactctggattaggcttcgatttaagggaatgttgtggctcgtttgatcttctatccagaccactaaaattttctccatatcaacaaaaaggctgttttacattcttacttatgtgttcactggagtagcacttttaatttccttcaataacatttcctttacattcacaacttggctatttagcacaagaaacctaacttttggtctgtctcggctatcaacatgctttcctcactaaccttaatttttgtttctgtcttttattttaaagtgagagatatgtgactcttcctttcacctgaacacctagaggtcattgtagggttaataactggcctaatttcaatattgttgtgtctcagaatagggagacccaacaagagggagagagatggtggggcagtcagacacacatttatagattaaattcatcttatataggtacagtttgtggcaccccaaaacaattacaatagtaacatcaaacatcactgatcacaagtcaccatcagatataataaaaatgaaaacttttgaaatattgtgagaattaccaaaatgtgagatggaaggtgagcacatgccactgaaaaagtggacttgcttgagacagggttgctataaaccttcaatttgtaaaaaaaatgtaatatctgtgaagcataataaagtgaagcataataaaatgaggtgtgtctgtattttattatttgacttctctgattttgtttatttggagatagggtcttgctctgtcacccaggctggagtgccatggcatcatcatagctcactatggccttgatcctcctgccttagcctcccaagcagctggtattacaggtacgtgccaccacactcagctaattctcttatatttttgtagagacagtgtctccctgtgtttcccaggctggtcttgaactcctgggctcaagcaatccccccacctcagtctctgaaagtgctgagattacagacataagccaccacacttggccttcctgatgtgttttatacaaggatattaaaacactttgagctatcatttgacatgtaacattttgctttttctgtttacaaaatctgaagtcttttttttctcttcaagatgtatcaaatgagcacactgaaatctaataaagtgatatttcagctaaaaaagaacaatttccaccaatttaggttctttaaaagattcatgtaagttcatgtacacattgaatataccttatctgaaatgtttgggtccagaagtcttgtgaattttggatttttgaatatttgcacataattaatgagatgcaggaatgggacccaagtctaaacataaaatttgtttatgttttatatacatcttatacacatagtctgaaggtaattttatacaatacttttttttttcttttttagatggagttttgctcttgttgcccaggctgaagtgccatggtgcaatctcggctcactgcaacctccgcatcctaggttcaagcaattctcctgccgcagcctcctgagtagctgggattacaggcaccccccaccatgctcagctactttttgtatttagtggagatggggtttcaccatgttggccaggctggtctcaaactccctacctcaggtgatccgcctgcctcggcctcccaaagtgctgggattacaggcatgagccaccacgcccggccacaatacttttaataatttagtgcatgaaacaaagtttgtgttaagtacttatgtgtggaattttgatttgtgccatcatggtggcactcaaaacatttcagattttgggttttggactttcagattcaagatgctcaaccggtagtttcctttgtattgatggcagacacaagttgtgtatcttcttgtaaaggtgtgaagaagctaaatgacatctttcctgaattactgggatagagcatttattaagaaacaggatacaagaattttcttaaactactctgttttaaatgtgattttcttcctattaatattttaaggagaaaaagaattaattttccaatacattgataccaccttcactttgaaagtgaaacaaatgacatctattagctttgcagtagaggttaagtggttttcctaagaaaagaatatgcactgcaatgaaagatttgccagtcatcccaatggctattttgttttgcagaccacggtgtgaacacatgaacagaagacgaaaatttcttctagcctcagtacttgctctccagaattcaagttttatatatccatcatgtcagaagtgcttctctaggataatcctggtctccaaaaggtaaaagtaaagtctgtaagtgtgagagaggaaatacaaatgcacactgtagatttcctatggctcaagggcaaggaccagatttaccaaacaaggacattagattctctcaggggttggttcttctgtaaatcccagaacagatttcactgctaatcctctattactagagaaaagttttaagttactgtcaagtcctttgctaaatacttgcctcattgaagaaaaataacttctcagagagtaagttccaatactgggtacaaaacttagcccatttctgggatatccctgggaataatataggagacttgtgtttattctttgtttatttttgcatgatcagtagaatagttgttaatataaataaataaattccttgagaccagggactatgttatagtaatttctatcctttagcaactagaaaggtgtttggcgtataattctttatcatggtgctcagatgcaagccaactatacctgagagcctaaggtcttcctctgatctttatagagtagaaacgagaggttaggtttgaagtttctccagaacactgtctctctgcatcgaagagaggacaagaatacctagtaagtaactagaactatgtaagaaagagtagtgtgccagcaatattcttaactagtctttttgtctagttagcattgaatggggaggcagaaaaggattggcagttctaactcatatctagactctaagtaatccttgaagtagttatcacactgttcctttattaagccactctctcaagcactcatttgttagctctaagagaaagaccctgtttgtgttattcatcattaaatccttggctagggcttagttcatagaaagtgttcaacaaatgttggttaaatgaatgaataagtgatagcatgatagtgtttagattgtcttaggttcaccccttttcaggttcttgcctgtcatctgaaacaactaaaacccatgggctatttgcctttcatcaaaatctgtacttagaagcagtgtggtatacagtccttacttaatgttgttggattcttagacaccgcaactttacgcaaaatgatgtataatgaaacaaatttttttctcatcaacgttataatgatgttgtttgagaatctgctataagtagttttgcttaaagtcacagtatccaagaacctatcactaacattaaatgaggacttactgtaatggaacaatttcaagcttcagagaacacaacagagtttcatgtaggctctggctctcattaactatgtgacctagggcaagatagttaacttctgtgagtctaattactcatttgtaaggtgggatcatggtacccacaatatgggatcattgtaaagttagagataatgcacagaaatgttctagtagaatacataacatatattaggatttccaaagtggtagctattattattataatctattataagtatactttaccttattgcagtatgttatcatgattaaaagcataattctctggagctgactgcctggattcaaattgcaaccctgccattatagctgtgtggccttgggcaagtcactttaattatctgagcctcaaaatggggaaagtaatatctgcctaataaggttcttgtaaggatcaaataggttaatatacataacatgcctagaacattgtctgatacattatcagtaatatatagatataaaatatttttaaaactctttctttccagtcatttattttaaagataatctgcaacaaaaatttaggttgaacaataatgccattgttacttatttagacgggtaataccagtagataacattagtgagtgtttgctgtacagtaggcactgtgctaggaactttgtgggcattatatcttttaatacaatagccctatgaagtgaatgctattgttaatgccaacctttaaaggagacaactgaagcttgggaaagttaagtaacttaccgcaaatcatcacacagccagctagttaggggcagaaacatattcaagcctaaacaatctgaattctgtctaccttcatagtcaccatattacttccaaattagcagcgaagtttgtattcagaatgacatcttcccctctctttcttagaacttaaagtgacctcggaaaggacttgtgactggacccttttggaatataaaacccatggcacatagtccttgcctatggaaacatagtccatggaaatataacctgttttctgcatatactacattgacacaaaaattttttaaaactatttccataatttctggtgcttacctttttttcccataggttattggggtacaggtggtatttggctacatgagtaagttcttcagtggtgctttgtgagattttgctgcacccatcacccgagcagtatacactgcaccctatttgtagtcttttatctctcaccccctcccacccttccccccaagtccccaaagtccattgtatcattcttatgcttttgcatcctcatagcttagctcccacatatcactgagaacatatggtgtttgattttccattcctgagttacttcacttagaataacagtctccagtctcatccaggagactgcaatgccattaattcattcctttttatggctgagtagtagttcatcgtgtatatataccacagtttctttatccactcattgattgatggacatttgggttggttccacgattttgcaattgtgaactgggctgctataaacatgagtgtgcaagtatcttttgcatataatgacttattttcctctgagtagatacccagcagtgggattgctggatcaaatagtagttctacttttagttctttaaggaatctccacactgttttccatagtggctgtactagttcacatttctaccagcaatgtagaagtgttctctgattgctgcatccacaccaacatctactggtttttgattttttgattatggccattcttgcaggaagaaggtagtatcgcattgtgattttgatttgtatttccctggtcattagtgatgttgagcattttttcatgtgttttcttggccatttgagaattgtctatttatgtccttagcctactgtttgatgggattgcttgtttttttcttactgatttgtttgagttcgttgtagattctggatgttagtcctttgtcagatgtatagattgtgaagattttcttccactctgtgggttgtctgttcactctgctgactgttctttggccatgcaaaagctctttagtttaattaagtcccagctatttgtttttattgcatttgcttttgggtacgccaatgtctagaagggtttttccaatgttatcttctagaatttttatagtttcaggtcttagatttaagtccttaatccatcttgagttgcttttatataagattcattctcctacatgtggctagccaatgatcccagcaccatttgttgaaaagggtgtcctttccccactattgttcactttgtcaaagatcagttggctgtaagtatttgagtttatttctgggttctctattctgttccattggcctatgtgcctatttttataccagtaccatggtgttttggtgacgatggccttatagtacagtttgaaatcaggtaatgcgatgcctccaggtttgttctttttgcttagtcttgctttggctgtgcaggccatgttttggttccatatgcattttaaaattgttttttctaattctgtgaagaatgatggtggtagggattgcactgaatttgtagattgcttttggcagcatggtcattttcacaatattgattctacctatccacgagcatgggatgtgtttccattcattgtgttgtctatgatttctttcagcaatgttttgtagtttttcttgtagaggtcttttgcctccttggttaggtatcttcctaaatttgttttttttgtgtggtttttttttgtgtgtgtgtttttgtagctgttgtaaaaggagttaaattcttgatttgactctccacttggttgctgttagtgtatagaagagctactgatttgtgtacattaatcttgtatccagaaacttggctgaattcttttatcagttctagcagctttctggaggagtctttagggttttcgaggtaaacaatcatattgtcagcaaacagtgacagtttgacttcctctttactgatttagatgccctttctttctttctcttgtctgattgcattgtctaggacttccagtagtatgttgaagaagaatggtgagagtgggcatccttgtcttgttccaattctcagagggaatgctttcaacttttctccattcattgttatgttggctgtgggtttgtcatagatggcttttattacattgaggtatgtcccttgtatgccactttcgctgagagttttaatcataaatggatgctggattttgttgaatgttttttctgcatccattgagatgatcatgtgatttttggttttaaaattctgtttatgtggtatatcacacttattgacttatgtatgttaaactgtccctacatccctggtatgaaacccacttaatcatggtggattatctttttgatatgttgttggattcagttagctagtattttgttaaggattttagcatctatgttcatcaaggatatcgggcagtagttttcttttttgcttatgtcctttcctgatttgggtattagggtgatgtcgccttcatagaatgaattagggagggttccctctttatctcatagaatagcgtcagaaggattggtaccaattcttctttgaatgtctggtagaattctgctgtgaatccatctggtcccagactttttttcgttggttttttttgagacggagtctcactctgtcgcccaggctggagtgcagtggcgtgatctcagcgcactgcaagctctacctctcttcacgccattctgcctcagcctcctgagtagctgggactactggtgcccaccaccatgcccagctaatcttttgtatttttagtagacagggtttcacggtgttagccaggatggtctcgatctcctaacctcatgatccgcccacctcagcctcccaaagcgctgggattacaggcgtgaggcaccacgcccggccttttgttggtaattttttaattcccatttcaatcttgctgcttattattggtctgttcagggtatctaattcttcctgatttaagctaggagggttgtatttttccaggaatttatccatctcttctaggttttctagcttgtgtaaaggtgtttgtagtagtcttgaatgatcttttgtgtctcagtggtgtcagttgtaatatgtcccgttttgtttcttaatgaggttatttggattttctctcttcttggttaatcttgctaacggtctatcaattttatttatcttttcaaagagccagcttttggtttcatgtatcttttgtatttgtttttgtttcaattacatttagttctgctttgatcttggttatttcctttcttctgctgggtttcggtttggtttgttcttgtttctctagttccttgaggtgtgaccttagaatgtcagtttgtgttctttcagtctttttgatgtaggcatttaggactatgacctttccttttagcactgcctttgctgcagcccagaggttttgataggttgtgtcattattgccattcagtttgaagaatttttaaatttccatcttgatttcatttttgatccaaggatcattcaggagcagcttatttaatttccatgtattggcatggttttgaaggttccttttggagttgatttccagtttattccactatggcctgagagagtgcttgatatgatttcaattttcttaaatttattaaggcttgttttctggcttatcacatggtctatcttggagaaagttccatgtgctgttgaatagaatgtgtaatctgcggttgttggatgaaatgctctgtatattatctgttaagttcatttgttccaaggcatagtttaaatccattttttctttgttgactttctgtcttgatgacctgtctagtgctgtcagtgtagtattgaagtcctccactattattgtgttgctgtctatctcatttcttaggtctattagtaattgttttataaatttgggagctccagtgttaggtgcataaatgtttaggattgtgatatttctcgttggacaaggccttttatcattatataatgtcctttgtctcttttaactgcttttgctttaaagtttgtttttgtctaatataaaaatagctacccctgcttggtgtccatttgcacaaactgcctttttccactcctttacttgatgtttatgtgagtccttatgtgttaggtgagtctcctgaaggcagcagatggttggtgagttcttatccattctgctattctgtatcttttaagtggaacatttatgccatttacattcgatgttagtattgagatttgaggtaccattgcattcattgtggtatttgttgcctgtgtaccttgttttttttgtttttgctttttaaattgtttttgttttataggtccttcatgatttatgcttttaagagattctgtttttgatgtgtttccaggatttgtttcaagatttagagctccttttcacagtttttttctttctttcttttttttttttttttttttttttgagacggagtttcgctttttcgcccaggctggagtgaagtggtgcaatctcgtctcactgcaccctccgcccccccaggttcaagcaattctcctgcctcagcctcccgagtagctgggattacaggcacccaccaccacgtccagctaatttttgtatttttagtagagacagggtttcaccatgttggccaggctagtctcaaactcctgacctcaggtgatccacccgcctcagcctcccaaagggctaggattacaggcatgagccactgcgcccagcctagcagttcttgtaatggtggtttggtagtagcagattctctcagcatttgtttgtctgagaaagactgtatctttccttcatatatgatgtttagtttcactgggtacaaaattcttggctgataattgctttgcatgaggaggcttaagatagggccctaatcccttctagcttgtagggtttctgcaaagaaatctgctgttaatcggataggttttcctttatagattacctggtgcttctgtctcacaactcttaagattctttcctttgtcttaactttagataacctgatgacagtgtgcctaggtgatgatctttttgtgatgaatttcccagatgctctttatgcttcttgtatttagatgcctaggtctctagcaaggccggggaaggtttcctcaattattcacccaaatatgttttccaaacttttagatttctcttattcctcaggaacaccgattattcttaggtttggctgtttaacataatcccagactttttggatgcttggttcataatttcttattcttttttctttgtgtttgttggattgggttaatttgaagaccttgtcttcaagctgtgaatttctttcttctatttgttcatttctattgctgggactttccagagcattttgcatttttgtaagtgtgtccagtgtttcctgaagttttgattgtttttctttatgctatttccttgaatgtttctcccttcacttctcgtattgttttttggatttccttgcgtcaggcttcgcttttctctggtgcctcgctgaattctttttcaggtaaatcagggatttcttattggtttgaatccattgctggtgagctagtgtgattttttttggaggtgttaaagagccttgttttgtcatattaccagagttggttttctggttccttcttatttgggtaggctctgtcagagaggcaaggtctagggctgaaggctgttgttcagattcttttgtcccacaggatgttcccttgatgtgatactctccccccttttcctatggatgtagcttcctatgagccgagctgcagtgattgttatctctcttctgggtctagccatccagccagtctgtctggctccggggtggtattcagggtttgtctgcacagagtcctgtgatgtgaatcgtttatgggtgtctcggccctgaataccacacagtatttggggtgtctcccaggtcctgcaggagcagtccacttccttcagagggtctgtgggtcctcttgggattcctggtttgttcttgcagttgttctggagctaaaattcatagtgcgagccccaacatgctgctttgtccgagttggagctgcaatctaatcctgcctcccatccgccatgatgatctaaatcctggtgcttatcttttctactgttgtttttgctttccctttttcttacttggaatcagttgtaagccaacacaggaaacagaaattcctcatgttcatttccccattgctatagcactgcaagcttatgacagaggagttccatgctcttgcctttgcagaagatcttagagatgctgaagaacagagagacgtccctaaatattttctttgaacctgaaatttttagtgactataatcataataagtattttgtgctttatggaattaactttcttacctccaagatcagatcagtagattgaatgtagttttcaatctataggtattctgcagagccttggggctccatggaagtgcttatggagggagatgggattagagtagtaatagtacctagtgctgagtagtaggtaagactctagggcccccacgttagtttcaacaagatctctattctcatccttatattagtgttccaagttaaatttcatttgaaagggggtttcattatgtaaatatacaaacatagacatacatctataaaaaaaaatgtgtacaaagttagttcggtccttcatatgaagcagtaactacacatacacacacaatagtgtatgtctgtactctccccagattataagctggagaagggatttatttatccagacaagctatctacatagaaattgcccttctgggtgactaatgggacccataattccttttagcctagaaatccatttctaacactaataactttcttttcctatcttaaaataggactcatcgctcagaggctacctatcctctcccccattcccaactacccaaaaagtttatatcatttacttaagcaagtcaaatttaatttcacacatatagatcatagttttcttactttgtgggggaagtgatatgtggaagcattaagagatatgttttttaaaatatgtctcattactttgtgtgtatttaatctgggtctataaacttggaaagggatgttatataatcatatagtcaggatattcttaagctggaatctgtggatacattataggtatgtatgactcctccagtccctaagatatgtagaatatcgtgttcatatctgttttttgtggggagagagtgagtccattgctttcatcagattttttaaggttttcaagactaagaaaacattaaggattacttatctcaccagttcttctacatctgggctaaatataagtacgctagaaaaataaacaaatgaggctgggcatagtagctcatgcctgcaatcccagcatttgggaggccaagatgggaggattgcttgagtccaggattttgagaccagcctgggcaacatggtgaaacctatcctctaccaaaaataaacaaaattaggcaggcatcgtggcatgtgcctgtagtcccagctgctcaggagtctgaggtgggaggatcgcttgagcctgagcggtcaaggcttcagtgagccaagatcataccgttgcactccagcctgggcaacaaagcaagaccttgtctcaaaaaaataaatgaataaaaataaaaaaaaaacaaatgaaacttggtatttttttaactgggatcaaacaaaaaagatagcaaattacagctattatttcagatagatcctttcagaggctccttgaactcaaatctattttcataattctaaggcattatttgccttttcactttcagtctctcatgagtgcataatggagtttcccagaggctacataacacgtactatcacaacagattgagcagagaagcagatatgagaatccagctgtctttttatgaaaccagacattaaagagatttgcaaaatgtaaaacaatgctggtctcttcttactaatttttaaaatttgaaaaacataactatttttcataaaagtatgttttttgtgttaaccatgtaaagggtctgtttttaatgaattaatatttttttgatttctcagttttaatttctcactttcatttaatttctcgttttatgagaaatgtagatagaagccaggtgtgatggctcacgcctgtaatcccaacactctgggaggccgaaacaagagaatcacttaagcctaagagttcaagcctagtcagggcaacacagtgagacccccatctctacaaaaaaatttaaaattagccacatatggtggcatgtgcctgtggtcccagctactcagaaggctgaggcaggaggatctcttgagcccaggagtttgaagttacagtaagctatgatagcaccactgtcctccagcctgggcagcagaatgagaccctgtctgaaaacaaaccaaaaaagaaatatagacagatataagataaacaagttctatggatctaatgtacagcttgagtggtaatggatgatgtgttaaataattcgactatggtagccaggtgcggtggctcacacctgtaatcccagcactttgggaggccgaggtgggcggatcatgaggtcaggagatcgagaccatcctggctaacacggtgaaaccctgcctctactaaaaatacaaaaaattagctgggtgtggtggcgggcacctgtagtcccagctaatcgggaggctgaggcaggagaatcgcctgaacccaagaggtggaggttgcagtgagccaagattgcaccactgcactccagcctggccaatagcgagacactgtctcaaaaaaaaaaaaaaattttgactatggtaatcattatacagtgtagacgtatttcaaatcaccatgttgtataccttgaatatattcaatctttggcaagtaatttttttttttttttttgagacagggtctggctctgtcacctccagactggagttcaatggcacaatctcagctcaccacaacctctgccgcctgagctcaagcaatcctcccatctcagcttcctaagtagctgggactacaggcgcatgccaccacgttcgttaatttttgtattttttgtagagacacagttttgccatgtttcccaggctggactcgaactcctgagcttgagtggtctgcccgccacagcctcccaaagtgctgggattacaggtgtgagccatcacgcctggcccaagtaaatatttttgaataaaaaaaatagatactattcacataaacaaaactctttgatattctcaataattttttaagagtattaaaggagtgtgaaaccaaaaagtttgaaaactgctattctgtaacaaatgacattttagaaatatgggtgcctctagaagttaaatcgggacggtgatgtgaatatgttgtctatatccttgtttctcaaagtatggcctaaggtacatctgcatcagtattacctgggagcttattaaaaatgcaggatcttgggcctcatcccagacttcctgaatcagaatcttcattttaacaagatctctggatgatttgtatacatattaatgtttgagaagctctaatctgtattacaccacactaacatttattttaatccagcatcgttcctaaaaggattaaagaaaactatataaataaatatcttcattatacatatgtactttataaaaatatatatagtttaatatgtaaatgcatgaacactaatagacatagttttttgaggctattattgatactgtcattgcaagcagttctttattttaaccatttggtcccactgttatcatatcataatatcagaacttcatgatacgagttcacagtcttgggtttgggtcatatatttaccaactttgtcatctcagataaaaattcaaactaatttccccatttgtaaattttacctataaaaatgaaataatgtatgttgaaaacatttgtaaactgaatgctaatgcatattagtctaagttttgctaggaattttacattaaacctgtatgcattattgcatagcctttaaagaaattccaatatatattttaaacagttcatttccctagagtttggtactaatggagttttatcccctagtgagtcaattacctttaattcattctatggctaacctacagcacaaactctagcagatttgtataggattatatgaatgggttggtatagatctatcctcagtatggcagaagaataacagcacagatctaataaaggtgagtcactttcagagctacagattttagactccccctagtggccatctggcaacaatcaaatttatacaaccatctttcaccttgctttctgtttgccttttgccactcttttttaagatctttagcaatctgaagaaaaaacaaaattctagtattagccattaccataaaatgtttttaggtgcttgttgtatttcaaaaaaattttttaaactattctgtctgttaaataaagttaacctaactgaggggtggacattaagaacctgaaagatagaaatcagagttataatacattgcaaactagaagagaagttaacagtacaagtgacagtaattatcacaatacttgatataattatgagggagaagcagactaacactaatttcacagtatttgcactagaccctttatttgtctattttaatccttcttcagccctggacttcatagatgaggaactcaagaatttagtaactgtcagacaatgagtacatggcaatagagttacactgccatgtagatgtgtactttttgactagaaagcctttagccaccattacatactgtcttaaaaaaacaagttaaattgcatggttttcatatcaaattttataatctgataagttatcaacatagtctaatgaattaaagaaagtaattttcattatggtgagaaaaatgcaattaagtgctttgtgtataaataggtattaaatattttgagattattttttgtcctctttttttttttttttttttttttttttttttttttttttgagacggaatgtcactctgccccccaggctgtagtgcagtggtgcgatcttggctgactgcaagatccacctcccgggttcacatcattctgctgcctcagcctcccaagtagctgggattacaggtgcccatcaccacacccatctaatttttatgtatttttagtagagacagggttttaccgtgttagctaggatggtctcaatctcctgacctggtgacccacccgcctcggcctcccaaagtgctgggattacaggtgtgaaccaccgcgcccggccttttcgtcctctctttcatgcacagttctcctttagttttccatcaatttggtatgtatttctatcaacttggggctgtttaatttaaatcagtaacgctaactattctgactagagaaatttaaaataagttgatctgaaagagtttaagaagaatttgagttgtgtaggagcatttatacacaaaatgttattttaaatttttactgttctggatttttcatcatatgaaaaacatttaatgaacatctccacacttttttccaccacttttctaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtaagaatacttaaaacatcctttttcctgactgcccttagaatttgaagatacaagtttataaggcaatatgcatttttgtagaaagataatcattcaaccccagattgtcaattcctttaaaagacaagcaagtaagaaagatgtttatttcctgaatacatattatgatgatattaaaacagtctccttttatttagggtaattaatctgtaattagaatattaagttataaatctctaatccaagttacagaaatagaggctaagaaagtaacatcatttcaaattgaagaattatccaaattgaggttagcattgaaacagttaggttcccctgaggcagaagaatctatttgagggaatatttgcatttcagaaattgaaattttattttttatctgtattgcaatttaatttgcatagtttgaccttttacgacattgtcctgagaatataagaataagcaattaaagcttttcttggccgggcgcggtagctcacgcctgtaatcccagcgctttgggaggccgaggcgggcggatcacaaggtcaggagatggagaccatcctggctaacacggtgaaaccccatctctactaaaaatacaaaaaattagctgggcatggtggtgggcgcctgtagtcccagctacgccgggaggctgaggcaggagaatggcatgaacccaggaggcagagcttgtagtgagccaagattgcaccactgcactccagcctgggagacagagcgagactctgtctcaaaaaaaaaaaaaaaagcttttcttccccctcagtcttctgccctcctcccctaatcacatgcaagaaatctatgtccacatttttgtgcttgagacaataaagggaccacaaccaggcttatcagagaaaagggatgactttttcctgctttcaagtgaagagctagagatgccaccactattcccactgccacttttatttttccttataatcattgccgggcctgatggttaggcaggtaactactttactcccacttgatcaattggttttgttgatttttctgtgctatgagaaactagagagaacaaactgcctggctcttaaagtcactttttttcctctataaaaggttcatgctgcattttcaaattaattgtgtctctgactttatggcaagtaaaatttcaaagttcattgcttcacattttttactttttttccaatcaaggtacattcaggatcctaataaaattccagaaacactggacaatgatacaactcagaatctattaactaaagcagttgaaacttgctttgttggacaaagctttatttttggagtgacggtaattgagactagctttctttttaataatctgttaacatttccattgtaatgaattatgtgaattttctaaatagttgttaggagttctgtacatgtgaaggcctgtagaaacactttaaactatgtaaaaatagcctataggtggtctgttaaaacaccatgtgtgacaacttcctctttcgaaagtcaggggagcctacttcaaatgctttcagagcttaaaaatataaatttattatatatttagaaatgttagatatttgtttttggtatttagtatttattttgccctccggattttgttcaaattctatagtaaaacttccaccaattctctagctttttaattctgtcttctataaaagagaataatggaacactgaaggcaaagtatcttgagtattgataagaatactaaaactagattaagaaagatggtcttaaatataaaagtgactgtagaagaagttaaaaaaaaaagaagttactcctttgactttgaaggagtaatagttttctgtctcatctatgctaaagggaacaaagagacatttttttccacactggaatcagggttttaaaagaggactccacaacagaagagtgagaaaaatccaaagggaaggtagaatcaacggctacagagctttacttgttaaaatcgtagacagtccttttctctcctctcttctttttcctcctcccctttttcccctcccctcccctcctctctttccttagctaaagagaactatgatagttgccatttattgagccactgctattttctaagcactgtgcagttttccattttattactaaacagtaatcctgcatttttatttttatttttattttataaaggagaagactcaggttaaataaattgtccaaagtctcaacactattaataaatgcgggaactaggatttcttcaaatcagtttaaacaagctctttactctaaggtttatattctcttacatatgctactttgcctataaaactaacagaatcgaaattggaattgggggatggaggtaatagttgtatctgttttaaccttttaaatctgtttattttattttatttttgagacagaatctcactctgtcacccaggctggactgcagtaccaagatcatggctcactgcagccttgacctccctaggctctggtgatctcccaccccagcctcctgagtagctgagactacaggcacacgccaccatgcccagctaatttttgtgggggtattttttttagaggagaggttttaccatgttgcccagtctggtctcaaactcttgaggctcaagtgatctgcctgcctcggcctctcaaagtgctgggattacaggcatgagccactgtgcctggctaaatttctgtttcatgtttaagtaaatggaagacaattttattcttacttaaatttctttgcttctttcacagaattttgaaaaccaacctggacaaggttcagatgccagtaacttcttacagcaatgctctgaccacaaaagaaaagccaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcaggttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtgtttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaaccaaaa

SEQ ID NO: 98 - DNA, 21474 bp, Homo sapiens
ggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacggtaagcgggagatctctggcggagagaactgggccgggctgctgtcgcgggggcaccggccgtgtctactgtcctggaaagttgggtcgagcccggggttgggggcttgtggagtctttgttcgccttgctgctcctgcgcgactagggtgcgagcgtactcttctaatcgcattttgggcttcttagggagggaggaggggcgggctggcagaacccaggcttcctcacactcgccctctttcttggtttctttctcagggaaaaccatctatgagaactcctctccgtgaacttaccctgcagcccggtgccctcaccaactctggaaaaagatcccccgcttgctcctcgctgaccccatcactgtgcaagctggggctgcaggtgagattcgcctggacagcttctcgactgggctgtttgcccagggtgagagctcaggggaacagagggccagggctacaataattaataacgataatgaagtcttctacgtcggtgacatccatttacagctattcaggccaacagagaggtgccctagggtggttaaaggaaatccagtgagaacttgaatctctgtttagctgttagtttttattacctcctcctcctcccttcgacctttatcaaactattgagaaatcctaccaccctgattagtgctcttcctccaacatggggtcacttacggaaaggtcagtcacctgcaagattgaggcaatatccatttactctaggaggtagttagaactctcctgggatcaagttacaccactggaaggtagggtacttgaatcaccttagtttaaactagctccttgcagaattgccctcactgatttgtacttttgttaaacgttttgagagacgtagccatgtagaaactgcatttcagttgctgtcaaaacttgtcaaggaagcagcttgactcctgtataagattcctccaagaaaggctttaggactaactgcctggaaaaattgtcttcctgaagaaattgctatccttttctttctgataatgagaactatgtagtttaccatattttccctcttgctctgccttctagaaagctcaaggccaaactggatcatcacatacagctactgttatagctgtataggaagttttgcttcctcttttttgaccatgactttgttatttcattaatcgtatctattcattttcatgcatatgaattatttttggaaggagatgggatatcaataaaataggtatgaggaggaaagaagagtgtatagacagatgacatcctgagtaacagaagtatgatgatagcatagcagtctttcttgaaagagttgcaaaatacctactgtccaatagaactttctgggatgagggaaatatttgataatctgtgctgtccagcatggtaactactagtcacatggttattgagcacttaaaacgtggctgaggtgactgaagaattgaatttttttgtttttgagacggagtcttgctctgtcacccaggctggagtgcagtggcgtgatcttggctcactgcaatctccgcctccagggctcaagcgattctcctgcctcaggctcctgagtaactgggattacaggtgcacaccaccacgcctggctaattttttgtatttttagtagagacagggtttcacaatgttggccaggctggtctcaaactcctgacctcaagtggtccgcccgcctcggcctcccaaagtgctgggattacaggtgtgagccactgtgcctggcctgaataattgaatatttaatttaatttaatttaattaatttttttttgagatggagtttcgctcttgttgcccaggttggagtccaatggcgcgatctcggctcaccgcaacctctgcctcccgggttcaagcgattcttctgtctcagcctccggcatgtgccaccacacccagctaatttttgtattttcagtaaagacgggtttctccatgttggtcaggctggtctcgaactcctgacctcaggtgatctgcccgcctccgccttccaaagtgctgggattataggcgtgagccactgtgcccggcctgaatttttaattttaatttcaatagctacatgtggctagtggctatcatattagacagtacagcttaagatgaaaaataaataagtactaggtggaaattagctctatagagcttatagaatttattatgattattaattaattaattaattttgagatgcagttttgctcttgttccctaggctggagtgcaatggcacgatcttggctcgttgcaacctctgcctcctgggttcaagcgatcctcctgcctcagcctccctagtagctgggattataggcacgtgccaccatgcctggctaatttttgtatttttaatagagacggggtttcgccatattggccaggcttgtctcgaattcctgacctcaggtgatccgcccacctcagcctcccaaagtgctgggattacaggtgtgagctatggcgcccagcctgaacttatagaatttaaccataattatttaatcacaatagcagaatactagattgaaatcgaattctccttccctcttaactgctgggcttactacctccagatgcagtcagctacacaatgaaaagggtttttccccaataaaatagcaattatttttgttttgtaaaaatttttttttttttgagagtctcactctgttgcccaggctggagtgcagtggcacaatcttggctcactgcaacctctgcctcccggattcaagcaattttcctgcctcaccctcccaagtagctgggattacggtgtgtgccaccacgcctggcagattttttttttgagacggagtcttgctctgtcacccaggctggagtgcagtggtgccatctagggtcactgcaacctccgcctcccaggttcatgcaattctcttgcctcagcctcctgagtagctgggattacaggcatgtatcactacgcccaggtaatttttgtatttttagtagagacagggtttcaccatgttgggggtcaggctggtcttgaactcctgacctcgtgatctgcctgcctcagcctcccaaagtgctgggattacgggcgtgagccaccgcgcccggcctaattttttttttttgagacaggatctcactccttcatccaggctagagtgcagtggtgtgatctcggctcactgcaacctctgcttcccgggttcaagcaattctcctgcttcagcctccccagtagctgggattacaggcgcgtgccaccatgcctggctaattttttgtatttttagtagaggcggggtttcaccacattggccaggctggtctcaaactcttgacctcaagtgatccaccctccttggcctcccaaagtgctgggattacaggcgtgggccactgcacctggcctgttttgtaaatttttgattattaatagatattaattgtttgaagcatttgaatatataaatgtataaggaagaaatatttctggtatcttagataaatgtcatatttgacagttctttcatacatctctttatgtgtgtctattttgtatatatgcacacacacacacacacactcatctttatattgtctttttttttttttttttgagaaggagtcttgttgtatcgcccagattggagtgcagtgccgcgatcttggctcactgcaacctctgcttcccagattcaagcgattctcctgcctcagcctcccgagtagctgggactacaggcacccgccaccatgcccagctaatttttgtattttgagtagagatggggtttcaccatgttggcccagctgcactcgaactcctgaccttgtgatctgaccgcctcagcctcccaaagtgctgggattacaggtgtaagccaccatgccctgtcttttttatttttttttttgagacagggtcttgctctgttacccaggctagagtgcagtggtgtgatcttggcttattgcaaccttgaactcctgagctctagcagtcctcccacctcagcctcctgaatagctgggactacaggtgtgagccatcataccttttaataatttcaaaattaaagtaagatacatgaaattacaataaaacataacagcataacaaattactataaagtacacatccatgtaactaatacccaggtcagtaagtaggacagtaccagaatatcagaagccctttttaacctaaccttggttttgtttcatccactaatataaatgagaaatttcatatgtttgattattattattattattttttgagacggagtctcgctctgttgcccaggctggagtgcagtgtcacgatcttggctcactgcaagctccacctcccgggttcacgccattctcctgcctcagcctcccaaatagctgggactacaggtgcccgccaccacagccagctaattttttgtatttttagtagagacggggtttcatcgtgttagccaggatggtctcgatctcctgacctcgtgatccgcccgcctcagcctcccaaagtgctgggattacaggcgtgagccactgcgcccggtctgtttgattatttttttaataaataattggactttctatctaaagcttccagaatagttttttcttcattgtagcacagaaattttataattatgtgtctagcatgtatcttttctagtcagtcctgcttagaaactggtgagccattttaatgtgcaaactcaggtctttcattagggtagttttcttctaatatttgttaatcagcgcctcatgtatatatgttctcttctggaatttcttttatttaactgttaggtatcctgggtttatcttctaattctcttagctttttcttcagatttacatttctttatatttttatctttgctttaagatatttcttccacttgtccaggccagtaattctagtttcaactctaataatttactctttcaattcattttactgacattttttatttaaaataatatttattatttctaaaatgtctttgtgtgtgtatttatgttgtagttaaagcttaagtactcgttttttttgttgttgttcagattatcatctgtgtcttccagcagctctgttttgttagggtctaccttttttatttatttatttatttttttttgagacagggttttgctctgtcacccaggctggagtgcagtggcacgattttggctcactgcaacctctgccccctgagcttcagtgatcctcccacctcagcttcctgagtagctgggactacaggcacacatcagcaccaccatgcccggctaatgtttgtatttttagtagagatgaggtttgaactcaagcgatccacctgcttgtggcctcccaaatgctgagattacaggcgtgagccactgcgcccagccgagagggagaagaacttgtaccaactctagattctgacagagcttaagccttcactcacaccctatggacccctcctatctgttcatctagaagtgcgttagagttcagaatggagatgagtggggtcactttcaagctaccatctgcccacgatatggatctatattctcagcctgtttataatgtaggctggttcacttggaaggacccaaaatggcttagcagcttttctttccctactattgggtctctatatgagcaacaaagattagccaagttcttacctaagcagaggtagtaagaattcttttcttttttgagtgcactatcttgcacctgtaattgtatgtcgggaactgaattgactgccttagacaactacttttgtttcctttggcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtgggtaagcgcccctatgtccttgcacctcgtgagttccattaccctggaccttcccctcccatcccttcccctccttttcttttcgtcatgttcttctctttctgctgcagccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtggggtaagaaggttcctctcaaagcttgagggatcccagtggggatccttggaatttaagctgagaagctgccagagggcaaaggggactcctatcacaggcttatacttagaacatttgcaaaagctgagaatctgggcagtcacaatggctgatgcctgtaatcccactgctttgggaggccaaggtgggaggactgcttgaggccaggcatttgaaaccagcttgggcaacacagcgagatcccatccctacaaaagatttttaaaaaatcagctggatatggttttgcatgcctcactactcaggaggctgaggcaggaggatcatttgagcccaggaggctaaggctgcagtgagctatgatcatgggcaagacagtgaaaccctgtctcttaaaacaaaaaagctgaggatctggaaaatccccttaaagctgtgggtagtcactctacccctggggtacatcagaactttccaaaggagtgcaagcaaggaaacttttaaaggaattggtttttagatcatcatcttccacaagtattctttttcttcgttttttgcattggtagactatatttaatattttaagaaaaattatgaataagcctaaaacattttttaaaataatttttaatttttgtggttacagagttaggtaaatatattcatggagtccatgagatgttttgatataggcatgtgatggtcaataatcacatcatggaaaatggaaaatggagtatctgtatctgtcccctcaagcatttatcctttgtgttacaagcaatccaattatacttttagtttttttttttttttttttttttttgagacggagtctcactctgtcacccaggctggagtgcaatggcctggtctcggctcactgcaacctctgcctcccaggttcaagcgattctcctgcctcagcctcctgagtagctgggactacaagcgcatgccaccccacccggctaatttttgtatttttagtagagacagggtttcactatgttggccaggctggtctcgaactcctgccctcatgatccacctgcctcagcctcccaaagtgctgggattacaggcgtgagccactgcgcctggcccctgttgtttatgtgaagaagatttctcagtgtttacatctgtcagaatggaaaggagtcagctggcatagtggctcacccctgtaatctcagtactttgggagggtgaggtgggaggatcgcttgagctcaggagttcaagaccagcctgagaagtatggtgaaacctcatctctacaaaaaaatacaaaaattagctgggtgtggtggtgtgtgcctgtagtcccagctacttggaaggctgaggtggaggatcacttgaggctaggagttcaaggctgcagtgaactgagatcttgacactgcactccagcctgggcaacagagccagaccctgcctcaaaaaacagagtcacgaattgttgctgaactatttcttattgctggaattatagtaatccacagatatacgaactaataaggggaaggaatctccatcgatttcattaataggtgattcccaattaaattttgccgagcatgtttattttattagaaattatattacagtgactaatatacaactgattaaaagatttctctatcctaaagaaagctttttcactttaaagccttccggtcaaaggaatttaaaggaaattttaatttaaatttagatgaactttcattgttgttgcagagatgatggttaataacagattttatttttattttttgagatagtttcttggtctgtcacccaggctagagtaccatgttgcgatcagggctcactgaagcctcagcttccttggctcaggtgatcctcccacctcagcctcctgggtagctaggactgtaggtgtatgccaccacacctacctaatttttttgtatttttagtagagatggggttttgctatgttggccaggctgttctcaaacccctgggctcaagtgatctgctagcctttgcctcccaaagcactgggattacaggtgtgagccactgtgcccagctaataacatactttaaagcataaaaatatattacattaggctgaaattctgagaaaaataaaaaatatatgttcaaagagaaaaagggatgacataataaaatttctgactgctaagaagagctttttcttgtatttttaaaagatagcaactaggtatctcatcattttggtgtatgtagtatttatgccactggatatatttaagagtaatctaataattttattttaggctgggcatggtggctcatacctgtaatcccaacactttgggaggccgaggcgggaggatcacctgaggtcaggagttcaagaccagcctggccaacatggcgaaaccccgtctttactaaaaatacaaaaattagctgggtgtggtggagggcacctgtaattccagctacttgggaggctgaggcatgagaatcgcttgaacccgggaggcagaggttgcagtgagccaagatcgcgccactgcactccagcctggaggatagagtaagactctgtctcaaaaaaaaaaaaaattattttaaattgtcaatattggtaatatgctggacattacagcctttgcaacaatttaaacttaagggtacttagtttttgcaggaaatattagaggaaagtagctaaaagaccactgttggcccaatgtggtggctcacgcttataatcccagcactttgggaggctgaggccggcagatcacttgaggccaggagtttgagaccagcctggctaacatagtgaaaccccatctctattaaaaatacaaaagttagctgggtatggtagtgcactcctgtaatcccagctacttgggtggctgaggcatgagaattgcttgaacctaggaggtagaggttgcagtgagccgagatcacccagtgtactctagcctgggcaacagagtgaggctgtctcaaacaacaacaacaacaatgttctagaggattgtattacaacacaggcctaagaaggaagggaatggtggcaggtgaaggaattgatagcacctcaccattgtggctgttgagataataggtggctgctgctaagaagagatggtccccaaatgtgcagagacctcctttgagttgaaaatatcctcaaagtaatgaccttaccatttgccaaaaatcctggaaaccataagctccatgttcctccagctgttcaatttccctcctgttttcttatctttgtgtcctttcctcttgttcttgaccttgtttcccatccctgaatctgccatgcatcctcttcccctgaaggttgccaggtccctttgtaggccactgaagcagaaccaaagaggggaaatgacatacctttagccattctccatcagcatgccatgtccttgctgcctggctgcctccttcacattaatctcatcacctgcctgactgtccagctgagcacgatgtgagccctatccaagctcatgtgctactctgtgccttatttcacgatgcagcagtgaatgataactgctttgctggggaagggagccatgaactccaagaaatcagcagtgctgctccagtagtaacttttcccccagatgatggctgccttgcctcagtaatgaagactcccacttttctcttagaacttgtcttctggggttctactgcctttgagatcatacctacttactctatgcatactatgagttttatctatctgacccaggataatgagcagacaattaagaaagtaaaaatgatgaataaatacctaagaaggttagcattattggcaataaaaaatgcaaattgaacagtgagatgccattttcttgtgactcaatagcaaagaataaaataggtaatgctggtaagcatactctatttatctgcaggatataaattggttcatcctttttttttttttttttttttttgagacgaggtctcactctgttacccacactggagtgcagtggcacgaacatggctcactgcagcctctacctcctgggctcaagggatcctcccacctcaatccagctgagtagctgggaatataggcatgtgccaccatgcctggctaatgaaaaaaaattttttttttttgagacggagttttactcttgttgcccaggctggggtgcagtggcgtaatctcggctcactgcaaccttgcctcccggtttcaagtgattctcctgcctcagcctccggagtagctgggattacaggcacgtgccaccacgcctggctaattttgtagttttagtagacatggggtttctccatgttggtcaggctggtctcgaactcccgacctcaggtgatccgcccgccttgacctcccaaagtgctgggattacaggtgtgcgccaccgcgcccagccttttttttttttttttagagatggggtttcactgtgttgcccaggctggtcttgaactcccggacccaagtgatcctcctgcctcagcctctgaaggtgctgggattacaggcatgagtcactgtgcctggctaaacaaagaaattttttacctacctgtggatttttctttctgacttggcttcattgaattgagtactttgcttctgcttttaataggaaaggtggctgggtgtggcaggagcactttggaagtccgaggcaggaggactgtttgaggccaggagtttgagaccagccagggcaacatagcaagacctcatctctacagaaaataaaaaataaataaaataggaaaggctcctataactcactgggtgggaggaagaatgaggtgctggtggtacatgttgcctactcaaaaggaacaacttggctggtcatggtggctcacccctgtaatcccagcactttgggaggccgagtcggtggatcacttgaggccaggagttcaagaccagcctggccaacatggtgaaaccccgactctactaaaaatatacaaattagctgggtgtggtagtgcatgcctgtaatcccagctacttgggaggctgaggcatgagaattgcttgaacctgggaggtggaggttgcagtgagctgagattgtgccactgcactccagtctggatgatagagcaagactctgtctcaaaaacaaacaaacaaacaaaacaaggaacaactctgtttttctggctagataactaataaacttcagcatcttaaggagagccatgagatgggacaggccctacagcaggccagaaatgtcatggtaagtgatgattgaccttacaccaccactgggtctcctgtgaagatgaagaatggagaatcctgggtggttagtagatggtgatactaagtcgtggtggtgaagggaggtttccaaacatttgtaaagtacatctccttatgcggagcttggaattggggttagcggttttcctccccagtgcccctgtttcctgcttagtgactttatttgatctcacctacccatttttttctctacagcaatcatgggtgcttatctctaaagagctgatatccttgcttcacctatccctgttgcatttagaagaagataagactactgtgagtcaggaggtaagcagcctgaagatggaggtggaggcctgtggtgggactaaaagccataaagaggaaccagacacattaactgattcttaccatatagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggtaaggtgacaggcatttgttcttggatgtgggaggtttccacctcaaggttcctgcaggaacacaaatgcactttagacacagatgggtggcctaagaactgcctgccctgggcagtaaagaactgatctattgaggtgtcatggttacatctttttgtgctggctcccctgttgcccactgtggccttgcaaccacttccctcaataggcagagatagtgttggaggctttctgtgcacacgccagccagcgcatcagccagctggaacaggacctagcatccatgcgggaattcagaggccttctgaaggatgcccagacccaactggtaatttaagggcattttctttcctggggtctgtgctgacagactgggagggtagttgcatactcccactttgctgtatccaaagggaaggggttcccgcctaggcaatctttcttttgtaggtagggcttcatgccaagcaagaagagctggttcagcagacagtgagtcttacttctaccttgcaacaagactggaggtccatgcaactggatgtgagtatttgggaccatcataactaattccttactcacatcaagtcctgttgtgagctttgcctcaagtgtgctctactgacctgcttgcttcccctggtagtatacaacatggacagctttgctgagtcggtcccgacaactcacagagaaactcacagtcaagagccagcaagccctgcaggaacgtgatgtggcaattgaggaaaagcaggaggtacaaaccaagagtggggactgcttaggcttggtttccttcctaatgtgtgataccattagcctcttaccctggatctgttttcttttcaccctgtgggtttggaggccagccagtaaggtctcttagctgtaagatggccttaagcgcagttttttcctttgcccttcagcatctttacttcagcaacttttctcctgtctctactttttcctgaggatcaaccttattttctgcaatgttgatgcccaggagcaaggtagttttctgtcttgtccagaaagagaagctggaccaagtcctgggattattgattcaggaggaactataggaggaaaaccatctgttcttcctaggtttctagggtgctggaacaagtctctgcccagttagaggagtgcaaaggccaaacagaacaactggagttggaaaacagtcgtctagcaacaggtgtttgtgtgtgtgtgtgtgtatgcatgcatgtaagcatttgagccctgttaaggcttggagtgtggcactagagcaaggaagtactcaggagcacttgctttggagcagaagtttggggagtttctagcctgctgaccgcatggtgtcattaggatacttttgttctagatctccgggctcagttgcagattctggccaacatggacagccagctaaaagagctacagagtcagcatacccattgtgcccaggacctggctatgaaggatgagttactctgccagcttacccagagcaatgaggagcaggctgctcagtgagttcctaacggggtactgtggcagtaggcatccaggatttaggaccaaatgggatctaatatgttgtctctggcagatggcaaaaggaagagatggcactaaaacacatgcaggcagaactgcagcagcaacaagctgtcctggccaaagaggtgcgggacctgaaagagaccttggaggtaaggaatatggcttgggccaagggagctggtaagcctcaggagtgtgattcttgcctgatagtgttgaggtaaggtttgagactgtgaactagaaaaagcctctgtacccagggcactaaaattctccctccctgtcttgctccttctcttgtcttcccagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacgtaagttctctaactttctgtacttccccctaagtgcttatttttttctcaggaacacttctagaagccaaaatctccaagaagagaactgtgagtgttgagcctcttgtttctctcctttaatgcagctctgtggggatttgggataggcgttcagagaaggtaatttggtctttggtcatcttccctgttccttatttcagggctaaactggccagcaccatagcagataaccaggagcaagatctggagaaaacacggcagtactctcaaaagctagggctgctgactgagcaactacagagcctgactctctttctacagacaaaactaaaggagaaggtaggatcctggggttccttctcttctcttccaattgtatctttattttacagatagtcttcctaaaacattactctttttctaactgtgaccttttatgatttcagttacctacaggacctcattagcctgttgctcaaacctttcttcccctgtctcctatctccctattatgaacactttgccccagctagactgcctgtatgctacacacatgtccccatttttatccccagaacccagactctggctgttcccacattcattctattctttcttcaaactggaaatgccttttctattaaaatcctcccttccgacctgggcaacgtggtgaaaaccatctctacaaaaaaatacagaaattagcccaggtgtagtgttgtgaacctgtagtcccagctatctgggaggctgaggtgagaggatcacctgagcctgggaagttgaggctgcagtgagccatgatcatacctggctaatttttttgtatcactgcactccaaactgggtgagagtgaaaccctttcccccacaaaaaaagaaatcttccctggtttaccttctttgaactgttcccaaatcaaatcatgtggacccggtgatcttttcttctgccatatttctcatgaacttactcttcttttgtatttgtattaattttccttggatacctggtctcttcaaccagactatgtttcaagaaagcagaaatatagccttctttggcctccctgcagtgtgcactaaacaataaatggttgacatcattcagaatacaaaggtaattagcttattcagcagataaggcacaacaaatatcctaaaatctggcaattgcttatgacctgatcctcttccccaactgggtaccgagcacaggaaatgccatcaaatctacagtttagcatggaagacaaacagatgtaaacttgtcatcttgacttatgatcatggtagaggtctgcatggaccactgtgagagatagagaggggagcaccacttcagccttcgagaattaggatgccttctcaaagcagctgaccttgggtacagtcttgaggtttagacgtttgtggggcaggggagggtatttaggaagtcccactaggcagagggaacggtgtatgaaagtttcatctgactacatatgagagtcgtacgtagaaagtcatgcacatagtacatgatgtgttcttttttatagtgtctaccttataaaacctgggttaggtgctgggactagaggatgaacaaggcaagatgctgctcatatggaatgcagcaagtctgaggaatgggaagcagctcttcatggctgcagcgtgagagctctgtggggcaaggcaggagacaacactggagaagtaggcaggaggccagattttgaaggcttgaaataatggcagttttataggcagtagaaaggagaggatggagtgaatggattcaatagatatttaggaagcagaggcagtagaaccaatttgatgtaagagtgaccaatttgatgtgagagtaagttagaagagtgaatgatgatccttagattgctaggaaagagggcccagcgggtcagctgtgttagtgtgtggagactagggctagtgacacctccgggtcagctctgtgcccaggaagcacttcaacctgtgtggcaggagggatagcaataggaagcacttcaattccccacaactcagacacccagacgggagggcagaggaccaaggctgaaaggagtagagagcctgagagagagatgagactgaggggagctagtggtgactcaggctaaccagtcagcgggagagacctagaccggggggcagagaaggcgggagaactggagagaggacctagcctaggaggagagggagcaggctgagaaggaaatgctctgggtaggagagacagactccaaggaaaaatccaacaagtagaggaggatttgggattggaaaagctgaggtccagctgggagagctgaagagggatagaacagaagaggttgagccatggggtttcaagtacgcggaaaggagcaaagatgttaggaaagggtcgaaagggcacatcccggagtcccaggtagcaggacgaggatggcaggggaagagccaaggaaatgaagcggagatgttgagtggctcccgccttgcctggccttacctgtgcgcagccagttagcagccgcagccacaagcacagctacttcaggactgaggccagcaagcttttcctataaatggccatataataagtatttttggctttttgggccatatggtctctgtctcaactactcaattctgcctttgtagttcaagagcagccatagatgatacagccattaatgggtctggctgtgttccaataaaactttatttacaaaaatagttggcaggctagatttgacctgtaggccacaatttgctagccttccctctccctgctctagaatagtaaatacaggagtaggaacagacttttgatagggtgttccctatcagggcacagggaaaatggtgaactcagcttcatacatactaagttgacagattgactgtggaaccttctggtagattcttcacaggcagttagcctttgagtctgcagactgggaaaaagactgggaaaaagttgagagagggatggaagagtcattcatgtggaagggaagtttgaagtagatgtttttgtgatgctcccaaggcaaggccaccctgggaatgaattagagtaaatttagggccaaggacttaacccagaggatccagcagttaaggaaggacctgtgaatagagaagaaataaccagaaaggtgtggggcctgcctttaaaggagagagactcatgtcctggaagctaagaaaaggaagtttctaaaagaacaatgtggtcatcaatatcaaataggtcaggtaaaacaagagctgaaatatatgcattgcatttgaaagtaaggctgccattggtgaaccaaatgacaagaatttaggtggaatgacaggggagaagcctgagtgtagtgggctggggagtcaatagatggtgagagttataaacaagaagtataggctctttttttctttcttttttctttctttcctttctttctagaaaaggcagtagctaaaaggggatttaaggtaagaagaagggttttgttttgttttgtttaggtttgtttttaaaatactgctgtttttgttggagaggcttaagaatataaacatgttcagagaaaggcactaatggagaagttgaagatagagaattgagataataggtggaacagcattttggaggagatggctgggagttacctggaagcccaggagttcactagacctgaacagcagctattttttcttctttgcccttagactgaacaagagacccttctgctgagtacagcctgtcctcccacccaggaacaccctctgcctaatgacaggaccttcctgggaagcatcttgacagcagtggcagatgaaggttaaaggccctgggatttgggggtgggaaagttgtgacgctgctcctgatatcttctgctgttgaagatgtccaccagcgggcttgtctatcttaccctggcttccattatggtagacccctgcctggatcatcagaggggccctctcccattattggtttttctcttagagccagaatcaactcctgtgcccttgcttggaagtgacaagagtgctttcacccgagtagcatcaatggtttcccttcagcccgcaggttaggaggggctccagggatcctgcctcatttctagaaaatctggtggtgatgagtaaagacgaaagcagtgagaagtgctttgctctaaaaacctcaattctacttgggctcattttatttctgccttctgggatctgtaatgttccagacattcaaatcctgtgggtggggaacacggataagagttgtggaaatgatggctatacactccttccttccagggctggaaggctagacctctatctgggactttctctttcagagaccccaggcatggaggagagcctggcagaaatgagtattatgactactgagcttcagagtctttgttccctgctacaagagtctaaagaagaagccatcaggactctgcagcgaaaaatgtgagtgggatgcagttttggtgacagagggacagtgagacatcctcttatgccaagggtccaactgatccctgagaggacaggaatgttgctaaattcttccttccttcagttgtgagctgcaagctaggctgcaggcccaggaagaacagcatcaggaagtccagaaggcaaaagaagcagacatagagaagctgaaccaggccttgtgcttgcgctacaaggtgaaggagggacctagaagtggggcgatgaagaactggggcagctctactggcccactgggagccattatctctccaggaatctgggtggtggggattttccaaccactgccctagttttgcccttcctggggtcagacatttcacatgtcagctatgggctgacctgtcttcccaggctgactcaggagagaagtcaggaactctagcagagctctcccaacactgaaatgtgccttgcctggcttggccctggggaaagaattggcgtgatatcaattggtcccatgtgggctaagcatgggtcaggcactctctcctacctcctggcaagggctgtgaagagaccagctcttcatgtgtcttctcacctccctttccctcacagaatgaaaaggagctccaggaagtgatacagcagcagaatgagaagatcctagaacagatagacaagagtggcgagctcatagtatgttcaccatcatgcccaggcctttgccttctgtgttactggtcagccaggatcccaagtatgagaaatggtttgcttttgttcaccacatgttgtctatccttatgtcctattggacacctctccattctcattcccagagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtgactcagagttaacagaggagctggacagcaggtggggaccccaggctgtacccctgttgatctggacatatttctaggtggacaaactgagagtgatgttcctggagatgaaaaatgagaaggaaaaactcatgatcaagttccagagccatgtaagaatgtccatgccattccagggccatttcctaccatcgttaacaaatgccccgccatgtttcccctgtcctaccaagtttgctcttttatgcataggacttataaaatctgtttgctttctagagaaatatcctagaggagaaccttcggcgctctgacaaggagttagaaaaactagatgacattgttcagcatatttataaggtataggcaggagggaggtgatatcactaatgaacctggtacaaggcctggccccaggaggtactaatgagcacagatctggttcccagcctgtgctgagagctgggcctgaatcactattgcaggcttctctgtggtgtctgttttctcccctctaattcagcggctgcctcctggggctgggagccctgggccttaagtctgtggtcctgagctgcgttttctgcctctcttcccagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaatttctccaa

SEQ ID NO: 99 - DNA, 46475 bp, Homo sapiens
ctcttagcgctcaggtcttttccttccgccgacccgaagtcatcgctgggagtactggttgccctttcctcaggtcagccctggtgttgcccccaagagccagccgcacagttcacagggacgccttgcttcgttgggtgacccatgtgtgcgctcctatttctccccttagattgagggacacggctcgccctgcgtctccccgtcacctcagggccaccgcgcaatgtgtccccctcccccatcccaagttcccaggcccagcaccttgtacggaaggcggaggtccaagaattccggagtcggttgttgtcttgtggtcttgtaccctttgtaatataattatcttagtttacctcctctaactcccaaatcttttaggatatcttagaacggtcccatttggtccctgttagttggaaagcatctggtggcttgaatttctgactcatgattgttactggagtctctgtaaacaaaccggcactagcgctatcacattctctccgggatttccccccctgctctgtggcttcttgttgagaggttgtttggttatggtttagcgttgaaaagattcaggttatccttttaaatgactttacgttttagtggagctgggagattacttgcctggcttctaatcttcatgttggttcattttatttccatatgtgtgtgggttatttgttcagtaattagaattagataaagtattctgcttttaagtagttttgagaaggcctaaaaatactaaagtgtattcataaatatttttattatgttcagtagaagacacacctttgccatgtaaattttaacttttctcagtccttcagtgaatctacagacctattttctcaggagctcagcctggccttacttcagtgataaaaggaggaaaggtgagtgggagttggaggcattaaaattcttgagttcaagacagactgcgctgatgctcaactgctgaccactaaagtcataaaattcctaccagtttcccaaagagcttgagtgttgttcttggctttgttccagctctggttgaattacttttacaagtttaattgtctgtgggcttcttgtctttctgtcctaaactattgctgtgtatctccaaatgacttaagcctagaagtgaatgtgtgccccctgccccatgtcttcttttcttctttattcattttccttgtattttgtctttgtgtcgatcatattttttacgttgttaaaaactggaacttagtttgcctgagttctgttcatcctgttgtcaaatcaggtctcttcccctctcacagcttcgggttgtcatcccttggtatttagaggagaatatttagctgcttgtgactaaaagctggggagtgatgagtgatgctgcctttagttggtgtctgagtccagtctatttcagaattccgactttttaggatatagtgggaaattttttgtaaaaaaaaaaaaaaaatagtggctgctctttcttttgtagctggtctgaagaattcttggttagcagaagaaacatcctgggcattcagcagcatgggttggtgccaaaaagggagtcagaacatacttataaatgcagttttcgtgaggctttcaggtttctggtagcagagactagaggctcatggcatgtgacagaaaagctaagtgactggaaggtaggcctggccaattcctaatatctttatgatttgtagtaggaaaatattgagtgacactggtgagttttattccatctgatgactgaattagaaaatgctcatcatggactggaataaaattattagtgatggtgtatatgtgtatcagtaagatataaagagaaaagtacagtctttagagattggacagacttttaatttaattttaaggtttaaatactagactaatatttcttagccatgtgaccttgagcaagttacttaaacttctctgactcttaatttccacaactctaaaagtgtgataataccacttacctcccagggtcattgttagtattatagggaatctatttaaagctcttagtaatctaagaacacgtggtacacactcaaaaaatgttgttttttggttttttttttttgcacatcattgatacagctttgaataagttatacgttaatttatgcttcttttacattttgccttagaacacatttttctggttaattttcccaactgatttttaattggtcagcttagacgtgtcctttgtaagtgcccacctagagttgtcttctgaacatgaaacccttggtgggggttcataaccagaggacagagaatattagatattggtgtatgtatatttcaaaatgtattcttaaacatcagtaaatttttttgttcattggttccttcatcttggactctctgttagcacacctgatcagagttggccgtgttgtaattctttccctctctgctgcaatgttgtttacttctactgcaactattctttatactttccttttttgccatgaagggaatacattttttccttcttgttgggctatacagtgatcctcatcaacaaattatcaaagaactgtatgaggaaaaggtctctttttttaaaagtgaatcagggctggggagttaggaatgaagaggttttttttgtttgtttgtttgttttttgacgagtcttgctctgtcaccaggctggggtgctgtggcgcgatctcagcccactgcaacctccgactccctggttcaagcgattctcctgcctcaacctcccgagtagctgggattacaggcatgcgccaccatgcccagctaatttttgtatttttagtagaggaggggtttcaccatgttggccagggtggtctcaatctcctgaccttgtgatctgcccgcctcagcctcccaaagtgctaggattacaggtgtgaaccaccatgcccggccaaagagttcttttttcagctccacagctggaccgtcttaataatatgacagcacagatgaagagttttaaaccttttgttggcttttctttcgtatctttttggcaagggcacatgaaaattaagtactgataatatcacaatgaaagcagctgtgtcattcagaccagtgaccattttaggtttgatgaacttttcattaccatcatccagggtctaaattctccattgtaaggtaaggattctccagggtggtggtgaggtgggttgagattgcatttgtatcatttgtgtttttatgaactctgaagatccatgtcgggtgaaggaaaggatgggaggagaaaaggaaatactttgaaagagggataacttggactgtttatttccttatgtgctgggtaagaatgtccaggtgacatctatatgtagtaaatcagtatttctagtctgtggaccacactgtaaactttttatctttctaaagttttttttatttttgtagagatagggtctcactttgttgcctaggctggtctcaaactcctgggctcaagtgatcttcccacctcagctgagtagctgggaccgcaggggcatatcaccatacctagctaatttttggttgttttttttttgtttgtttgtttttttaaagagatgaggtcttacttgcccggctcaagtgatgctcccatcttggcctcccaaagtgctgggattacaggcatagccgcagcacccagcttgaagatatttttatatttccagggttttaggtgtttacttaagaattgtgacatcttattaggtagtatttcctaggatgattagagtgggaggctaagaatgcttgtgaccttttagttcccaccaccaacctcttaaagtgcagtctatttatttatttttgaaataggatctcactctgtcacctagagtgcagtggcactatcatggctcactgcaacctcgacctcttgggcttaggtgattctcccatctcagcctctcgagtagctgggactacaggtgcacgccaccgtacctggctaatttttgtattttttgtaaagatgaggtttcaccatattgcccaggctggtttcaaacccctgggctcaagcaatcctcctgcctcagcctcccagagtgctgggattacaggcgtgagccactgcaccctgctaaatgcagtcaattaaatgtataagaatctgccaggctgagtgcggctggctcatggctgtaatcccagcacttttgggaggccaaggtgggaggatcacttgatcctagttgttcaagtccagcctaggcaatattgagaccttgtctctacaaaaagtttaaaaaaaaagccaagcatggggcaagtacttgcagtcccatctccttgggaggctgaggtgggaggattgtttgagtccaggaggtagagctgagattgcgcagtgatcactgcagtgcgctgagattgcgcctctgcagtttagtatgggcaacagagcgagacctagtctcaaaaaaaagaatcagttccagtgccatggtccttagtgtggagtaggaccaacctaagacagaagcttgtctacagagagctgaaagaaagcagcctctttgttgccagtttaaaacaatactggcattttaaaagcaaacagattctagtaggagacattgtatagaagcgcaccctgttgtgaaagactgggatcttgagtttcgtgctctaagtcttgtattctatcaggggagtaataggcttttaaaatcataaagtgactattaaaatgctttcagtagatagattcattactccattatttctactgtataaaagtttattctaaacatgtctaggaaatatccagattataaaagagaaataacggtatccaaaccagactttttattgcataacattggtgttagagttagtttttaagtctctgagattgaattagctttttttttttttaaagcagattatcagtgagctaagataatctgctgtttaccctcacctatttggaacacaggcaactgaattaattgaatcagcaataggcatggggtagtgactttgtatattttcattttagagccaaaagccagtgagttttagattagctttatagtaatattaaaaacttcatcttttatttttacaaatgtagccaagaaacatcattgctgttaaaatcagtcagaaaaggaggctacttgctctttattgatttagtcattctgctcttggagtgagtagaaagtctttgaaagcttttcaaaaattagcgagtgatgaattttatgaattagtcacttctttgcagcagtttttttttatctctacctctgtaggacatagttcctgggccagaagccagatttctcaagtaccatctaaccccaggaatgtgttatgatacagataaattaatgaacggaggctgccttgaggttgccaatagggcattggggagtaattaatatgacaaagatgtcatcttattaatgaaatgtattaatagtatgtctagtggattgggtcaatgcaaacattttagattagatatttgctgtttatcctctgaagttactgtttaaggaagtctggccaagttctaaagtgaagcatacatatttgcctcacgtgccatttttttttttcttcctggctttttcttagccatctggaaagctactatagggtttacctctaatggtagtcaagttactgtattcctctggtgtactttaatgattgccacattaccaggtatgttttgttaaccttacttagaatccaacattagaccctttcttctaacctaacctgtaggaaggcacttcttgaggttttaagcctctctttaatgttttattgtaagttgtaccttgggagcatcattttttcatcttaaatcctctccagtttaagaaaaatttgaaatataaatggcaaaaactgttaatggcaacagacttctgatgtaaatgtaaattgagatggaaacaaaatgaaaagtagatttccctaggaattagttaaactgagataaatggtcctggatgtttttatagaaagttctcttagccaggtgcagtggcatgtacctgtaatcccaactactcggggggctgagttgggaggactgcttgagcccaggagtttcaggctggcaacatagcaagaccttgtctcttaaaaaaaaaaaaaaaaaaaaaaaaaaaagtttgcttagttctgctgctggaaattaacacttaagggttagagtgcattcctgacatagtctgaaatactgttattagaattaaagccagaggccatgcacggtggcttacatctgtaatcccagcattttgggaggctgagacgggcggatcacctgaggtcaggagtttgagaccagcctagccaacatagcaaaaccctgtgtctactaaaaatataaaaattagccagctgcagtggcatgcacctgtagtcccagctacttgggaggctgaggcgggagaattgcttgaacccagaaggcagaggttgcagtgacccaatatcacaccagtgtactccagcctgggtgacagagtgagaccctgtctcaaaaaaataaaaataaaaaaacaataattaaagccagtaaactataaacactgggcattttatgttaccaatagggagagaaggcattaattcaaagaaggaacaaagttccttattcatagtttgaatcctcatcattatccatggtgattgctttgcagtcttccatcttgggtatcctcagaaccttcaagagggagaagaggccaggtgtggtggtacatacctataatcccagcactttgggaggccaaggtaggaggattacttgagctcaggagtttgagaccacgcggcaagatagtgagactccgtctctacgataataatagtaaaaaaatctattttaaaaattaaaagagggagaaaaacttagggaggcttatattgtgggttcctgggtagattgtcttactgcagttcgtagaacatgaatacttgaaagaagatattaacggagctctctgaattctttaaaacgccagaaagggtaagcagatttcatagacttgggactgtgtcctatattatatacgatgtttggagaatcattgctgagtggtaaagaggtccaggattttctaggaaatgtagtctggtatagagatgggaaactagaaaaataatataaatggctactatgtacaaacaggctcttagcatacattatttttaatcctctaaattcctgcagggtggtaatattatcccattttacaaaagaaaaactcaaaagcaggtggtagaggtagaattcaaacccaggtctgtttgacaccaaagcccttttctttctttcataacacatgctgtctttaaaaataggacttttcttttttcttttttttttagatggagtcttgctttgtcgccaggctgtagtgcagtggcatgacttggctcactgaaaccttcccctctcgggttcaagcagtcctcctgcctcagcctccgagtagctaagactacaggcgcatgccaccatgcccagctaatttttgtatttttagtagaaatggggttttaccatgttggccaagatggtcttgatctcttgacctcgtgatccacccggcccggcctcctaaagtgtggggattacaggcgtgagccatggtacctggccaaaaaaaaaaccagggcttttcaaagccaagagatgaagctgaaaggtagaattaaatatttcttataaacatatgtatataaattattcaaatgacagtaggaatacaaactttttttattgtttagacatagttatgctatattggtaagctaatgagtttttaagaaaacaatttttttttttttttgagacagagtttcgttctttggcccaggttggagtgcagtggcacaatcttggctcattgcaacctctgccttccagtttcatgcgattcttctgcctcagtctccccagtagctgggattacaggcatgcaccaccatacctagcttatttttgtatttttagtagagacggagcttcaccatgttggccaggctggtctcaaactcctgacctcatgatccgcctgcctcggcctcccaaagtgttgggattacaggcatgagccacgcacccatcccaggaaataatttttatagatttaagagatagctgaatcctagtgttttatgattctttactggagagaaaatcagcattccattcaatctctgagataattccaggggaaaagctgttctgactcttacagccttttgacagtatactgttctctgtatttttttggaagcatggactatcctccttaccttcttggtttttttgtttgtttttctgagacagggacttgctctgtcacccaggctggagtgcagtgaccccatcacagttcactgcaatctcgacctctgggactccagtgatcctcccacttcagcctcccaagtagctgggactacaggtgtacaccaccacaccctgctattttttttttttttttttttttttttttttgagatggagtctcaccctgtcgcacaggctggagtgcaatggtgcgatctcggctcactgcaacctttgcctcccaggttcaagtgattctcctgcctcagcctcctgagtagctggaatcacaggcgtatgccaccgcgtgtggctaatttttgtatttttagtagagacagggtttcaccatgttggccaggcttgtctcaaactcctgacctcaggtgatccacccgcctcagcctcccaaagtgctgggattaccagcgtcacttagacgtcagccactgtgcgcagcctaatttttaaattttttctagagacagggtctcctgatgttgcccaggttggtctcaaattcctggactcaagcgatcctccagcctcagcctcccaaagtgctgggattacaggcatgagtcactgcgcccagcctatcctcaccttgaaacctttttattcttgacttccagaggtttaattttgattattcgttcttctcaatttttctctctgctctcctttctcttctctaagggtaggtattcctcaagattcttcccttgaacatcctctcccagagccttcttaggtaactaattgtttgttttagtgagatatgatttacaaggtgtttgattttgaagtttctctgtacagataattcacaagtctgtatctctggccttactttatttaagttccaaacttaaatttgttcgtcagtaccttcctaacatgtcggcttggattttaaatttattcagaataatttctcatcccacctgccagcttctcatttgtgtcacttgattttctctgggcgccagactaagaacttgtccttcttaactcagctttgtaactgcttattgagctaaacattatctacctttacaacgattctcatgttgatccctttttaattccttttgccatcaacccaagacagcccctcattacttcttatcttggcaactataatagcttttaaacttgtttctctttccttttccttcatttcagtccatcttattatctttgacaaaataatttctctgatgcctgactgcctgccccccaacaacaaagcttttattatacttcttaactaatcaactataccttaccatctagccaaagtagactacccatatatgtttcttgaccatgtcaggtttttaacctccatatcttttcttgctctggtcctgtggaatgtctttctcaactctacccgttgaaatcctgcctgtcttttaaagcccatcttaaaagctaattttccatggaagcatttcgtttttccctgaaactaaatataatcttttcctctgttcaaccacaacagcattctatttatctttttaaaaaatgatagatacttttatctcttgtatcactcatttttcctaattgattaattggctacaaatgggattgtgactgccttgtttatatttgtagcttctaaattgcctggtaccaatgctgttgtgtaacagcatgtttgcttacacataggccactgggtggtgccagaggcttgtgatttgtataaaaatgagtagcctagactcccagctagagtctacctgctagagtctctctgcagttgggttgtttgtactgtcagatcttcagcacagtaggaatagagattaatttttctgttacagaaacattcagtttctttctgctcatctgtccagcctaccagaggagacagtgtcatatgttggacccctccaagtacttaatagaaaatagcccagaactaaagtcctacctaccataaacatgctttatataatgagtttcagcctctttggggtcatcctttgagtttcagtgcctgaggttctctgattaataaacactatacggccaggtgcagtggctcgtgcctgtaatctcaagcattttgggaggccaaggaaggtggatcacttgagtccaggagttcgagaccagcctgggcaacatgttccccaccaccatctctacaaaaaatttagctgagtgtggcagtatgcacctgtagtcccagctactggaggggctgaggtgggagcatcacttgagcctgggagatcgaggcttcagtgagctgagatcacattactgaattccagcctggacaacagcgagaccctgtcttaaaaaaaaaagaacatctgcaaaaccactatgctattagagtgtggaaggcaagtaggcttggagaagtaagtgtttcttgtgaaggagaaatattaagaaaagtaaaataaacttaaaatgagccatttcatcttggaaacaaaaattggaggtggagaaagtagaactagttgataccagatggactgtgggacctagaaaagcaaatttgtactttggatggagatcaaccctgaacagctgctcatttatgagtggtatgggacatctgtcctcccaagagaaacttgggactgtgtggctctctgtcttaataataattgaagtattttcttatcaccttcttctttcagaggaaattctaaaaccttgtctcatttaaatatgggtgtttatgtaggagagttgggcacttgagtagcagaatgaggcaggcactggtttgagagaatgctgggattatataaaccatgagatttgacagaccgaattcaggtcttagtaaagggatcaaggacaataataatatttacacgttgatgtttcgatcgggctcaaggtaaggtagttgtcagaccagtgttcatagaccctaggcaccagaggatttaaaatgaaattcagagaaatttaaaaaaaataaagagcataaacatacaaattaatagtacaaccacaagaacaactttgagctacttaaatttctgctattcttagttatcaccaagacaatagggttgtagactttttatgtatttaggattcatcttgccattaatatggtcgctgataaatcacacaggcagtcttggttgcagcaaaaatcctttcagcactttcgttttcaagtgagaagtctggacattatgctctcatttgctatgatatattgaccatttttgtcaacttctattaatcacagccttgagaatttagtgtttttaatggtattatgtcatttaacaatttgcatgattttcccccatcactcttctctcatcctgttttttttttttttttttttttgagacagtttcgctcttgttgcccaggctggagtgcaatggtgcgatcttggctcaccgcaacctccgccttccaggttcaggcaattctcctgcctcagcctcccgagtagctgggattacaggcatgcactaccacgcccggctaatatttttgtacttttaatagggatggggtttctccatgttggtcaggctggtctcgaactcctgacctcaggtgatctgcccgccttggcctcccaaagtgttgggattacaggcatgagccactgcgccggcctgcattcgctctttttaggccacgtttattaaggtataatttatatacagtaaaatttatccttttttgagttggcctattcttttaattctgacaaaggcatagttatgtaacaccactgtgattggcgcatggaacatttccatcattccaaaaggttttctcatgccctttcgtagtcagtttcattcccctacctccaagccctggcaatccctgatccctctattcctatagttttatcttttccagaaagtactataagtggaatcatatattgtatagctgtttgagtctgaattattgcacttaccataacatacttgagatctatccatgttgttgcttgtatcagtagttcattcctttttattactcagtagtatcccattgtgtggacctaccacaatttgtttatctatgacccagctgaagaaaatttgtttccagttttttgatgaatttaagtaaaactattaaaacattcacctacagggtatttttaattttgtggacatacattttccttcttgtttatcttatttatttatttttaaagatggagtattgctgtgttactcaggctggtctttaattcctgggctcaagcagtcctcctgcctcagcctcccaaattgctgggataacaggtctgagcctcttttttcttgtataaattcctgaagctgaagtgggattcctgagttgtatgataagtgtatatttaacttcataagaaactgccaaattgcttttttcaaagtaactgtactgttttgcatttctagtaacagtgtatatgagttgtagttgctctacttcttgttagtacttaataaagtaaatttttgttatttaaacaatttttgaccattcaaataagtgtttagtggattctcattgtggttttaatttatattttcctaattattaataatgttgaggatcttttcaagggattattatttacagtactttttttggtttgtttttgagatggagtctcctctgttgcccaggctggagtgcagtggtgcgatctcagctcacttgcaacctctgccttctaggttcaagcgattctcctgtctcagcctctccagtagctgggactacaggcatgtgccaccacccccagctaattttgtattttaatagagatggggttttaccacgttggtcaggccagcctcaaattcctgacctcaggtgatctgcccgcctcagcctcccaaagtgctgggattacaggtgtgaggcaccacacccgccctcttttttttttttgagatggtgtcactctgttgcgtagactggagtgcagtgagtagcaggatcatagctcactgcagccttgaactcctagacttaagtgatcctcccacctcagtcttccaaagtgttgggattacaggtgtgagccaccatatccagctcgcgataattatttagttgtgacagttttttttttttctttttttgagatggagtcttgctctgtcaccaggctggagtgcagtggcgcgatcgcagctcactgcaacctcctcctccctagtagctgggattacaggcacgcaccatcatgcctgcctaatttttttgtattttagtaaagacggggtttcactatgttggccaagatggtcctgatctcctgacctcgtgatctgcccacctcggcctcccaaagtgatgggattacaggcgtgagcctccacgcccagccccagcctgttgcgacagttttaaaggatattctggttactgtccttgatcaaatacatgttttgtagatactttcttccagtctgtagcttgtctttgcattgttgtaacagtatctcttggagatattttaatttttttttttttctagatggagtctctctttgtcactcaggctggagtgcagtggtactatcttggctcactgcaacctccacctcctgggttccagcgattctcttgtctcagcttccccagtagcagggactacgggcatgtgccaccacgcccggctaatttttgtatttttagtagagacgggggtttcaccatgttggccaggctgatctcgaactcctgacctcaggtgatccacccgccttggcctcccaaagtgctgggattacaggcctgaaccaccgctcagatttatcagaatttattaattttgataaatccaactgattaatttttttgtatgtgctttttgtgtcctatcctaagaaattgttgcctaacccaaggtcacaaaggttattttctttgttttcttctggaacttgtgttgttttaagttatatttaggtctgtgattcattttgacttagcttttgtatattgtacaatgtatggattgaggttctttagtttttttcttttggcagttgaatgttcagttattctggtacaagttgagcatcccaaattaaaaaatctgaaatctaaaatgctttgaaatctgaaacttttcgaatgccaacttgatgctcaaaggaaatactcgttggagcattttggattttgaattttctgatttgagatgctccactggtatattgcaaatatttaaaaatttgaaacacttctggccccaagcattttgggtaagaggatacaccggacaagggatacgtagtctcttatgcagatctttcatcatattagaggaaaagagcagccccagtagttttaaacaagagacacttggtatctcttttacagagtactcttatccagcgtagtaaagtctttctgcctggtttttagttaatattttgtcatgtaattggttaaaaatttaaggctttattcttattaagacaagaaaaatctaggtcactggaatttcttagtgaaattaaaatggcacctgggtcttttttcctcaccctccagtgggttactctttaaccttcagtttggcaggagttatggttatttttagagtaggaacagtggagctaatctaattaaactcctccaactacctgggacagtgagctcatcagcttttccaacctcagcaagattagctttggactagattttacatgaaagttgatcaaagtaaaaatagtggatttgttggaaatacagtgaaaagtgaagaagatagtttggatttgaatcaaatatgttctctgcagacctcagtttataaagttaagactgtattctttggtaatggaaaagattttttattttttatttttttggagactgtgtcttgctctgtcgtcctgcctggagagaagtggtataatcacaggtcactgcagcctcaacttctatggctcatgtgatccttccatctcagccctaccccaagtagctgggactacaggcatatgcctgactgatttttttcttttctgtagtgacgggggtcttcttatgttgcccaggctggtctccaactcctgcctcggcctcccaatgtgctgggattataggcgtgagctgccgtgcctggctggaaaagatttttcagtggctcctatacttgacacctagggcacagcatctctgcctccttgactgatttatagagacaagggtctcacagttctgcccaggctggtcttgaattcctgagctcaagcagtcctttctcagccttctgagtagctgtgattacaggtgcatgccacacctgtgagcatcaggttcctgctcaaagttttcactcatataggttcataatcaaagtttggagaccactgctctagagtatccttctgcagaaattttgacatttaattctacttacttttatcatctgtgcacatgtattttctagagcaattatgagtcaaaagttcaggcagtctgggctcctgtaggagttgatgcttggttttgagagaggttctctgcagctgcttttgaattctctgggagtggataatagtggggtgaaacgtatggtaaagagttttgattatggaggtgggaaaacatcagatctgttcttcatgttacactggtctgcttattaccttagtttataagttttttttaatttttttttttgagacggagtttgctcttgttgcccaggctggatggggtgcaatggcacgatctcggctcaccacaacctccgcctcccaggttcaagcaattcccctgcctcaccctccctagtagctgggattacaggcatgtgccaccatgcccagctaattttgtatttttagtagagacagggtttctccatgttgctcaggctggtctcgaactcctgacctcaggtgatctgccctcctcggcctcccaaagtgctgggattaatcttaacaaagtagtacattttccccacttgataggaattaatataattttaaactctagatggagaagataggctcctattctaaagaatataaacaaggactgttgagagggaaaaacaagtgctgtgtgaggaatgctatacaaaactgtctacctcaaaaatgaggaaaacaaaatgcattgcaaacagcttctcactatttttcttcatgttgcttcacatatctgttttttgttgccattgtctttcatcatcacccttccaggtgtcccttcctgaagttcagtcagcttcagccccagtcttgcagtatttctattcccaccttggcctattatgaacaatctttgggctactgtcttttgacagaggatacttttaatgaagcagcttagatttctatagagggtagcggaggaaaagataaggatgaggctgcttctggaataattgtcatgggaatgaaagggctgttgaaagattagaggccagtgtgcctgggtacaaggactggggtcataattatactttgtcttttactagtgccttttgtccaagtcactgaaagggcttaataaaattctggtctgaataatattattctttgctctttggaatttactggaggtggcagtgaggctctgaaaaaaatatgaatgttttatagtggcataaaaggaagtgagttagataccctgattccttgttaaggaaagatgagtctggtgaaagctggtgctgttaggtgaaacagtgtttgccattatatgaaatgggatgagatggtttaatggaaatgttgcctttttcttccccacctttgtctttgtgcttagagactctgactgttagtcctaagggaaacaaaacaacttaagcttctttcctagggatagggtgctcctgatttctagtttcagctctataatccttagtatctgtgcctttaataagtttgaagttagttgggctgggcgtggtggctcatgcctgtaatcccagcactttgggaggccgaggcgggcggatcactcgggagatcgagaccatcctggctaacacagtgaaaccccatctctactaaaaatacagaaaggtgggcatggtggcaggcgcctgtagtcccagctacttgggaggctgaggcaggagaatggtgtgaacccgggaggcagagcttgcagtgagcctagatagcgccactgcattccagcctgggcgacagaatgagactctgtctcaaaaaaaaaaaaagaaagaataataataataggtttgaagttagtcatctgagtgaacagaaagctcaatctcttcccccaagaggttgatttctgttgatttgtgtgtaaaatgatactcagaatctgacccacctctttatgttgtgaaaacaagtgttgtacagagtttgaggatacatatgtcacttatttacattggaagattcttgcctagggggcaatgctgaagttagctttatgtattgagttgagactcttggcttgcagtacctgtcatttgatatgtgcctcctgttccaggttttattttagttcccactttcgcatctgaaaaatcactgccagttactcagtgagtgaagtaaagagatggcacttgacctccccaaaaatatatcattatatggattttaaacatagggaagaaaacataaggaagaaaaaatttcacaagctgagaagacctgttaagcatgcatacacaaatcatttttataaaaatgataaaacctgtacattgttaaatctccttgtccctattgtcttctttcccaggtggtttcctaattgttttggtttcttcctctcccaaacccaggctggctacagcaaacatcattcaagatgtccagcaaagggagcagcacagatggcagaacagacttagctaatggtaaggggccaaaatgaaggtgaagctatttttactatcaactgaggttgtcctcctccctgcaagatagagtggaggcctggattttagtggagagagggaaactttcctgtgttgttctgagtttaggaaactacacaggaaacaccttggactatattatgcttttgcttcttctgattttatctgatcattttcaaaatatcaataacagagctgtacttctaagaggtcaagtggtttggagttctataaagctataaggatgggcagaacctaggaaatgctgttagtaaaggagaaaaataaaatctaatggctagtaggaacaagggaattttagggaagatgagcttcccagttatattgagaggtccctttccacagtaagtagtagtttgatagagagattacatggctgggcatggtggctcatgcctataatctcagcactttgggaggctgagacaggcagatcgcttgagcccaggagcttgagaccagcctgggcaacatagcgagaccccgtctttttaaaaaaaaaaaaaaaaaaggtgattacataagggatgaagttacaacccaactaggagtgggacatctttcccctccttatttcctttccttacttcccctcccttctttccatttatttccttccttccttcctttccctcctccttcttttcaggaccagtgctgccaagtgtcaaatcactggctttagggcagatttgaaggcagaatataaaaattctaatagagtataactaccacctgggttatttaaccagctcttcacctctgagccaacttttaaattagagaagccgcctttaaatggatatagttgggcagcacagagtccagcattccttagcaccttgaaggtcaggataacaggctaaattctagttgatgtgattggaggaaggataagtgagattttcaacatgcttttttattgctccatatgttcttatcactgccattcattcatcttttgtaaaggaaagtggttcatatttttcactgggtttagttgaaaggcacagggttctagaggagttaaagtatactattgatttggagcttgaccattagctaggtcaaggattggcaaactataaattgcaggccaaatccagcctgccacttgtttttgtaaagttttattggaatacagtcatgcctgttcgtttatgtagtgtctatgagttgcttttgttctacatactggagttgagtagttgtggtggagctccgtatggtctgcaaagcctaaggtttttactatctggccctttacagaaaaaatttgcaaacccctactctagatcttggtgatttactgttggggacttcttgatgagcttgtgataccctctggcccttatgttaatgtggtaaggcctccaaaattgtctatatttgttactcataattttaacaataaacactagatgttttggtgttttattttttcttttctacagacctgttaggttggtgtttcagtccctgctcaccactcccaagctcaagcccagctgcatttcaaaaaactgtaactgctaaactttcgtagcatatataacaggctcagcaaatgtggtccttgggttcaaatttctgtacttcataactttttcttccagcccctagcccagttgttttatactgtgctcttagttgaggcttttttttttttttttgagacagagttttgctcttgttaccaagctggagtacggtggcacaatctcggctcactgcagcctccacctcccaggttcaagcgattcttctgcctcagcctcccaagtagctgggattacaggcacatgccaccacgcccggctaattttttgtatttctagtagaaatgggggtttcaccatgttagccgggctggtcttgaactcctgaccttaggtgatccacccgccttggcctcccaaagcgctgggattacaggtgttagccaccgcgcccagcctgcaagaactgtttatgtcttctgggcttctgttactgcttgaatcaaagcacttgtattgttgatcttttttcagtattgggttttgcttaagagtacattgcttcagagctcttcacaaattactgctctaatccacatgactaggcaataaggtgctccacctttgaatccttaaacatcagtgtggtattggagttgaatagctcatactggatggtctgcctttcctgacagcttttacttctggcggataaaatttatagccatctgaggaaaggaggcccatgagcagcatttaaaatctttattctccccttttttcttcacaccttgacttaggttggaagttgtggttgtattggctttagaacattcctcaagttctcattggaattgacttgactgttgtgagttaagagaatgcagtatgtagttataggagataagatcgataaaagtgacctagttatttaactatcagcatagcagacctagaatatactgaactttcgtcttaggcaccactatagtagcccagctttttatcaattttatatatgcttcctaataaaactgtctcaatagagagactaaaaatgtgtgactaagaattatattaaaaaattcaaactaatggaagtaagtcaaaatatatttactagcaaaaggtgagcaagaacccactcaaatgatcacaattcccacttaccccttcagcttgctttcttagtgaattttagaaacttaggtggggaagaagcttaggatttaggtgacagaaggtgtagtggtactttcttttttttgagatggagtctcgctttgtcgcccaggctagagtgcagtggtgcgactttggctcactgcaagctctgcctcctgggttcatgccattctactgcctcatcctcctgagtagctgggactacaggcgcccggctaattttttgtatttttagtagagacggggtttcaccatgttagccaggatggtctcgatctcctaacctcgtgatccacgtgcctcggcctcccaaagtgctgggattacaggcgtgagccaccgtgcctggcctgatactttcttaaagtaggaaatggtgcaacaccacatccataagtcaagagtgatttttatcagctggtttccgtctttcgctaagaagatggctatgctagctcttgctggagttggctcttctttttatattctgtttaattatttgctataacttaataaatgcccatccaatacaacagagccaatggtagatgtatcaggcacacttttatacaatatgccaatgttttgcctcttgagaacttaatataatcttagattgtcctgagattctttgcttttgttgaagtattttatgtgtgtggatttgatcttaatcttttcaatttcttgtcctttacaagatttcccctcagagggtactctctgtaattatttgtaatgaaaacacttggaccaaagttcattttttggtcttttgatgtgaagatttcttagactaaggtggtcactatcctgttttcttatttttccctctcctctactccttcctcactaacatgcaggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggtgaggcaagggagcataatagcaactgagagaatcaggcatgagttagagaaatctgaactgcagcatggattgggagctgatagtgagttattgtaggaattacatatcgggacatggccctactttggctcccctaatgacctaaatacactgaaagactcttggcaaccctagattccttgagcatgtggactgttggaagcctcataggtagggtgcatgcagcttattaaatgtgtgctggtaggaggcagtgtagtataagcacaggctcttgaaccaaactgcctgagttcaaatcctagcccttctgcttactagctcagtgatcttggccaagttattttacctttgtcttcagtttatctgtaaaatgggactaataacacatagggttatgaggattaagtaacaatagaagctaagcagttagaactgtgactggtacttaataaacatttgataaatgttagcttatactgttgttattctggaaagattttactccttggccccatctactgtactggtaccagccatttatcctaagggtgttctcttttcttccctgacattccccctattttcctttttctttgtagcaaatttatatttactttcttaatcaaagtagatttttcctcctctattccttttctcctctgctagatacagtcctagttcatctgagctcttatcatgtgccagttcaatcttccagagccaactgaaatgctctcttacatcaaaggaagttttttctctccctttcctttaactcctggaagaaattgggcttagccagctgtacaagagtaggaaagctaagtttccagctgtcatgtaagaaaagggggtaagttgaggtcatcatcgtattttttattctcaagtttacctctctcatttcttttgtgtgtcctttttttcatttttaacaccccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaaggtaagtaagaccttgctccaaaatttgtgcaatccaaatcctctgtggttctcagccaaggttctcccttatctctgcccattgtgtcacatttgttgtggtcatgtgcctcacctctttcagtcctaagatttgtggttaagaaaggagcaaaagcagccaccctaaactcctaggaaggcaagtatctgaaaagtccctagatcatgcattcatagtatttggcccctaagctaagccctagttggtttggagatctttgaggtctcctgtgccctctaaaccttttacatttattgtgattttttagggtattttgacagtttcaaggtgctagtggtttattcctcttgtgtgagagcttcagcttacctgctcaaactctcagttcacaaatagcactgtttctggaagccctatttaaagctgggaatataggccaaataatccatggtggcagctaacaaggagttaagagctgccagttttaaggtaggcatggtgttggtcttttgtgccatgaaaagaggttggtactctcttagaaaccctaagcaaaaatataggtggacctggagtatccttttctagccaaggcggcccaggatatgtgaaaattacctatttctttgattcttaagtctactcctaacccactagttaactgattttcagttgtaaggaactaagatgtaaggaatgaagttggacaccatttctctctgcacttaagggtatggaattgattttattcgagaatgaactgttgctgggtgtggtggcttatgcctgtaatcccaatactttgggaggctgaggtgggaggactgcttgaggccagcagttaaagaccagcctgggcaatatagcaagaccccatctgtggaaaacaaacaaaaaaaaagcgaaaaaattagccaggtatagtgccttgtgcctctagtcccagctacttgggcagctgaggtgggaggatcacttaagcccacaaggttgaggctttagtgagccatgatcatgccactgcacttcagcctgggtggtaaagtgagaccctgactggaaaaaaaagaaaatgaactctaatggctgatgtttttctttgctatctgttcatatctcttgaggacttagttgaaatagcaaatcaactgtcctttgactagttatagaataaacaaaactataaataattcgcatagaacaagagtaagtgggcttagattatgtcctttcctgggattttatgacaaaaaggtagacatttctctttttggaacattttaagtgcagcccttcccaaagttataggaatgaactagatgacctctaattctaatatttagaaacctcatgtttttcctttttcttcttcagttggcactggaaccagactctccctgtacgttcttatctgcaggtgaagatgcagttgttttcaccattgacctgagacaagaccgcccagcgtcgtaagtgtagcagtaatatcattacagaactgtatctcttagccttgaacatattccatatgtcttggtaatgcctaactctggttcatccgaatagtacctttgtgcctatggttaagaggtagtttaaggttaaggggaattccttacttcctctctttctcagtagtgaaatactattcagtctaccttcatttctcaaacagtttacttgttatatgtggcctttaataatttgatgatcttttgctctttattcacttggatatcattcatcttacccacagaaagcacattcttccacagactcatgtagaggtacagtcctgtaaattttaaatttaaatacatttttaatttagttatttatagaaacatacaaacataaaatttgaacaaaaatactggtagctgtagttgagttctgttttatcacagttcatttgtatgtgaatctgagactcataggtaaattttattcctttttaactgtgtggtatcatagaaaaaacacaacatcttgtttggatccaggcagacctaggtcaaatctcaaatcaggcactactagttatgacttacataaccttctgaacctcattttcttcagccttgctatgggcatatttttttccctccctccgtccttccctctctagtagtttctgtgaggatatatatatatatacacacacacacacatacacacacacatatatacacacacatatacacatgtacacatatatacacacacatatatgtttatatacacacatatgtacacacatatacacacatatgtatttatatacacacacgtatatatgtatgtatatatatacgtacgtgtatgtatgtgtgtgtgtgtttgtgtgtgatgcctcagcataatgtttaacaccatggctgaaattgattaagttttagcttataattataattattttagtttcttttttcatttttattgctcttacaataaacaaatacttcttgtttaagagattcaagtaataaagtatacagacaaaatgtaaatgctccctcagtcacccccgccccaccatttttttagctgttgaaaaccattgtgggcagggcacggtggctcacgcctgtaatcccagcactttgggaggccaaggcaggtggatcacttgaggtcaggagtttgagaccagcctagccaacatggcaaaacctcacctctactaaaaatacaaaaattagctggacatgttggcatgtgcctgtaaccctagctactcaggaggctgaggcaggagaatcgcttgaacctgggaggtggaggttgcagtgagctgagatcatgccactgcactccatcctgagtgacggagcaaaactccatctcagaaaaaaaaaaaaaatcattgtaagtaattttgaacacctttttagtcccttttgtatacattttgtacctaaatacatatatacactttctcctttctccccataagtatacttgtatgtatatataaacatatatgtatgtttctgcagtttgcttatttcatgttacaatgtgggagatttttctgtgttggaccataaaagctaccttgttgttaaccatgagagaaatgtcatagcattggtgtaccacagtttatttaacctttaccttattgatagatatctagatcgtttattgtcttgtttgtcttaaagattattataacaaatcttggtcaggtgcagtggctcatgcctgtaaccccagcactttgtggatcacttgaggtcaggagttcgagaccagcctggctaacatggtgaaacctcgtctctactgaaaatacaaaaattagccgtgtgtggtggcacatgcctataatcccagctactcaggaggctgagacaggagaatcgcttgagcccaggaggtggaggttgcagtgagctgagatcatgccactgtactccagcctgggtgacacagcaagactgtctcaaaaaaaaaaaccaaaattattataacagatcttataggtcagtaccagtattgagtaagggatggcaatgatttacataggacataagtaaaatataaattaatttatattggggaatataacatgaaggctgattattactagacttatttttggagagctaagtccagaaaaagctgtttggatagtagaagaatttctacaactgcttaaaagatagaaatgttttaggcttggggaaaagatatgttgcttgtttatataaccttcaagaggacaaagactgggagatttatagtggaaatggaacaagcctaaatgacaagggttctgccttctagtactagctttgtagttatctgactttgaggaaatcatttaatcttttgaactacatgatgtttgttatttccagttctaaagttccagggttctgtaatggtaatggaagattagcaagtttttcatagggaagagcaaaaaaggaaaaaatgatagtaagtttatttaatatgctgtgttaaagagttgtgaaacagagtgagatcttatcctgtggatcaggttcagagggaaactactgttaggccaccaggaattgaatctggtgcaagtaatgaatagagcgaatgactttggcagattattgaatttagaatgaaattatataggcagaaagtctggctgagagttaaccatgaatctgaacataagcaatgataggtgggatagactctaaagaggggtaaaggagaaaatgaagagtagaaggaggcccaaatctagatttgagtaataaagacagtgagtctttaaagtttttgttgtaagggttaaagtagtgttacaggctggcatggggtgaaaagctgaacatctgcttatgtcagaggcatttttttttttttttgaggtgcagtctcactcttttgctcaggctggagtacagtggcatgatcttgtcagaggcatttttgtgtgaagttggcataagggggattttcttttgtatatatgatgatagccaagtctctgaaagctaatgaaattgactaacatcttaggaaaaaagtttgatttgaacctgtggatggaatattcctttagccagtggaagccagtttgaggtattcttcaaagaaatcctttggtctcatctgtaattatttttccctttttgctgggacatacttgctcattaattttaaggcaaaatttggtgaatttgtttaatgtttcctctaatgtgaacattttttcctcctattgccatgataatcatttttatagcacctctgcatgccccctgcagagttcaaggtactctgcatttacccatcaggagggagaaatgtttgttttatgggattaagttgaggcatagtaagattgagctcttcagcaggattacataactgtggagccagtacttcataatctattccttagtttcttcattttgcttccacatggtaacttttgtatttgtttgaccttgtccttctgaaatttcaaattgctaaggaaatgagatggtcctgtgggaaggagcagcatcagctcctcctctctttccctgtctaaaactcatattagagcagtctcttagctagttttgtccctgaagctgttattcttttgacatgtttcctgccttgtgtttttgagatgtgtgggggacaccattaggggatggaggtttcccctaatgacattcattttcagtgccctctgtattttttttgtttgtttttaattttaaaataaatagagatgggagctcactatgttgcctaggctggtcttgaactcctggattcaaacgatcctcccacctcagtctcccaaagtgctgggattataggcatgagccactacacctggtcctctgtattcatttaatgaaaagctgcagagatactaagtaaaatctcaacactttgcctagaacagttctaggctgaagtgactttggctatgcagaaaggatgctaaaatcatttctttacaaagaaacttgttgtcatggttatatttctttctgtttccatagcatcagaaataaataaaaccttagacttaaaaacaaaaactaaagccaagcctcttcctatagtttcttgaagtctttcctttgctgtaaatttaccaatcttcattatgtcatatttgactaattgaatgcttagatctgagaagaatattcctcatgccacccttaacctggaacaaattatggctgttttagacagattattctggatttcttcagtgaaaaatttatcagttttcagtgtgcatattttaagctgggttttttatttttttactttttgagacagggtctcactctgtcacctaagcagaagtacagtggcaagaccacggctcactgcagcctcaactttctggactcaaggaatcctcacacctcagcctcctgagcagctgggactataggtgcatgccaccacactggctaattttttataacaattttttttttttttttgagacagagtctccctctgccacccaggctggagtgcagtggcacgatcttggtccactggaacctctgccttctggattcaagcagttcttctgcctcagcctcccaagtagctgggattacaggtgcataccagcacgcccggctaatttttttatttttggtagagacggggtttcaccgtgttgtccaggctgatcttgaactcctgacctcatgatccacccacctcggcttcccaaagtgctgggattacaggcgtgagccaccgcacccggctttttataataattttttatagagatggggtcttgctatgttgcccagggtgatcttgagctcctagcctcaagtgttcctcccaaagtgctgggattataggcatgagccagtgcctggcttaagttgggttttaagtgacttttttttttttgagacagtcttgctctgttgcgcaggctggagtaccgtggcatgatctctgctcactgcagcctctacctaccaggctcaagtgattctcttccctcagcctccttagtagctgggattgtcctgagtagctgggatgataggcatgcgccaccacgcctggctaatttttgtattttcagtagagatggggtctcgccatgttggccaggctggtctcaaattcctggcctcaagtgacccacccgcctcagtctcccaaagtgtagggattacaggcatgagccaccatacctggccataagttacattttaatggaatctgagcaatagtctctgaccttaaggtcttttttagcctactgtttctgggattcttcttccacgtctctccttgttcccaggtgatagggaagatatatttataaataaagggtaggaaggtatctgtagtattgtctgattaataactggctgttactgtgttggactgcagctaaactgaggcttcctaaagaatggtacattcatatacctttagtttatacttcttaaggaacactagaaagtgacttcactacatatttttttccccaatccccaaagtcccatataataaatgtatgtgcttttttcctgttgttacgtacaaaacaaacagagaaaacacaacaattctttctttccaaatgagaatctctttggtttcttattagccatgtgactctcttggctctcctttgccatgaccatttggatcttttggagtatataactttctgtgcttttctactcttaaaggaaactggtggtgacaaaagagaaagagaagaaagtggggctgtatacgatctatgtgaatcctgccaatacccaccagtttgcagtgggtggacgagatcagtttgtaaggtgagtttgtggctcttttgtgtctttgacagtttgtaagactgatgcattgtatactaccaggtgctcctttatggagagttacgaattttataggaatccattaactattatcttgaattttttaccgttttccaaaaatcttacacgcctttggagatgttctgttctctaatgtaacagtctctgaggggtgactttacatattttagagattatcaagttttaaagaagttagatgatggtcaggtgtagtggctcacacctgtaatctcgacactttgggaggtgaggcgggtggatcacctaaggacaggagtttgggaccagcctggccaacatggcaaaactctgtctctaaaaaaaaaaatacaaaaattagccaggcatggtggtacatgcgtgtagtcccagctgctcaagaggctgaggcaggaggatcacttgagctcaggagtcagaggttgcaatgagccaagattgtgccactgcactccagcctgaatgacagagcgagactctgtctcaaaaaagaaaagaaaagaagttagatgaattgaccaaggtcctcacgtggcagctaagccataaatttaggtttaccagcaagtactatattagtaaataatctacctttttcgtatgtaaataaacgtgcactagaaattttaaatactggttttcaattcagaaatagtttgacttgggagcacttagtgtgaactgagggttttttggctctcactgtcctgagctaccacttttttttatccatagtgatatctttgttaccgtgaacaccttttgttaacactggctcttgagacatgacctaaggaaaacagacactgtggattcagtctccatatgtattagttaatttcctctgacccttagtaataagctgtatccatccctatccagttggcctattttaactatgtttctttgggctcatcagtttgaaaggagagagaggggcaagatcactagaaaaatgagtgactttttgctttcctaatggtaagtgaaaagcatcatcttccttttgaaatgagagcacattttatagctatatttccagattcattttattaataagaatcatggggaatagggtaaatttttagaaaatacatgagatgactttgccttgttcaagaatcctggacaaaaccttgtttctctcttcttcccctattcccatgccttcaaaattcgtttcctctagtcaccaacagtccttaaatgtgtagccatagatttttttttttagacagagttttactcttattacccatgctggagtgcagtgacacaatcttggctcactgcaacctccgcttcccgggttcaagcgattctcctgcctcagcctcccgagtagctgggattacaggtgcacgccaccacgcctggctaattttttgtattttcagtagaaccgaggtctcaccgtgttagccaggctagtctcgaactcctgacctcaggtgatctgcccgccttggcctcccaaagtgctgggattgcaggcatgagccactgtgcctggccaattttttttatttttaaataagaagctgttgatcaaaaagggttgtagtttgtatagattttcagttgctacctcctccaagttgagcattcactgaaattttgagttgagagttcctacttagagctccagattacttgaaaagtctgtgtctctaacaaattccaccactaggaccaagatgtttggaggggaatgtagtagtttgctgtattgagaactgtattcatatgtatgtatgtattcatatgtattcatatgatatgtatatcatattgccttaacccaaagctgatactttcccagggttagagtaaggcttagagttttagcatttcaacacaaggagaaatactcaaatcttctgtgtcttatcagcctcaatattcctctattggctatttactgggcagaagttatgtgaagatttttgttttttttttgagacagagtctcactttgttgcccaggctggagtgtagtggctcgatctcggctcactgcaacctctgcctcctgggttcaagtgattctcatgcctcagcctcccaagtagctgggattacaggcatgtgccactttgcctggctatttttgtatttttagtagagatacggttttgccatgttggccaggctggtctcgaactgtcttcaagtgatccacccacctcggcctctcaaagtgctgggattacagtcgtgagccaccgcgcctggctatgtgaagattttgaggcacgctgatcctacacaagcaggtagccctttcagcactccagctcttctctgacattaggttacactcaacttctctggcacctctcctgtgcagccaactgaatgttttgaggtttctcctttcttattcttcctttgaaagaacccaaacagctcatcttctggtataaatttgaaaacatttttgctgaatattatatatcataacatcattaactttcactcctagcctaaaggaattacttcaagggaatatagagaaatagcttactgatcctcaaggcttttgcatcattaatactgaattttagtttagggttattaaaaagtatttaagggaagctctggggagacatgctttttggcctgtggccaaaaaaaaaaaaaaggtaagtagaggaggtataggtgtgagtccctactacacctgctaagctaagctaattcctgcttagcttagttttaagaatttataggggtaaagaaaaagagaatatatcaggtgaatcctttagtggtaaatttggctgacatgaaaatttattgctaaaggattaagtataggccctgattgatgaagcacagtcagtaaatcatctcttcattccccagttcttaagccaacatcagcaacactgagagaacattagattaaaggcaggtatagaagagagacttagggtaacaagttagtgggtgcctgaaggcatgtgggaagagatgtggtaaaggtgtgcacactattccttacgtgacttaaaatgtcaaggggcttggtgtggtggctcatgactataaaactagagcactttggaaggccaaagctggaggatagcttgaggtcagaagttcaaggccaacttgggcaatatagcaagactgtgtctctaccaaaaaaaaaaaaaattaagaaaaaattttaattttttaattaattaaatatctccaggtgtggtggtatgctcctgtagtcccaactacttgggaggcagaggaggatctcttgagcccaggagtttgaggctacagtgagctgtgattacaccactgcactccatcctggatgacagagtgagaccctgtctcaaaaaaaataactaaaagtaaaatataaactatcaagggcctatcatatgttcagaaagtggtaggaaagtttgtattaatctttctatgcttactgtctatcacagggcttgacaaactgtagtgcttgtttttataaataaagttttattggaacacagccatggccttactttacatgttgtttatgaccactttcatgctacaatggcagaattcaatagttttaatagagattagatggtttgccagtttaccagcttaaaacatttactgtcttgtcctttaagaaaaagtttgccaaactccgttctagcatcatatgtagaatatagtaagctattaataaacacttagttggggtgtagtggcttatacctgtaatcccagcactttgggaggctgaggcaggagaatcttttgaggccaggagtttgagaccaagctgggcagatgctgtctccaccaaaaaataaaaatattagctcagcatggtggtgtgtgcctgtagtcccagctacgcggcaggttgaggcgggaggatcgtgtgagctggggatgtcaaggcttaagtcatcagtaacctaactgccaaagcaaacaaagtacttttcaagtctttttctctactcttgacattattactccttccctgaagcaccttctctccttgatgtccaaccactcctcagtgttgttcatgggtgtgtcttcctttctccacccattaaatgctgatgttctccagtagctcagtcttcagctctcatcttactctataccagggaattttaacttgaagtacaaatattatgtgaacctccagaaagtatgcttatgtgcatttttctggggagaagggactagagttttcattatattctgaaacaggccagagattctaaagggcgaagggaaaatcttctctgtattttcccttggagatctaattccattaccaatgctttaactaccacctttcacacggatatatgacttacatctgtgtctgcagaccacacttattctgaactctagacttacacctacttaacaaatggatataattaactgatgacttcagccagagaagtctcagtggtgagttgagaaccaaaaccagattaggatggactgagaagtgaataggaagtaagaaagtggaaatattgaatgttgattgttcttttcagtagtgtaactgtaaggggaaggagaaaaaaagcaatagtaggaaaggacagtcagcagaaggatttttagaaagtggccagctggtgatgaggaagaggttgagaaattagataatcatcaaacaaggtccctggaaggatgaaatgaaaagcatttttcaagagattggctctgagattggaggagactgggtgagaacagatactggatctgtcttgttcctcactgtatttctagcacctagcataatatttgacacataatatgtgtgtcctcatgagtttaaagcttggattagagagaggaaggaaggtgaaggtgtagtgtgcttgataagaatgaggaaaggagagggagtcttgaggatatgggtggtagtttttaataattattgtggggtatgagagggagaacaggccaaatacagttttaaggagggattacagacccattgacttacattaagcatggtttctgcccgtgagtaacctttttcggtaggtaatgtacatgtaaaaagctccatactaatgttagttgtttcagtgaaaagtagcagtatgtgatataaaacttgaggagagagataaaccacttcaaactgacagaattgaggattgccacttaaaatgggaagtatgtggataaaggatttaagggtttgcctggccaacagatgaaactctgtctctactaaaaatacaaaaattggccgggcgtggtggtgtgtgcccatagtcccagctatttaggaggctgaggcaagagaattgcttgaacccatgaggcggaggttgcagtgagccggggtcatgccactgcactacagcctgggtgacagagcaggaccccatctcaaacaaacaaaagatttagggtttggaaatggattggaaaagggatgccctttaaggaagagcacaaaccaaaagcttggtttggaaaatgttgtttatctgcatccagctggcagtttcctgccactacatcaaattgcagctcttcaagggtttcgtttgtacatttttacattttcattgcttttccaactgtaggatttatgaccagaggaaaattgatgagaatgagaacaatggagtactcaagaagttctgtcctcatcacctggtaagattcatgaagggccagttgctgcaggcttccctgactcaaccccaaggctgcacctgaacttgttggtatggtgggaagagcttggactttcaagtcagtcatctggatttgaatcctggctttaccacttaccagctttgtgatcttggcagtcacttcacttctgatagcctcagttttttaatcgacaaaatagaaataaaaataactgccttgcaccttgatggtgaggcctaatgagacagtgtacataaaatggctagcacatggatgacaaccaaaagaaagccccaagatgctaccccctgaggtggtcatgtttcatcagttgtactcttgtctctgtctgtctttctcaaatctctgggagaagatataggggagtttgaaggaaaagctgtttcctgaagatggtataacaaatgggggggtggggcatcagtcagtatctgctccttattgcaggtgaacagtgagtccaaagcaaacatcacctgtcttgtgtacagccacgacggcacaggtacgtgagcagggcccagctcctaggctggcatgccccctctgtctagggagctgctgagccagtgaggcatgtgccctccagtgctcaccactgtgctatagctccaagtagagcagctggggagtaactgctgatggtgagcacatagcgggaggatacagtagatgacccttggagatgccaggtaccatttgcagaatgctgcagatgatatttggcagggcctgtcctgaagcccaggttgcttgcctgagcaggttcttatgcctttgactcattcctgagttaatgggtatgacctttttgagcattctgctgcccctgggttggcagtgtgttcttagtctaccctgtacagtcggacttgcctggtgttccaaataagatgggtgctacacctgggtatttggagggggcactactggcaagaagccccaccccaacccccacctcctggtccctgcttttttcagcctttgccttcactgctatgttcttgttcttggcagagctcctggccagttacaatgatgaagacatttacctcttcaactcctctcacagtgatggggcccagtatgttaagagatacaagggccacagaaataatgccacaggtgagactgtcttcctaggtttctttggcccaagcctgttggctttggagaaccacagtgtcttactcaggttatacaaatagaaactacctgcctgtgttgccatgggcactgagggattatcctgaattgggctggagttttcatgttttctccgctatgctagaggagaaagcgctcaagagcatctcttgccactccaataatgttgcttctaattggtttggacataaggaggctagactaactgtttttaagatttcaggcaacttcaaaagaagcacaaatgccttgttagggagtcagggaaagccctctttagtcagtggtcctgaattgcttaaaatagggagtgaccttatacctctaggaaggaggagtaaacaattcttttagatgaggcagaagaggaggaatggtggtagtaactagcccaagattggcctgttttgttccatgtctgtggttcccaaactttggggcacattgaaatcatctgatgtgttttgttttgtgtttatgagacaggatctcactctgttgtccaggctggagtgcaatggtgcaattatggctcactgcagccttgacctcccaggcactgcagcctcaacctcccgggctcaggtgatcttcccacttcagcctcgtgagtagctgggactacaggtgcatgcctctacacctggctaatttttgtattttttgtggagatggggtttcaccatgttgcccaagctggtctctaactcctgggctcaagtgatccgcctgcctcgacttcccaaagtgctgggcatgagccaccaatcccaatcctggtgttcttttaaaaataacagtttggccttaaccccatatattctgatttaatagggatggactgcaacttgagcactgagatttttaaaaactacccacatgattctaatgtccaggaaagttgaggaatcatttctctattgttaccactcctagcagatacctgtcatgattttgtcttggagatagcagttagaggttagttttattttttttcctgagctggtaagaagggagggaaaaatctgttcttggatctcagtacacaggcagataaaggaagggtgccagtctcatggccaatattgtactgaccatagtcattggaactcttggcttcttttactgattccggagagtggagccctgttaatggtagcaagcacagatcacttgcttctcgaggcagttgtggcatataccttcatcagtctcagatcagctgatgacccagaaatattgacaaggtaccaatgaagtccacatatcaaagataatcctaggccataagacagtgctgcctaagagtaggcagagctgggatgattcagggtgggacaggtaagagattagagaggcctgtggttacttgatagggtataaacttgagagactaaggctgctgctaaaggactgcagattcctctgccctaaggagcgagctctttgggagaatataaatcatctcttgggactggtgtgattcctataactatctgttaaacatgcataatctagctgatttagagtttgtgaataactaaattccctttgagatgaatgtatataggcctgatgccaaccctcatgtggtttcttccctcatttatcatttcagtaaaaggcgtcaatttctatggccccaagagtgagtttgtggtgagcggtagtgactgtgggcacatcttcctctgggagaaatcatcctgccagattattcagttcatggagggggacaagggaggcgtggtgagtatggtgtgctgagctggctggctccctaatctctccagtcattaaggtaggttttagcagggacactgaattctcactgtgactacatgataccatgttttagaggtccagccagccataaaagactagttagcctggaggtgctgagtttttgatggagtattttcttcctgttcctatcttctgtccctgtaaagcacagtttattgagacaagaaagggatcttagggaagaacctctgtcctgtcctgagtgatgtaacttatctctagacgtgcaccttttccaaatgaaaaagcgttagtgttcagggcgtaccctcctacacaaggctaaagatttctccatgtctcttccctttaaactaaactaagtagtgatcttggctggatcttagattagcagataaaagctataaagagcattttttggacagttgggaaaattagaatatggtttatacattagataacatggtattcaatattaaattgatttgattacttagaatattcttgtacttaagagatacatgttgaagtatttaggggtgaaatgtcatgcgtacattcaaatagataacaaacacatatacatgtgtacatataaggagaacgcaaatgtggcaattgttttttagtagctgagcagtctgcttgctgtataacccatgatcgtatcatagtctgcctggcctttgagttctgcagccctctgtggagttagggcaaaaaggaagagtgagaatcgagttagggaatgaagagcaatcagctcttaagatgtatctggttaaccttatctttttttttttttttttttttttgagacctagaattaggaaggagttcaatcgctttctgttacaaggtttttggaccacaggagatgggaaaaacacagtttggaagactaaattatactgattgcccagaatagtctggttatccaaggcctctaaggaatgactgagacagctaagtctctcttcctttttattccttcttagctgtggggaacttcaaagagcctagccatctcttgatgaggttttttcagagagtggttttagaatttagaatggttctttgcaatcaggatcccattccttatgtttttcttgccctggtgaaagggtatttcaaattttcttctggtttcctctaaatttcagggacctgggacctgcatagatctagggtttttatggtttgaatacaaatggagaggagtctagaagttcaaggtgtgtctcactcttccctgcttcatttccaactcttccataggtccccctgtgtcatctgcagtgaacaaacccaaaacacttgagtcttaatgggaattatgcaataggcatttagagaaaggaagtcagaaggggccagtgaattttttcttgacataagctattgccttgcattctgttccagagagatgcagggctgaatgccctctcccaggccagcatttgtccattctccaaaagcattctgcaggccagtttgcttttagctcagccaatgccagggtttgatgattaacccatttgcccaggtgaggaaggcatctacttgggatgggtgggccccaggcctaagttttagtggtcctaagagtaaatgagtagaataagagatatagaggctacccctgaagcaaatttccttacatattcttgtctctgtgtaagctgaatgatcgatgtggtcttttacttggctccctctgctctgttttttggtcctaattttccagcagtgggggttaccaggcactactttcaatgtagtagactcagcagttctatatcatgcaaattgtaaatgtagagtagaatgtaattgtaacgtagaatgttagaaccaaagatcttagaagttattttctgccttgcccagatctcctgactgatttgaggatcttttctttgttcccattcagcttcacagggacaagggttgggggtggtatcagaggacagccccttagtctcccaagagcactttgatgcttgatcccattctctacattcccccagcccagtcatctaaggccagagctcttttctctgctcaggcattattgacaggataagtcctggcattcagacaggtctggtgaagtgaccaggtactctggcccagaagttctctgtcggctccccccgcaggctccaattcaggtactgtatgttattctcttgttcctcttgccactggctttttccttagtcttaagttccaaggaattgttcccctgtgtttttttattttcctgacttattcaagcagagctagctcagagtacaggtctgtaacaagggcttattaggagatagatgaaaaagtgcaggtttgtatatgtaagttgtccattactatagatagatactattccaggcattggactttaactgcactgcctaaaagagcccaaagataaacttcacaataggctgatatgtggaatgggaggaggagataaagaacggggtttctgttttattcataagctcagtcttagcttcagtcttttctgagcatttgtttatttgtaagatggaagtcaaagtaagtgggaagtctgtaggtcagctctattttccatgcctgcccttgacttctcctcagctgttctctgcctgtgcaggtgaggcagcggaggtggttggtccagagagaactaaaagaagttgttttcttggactataggtccagctgcaaggcagggtgcctttcctatgtgttcctcttttcactaaaagactcaaaatgctttagcagctagatctggaactaactcttctggatggggtaggaacttccctgcccttcccttagggaagctcatgtttccaagtcagacagcagggggcattgggtgcctttcggacagaaggaagctgcctaagctagaaggcctgcctgctggagtttatttcttttgccttgttcagtgaatttacccagagggtggctgagattgaggctttgggagccccaagaagctgcttggttttaatgtgctgccttatagctgagcctgttgtgctcagggcaagtagtaggatgttccccctgggatgtgcaaggttctctcaagcagacatgagcctccatcactcccaccactccctgcaactcagcctcctcttctcagcctgtgccttcctccagttctagtaaacactgccaaatgaatatagttctccgactcttctctgggggttcattggcagctgctgctttcttcattttttaaaatttatttgccacttggtgaaagccactgagatggttttttccagccttgggcaagttggagctttggaatctggagtgaatgaggtcatctggatttcattgtcttcttacgaagccagcagtaagcttgggcagtccactcacccacccctagggccatatctggggatgaagccacccccgacctatacataggaaatgattgatgtgcctggtcttatacccagtctgtgtctggtttctctaccctcagtgccctttggcttaggctcaggatgggtgggcctcccttccccagcagctgcctcagccctgatcaagggcagttatttggctcaaggtgagtagtggtttttaaaccctactcccacacactgctgagtctgtgttttcctttcttcctgaccaggtaaactgtcttgagccccaccctcacctgcctgtgctggcaaccagtggcctagaccatgatgtgaagatctgggcacccacagctgaagcttccactgagctgacagggttaaaagatgtaagtggctgactgcagaagttattttctttctgcttatccacatactgttgattcttattgtcatagggaggaataacttgctgcccagttctttaaaggcactgctctaacaccctcccccacattcctgtaatttcctctgtaggaatagtcctgctccagggggcagctgtgaagtggcactaatttgtaataggatggggataaggagcatctttaagaattattctgtattaaagcctgctaccttttcagcagctgaacctagggcatcatttcctaatctaatgtagctccacttcaacttaagggaagcttttattgggataggagatcagccttcttgatcaggtcccgggttcctcttcattgctgccccctcttcccaacctttttgggttccaggtgattaagaagaacaagcgggagcgggatgaagatagcttgcaccaaactgacctgtttgatagtcacatgctgtggttccttatgcatcacctgagacagagacgccatcaccgggtaagctagggttggaaatgaattcccaagggagtgacccttttaagagggctaaaaagttccagagtagtgacttcaagcagtaatcaggtgatcttggtcggatttcctatccactgtcctctgtccccatcagatccctgatatagccttggaagagacatcagcagaaaagggtggtatctacttttgtccattgccgtccatgtgtaatgctatcttcataaaggcaaaagctggagggtggaggagggaattgagaagaaataacaagtctcagtgtgacccttctatttttcctcttatgccaaaagaggcctagttcaggggttggcaaactggcagttggcctgctgctggtttttgtaaataaagtttcattggcttgcagccatacccattctgtgtattgtctgtggcggccttcacgctacaatgagttgaatagttgcaataaagaccatatagaccacaagtctaaagtatttactctctggccctttaagaaaaattctgctgatctctggcctaaagcatctaaattctggctaagacctaacaggcttgtccttgttccatccagggaagttactaacaagcctttcccatccacagcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctctatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 100 - DNA, 4401 bp, Homo sapiens
acctctcaagcagccagcgcctgcctgaatctgttctgccccctccccacccatttcaccaccaccatgacaccgggcacccagtctcctttcttcctgctgctgctcctcacagtgcttacaggtgaggggcacgaggtggggagtgggctgccctgcttaggtggtcttcgtggtctttctgtgggttttgctccctggcagatggcaccatgaagttaaggtaagaattgcagacagaggctgccctgtctgtgccagaaggagggagaggctaaggacaggctgagaagagttgcccccaaccctgagagtgggtaccaggggcaagcaaatgtcctgtagagaagtctagggggaagagagtagggagagggaaggcttaagaggggaagaaatgcaggggccatgagccaaggcctatgggcagagagaaggaggctgctgcagggaaggaggcggccaacccaggggttactgaggctgcccactccccagtcctcctggtattatttctctggtggccagagcttatattttcttcttgctcttatttttccttcataaagacccaaccctatgactttaacttcttacagctaccacagcccctaaacccgcaacagttgttacgggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgccccccaagcccacggtgtcacctcggccccggacaccaggccggccccgggctccacccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcacccccagcccacggtgtcacctcggccccggacaccaggcgggccccgggctccaccccggccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatggtgagtatcggcctttccttccccatgctcccctgaagcagccatcagaactgtccacaccctttgcatcaagcctgagtcctttccctctcaccccagtttttgcagatttataaacaagggggttttctgggcctctccaatattaagttcaggtacagttctgggtgtggacccagtgtggtggttggagggtgggtggtggtcatgaccgtagggagggactggtgcacttaaggttgggggaagagtgctgagccagagctgggacccgtggctgaagtgcccatttccctgtgaccaggccaggatctgtggtggtacaattgactctggccttccgagaaggtaccatcaatgtccacgacgtggagacacagttcaatcagtataaaacggaagcagcctctcgatataacctgacgatctcagacgtcagcggtgaggctacttccctggctgcagcccagcaccatgccggggcccctctccttccagtgtctgggtccccgctctttccttagtgctggcagcgggaggggcgcctcctctgggagactgccctgaccactgcttttccttttagtgagtgatgtgccatttcctttctctgcccagtctggggctggggtgccaggctggggcatcgcgctgctggtgctggtctgtgttctggttgcgctggccattgtctatctcattgccttggtgagtgcagtccctggccctgatcagagccccccggtagaaggcactccatggcctgccataacctcctatctccccaggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtgagattgggccccacaggccaggggaagcagagggtttggctgggcaaggattctgaagggggtacttggaaaacccaaagagcttggaagaggtgagaagtggcgtgaagtgagcaggggagggcctggcaaggatgaggggcagaggtcagaggagttttgggggacaggcctgggaggagactatggaagaaaggggccctcaagagggagtggccccactgccagaattcctaaaagatcattggccgtccacattcatgctggctggcgctggctgaactggtgccaccgtggcagttttgttttgttttgcttttttgcacccagaggcaaaatgggtggagcactatgcccaggggagcccttcccgaggagtcccaggggtgagcctctgtgcccctaatcatctcctaggaatggagggtagaccgagaaaggctggcatagggggaggtttcccaggtagaagaagaagtgtcagcagaccaggtgagcgtgggtgccagtggggttcttgggagcttcaaggaagcaaggaacgctccctccttcctctcctggtctttctctatgggacctagtaaataattactgcagccacctgaggctggaaaaccactccaggtgggggaggagagagtttagttttcttgctcctattttcctcctcctggagacctccctctctcggctttacaaagacacagatacaccccgccccccaaaacacacacacacacacacacacacctccttaggctggaacagcagagaatggagggacaagggggctgattagagccaagaagagggagtgaaggagagcagagggaggagggcagccctgtttacagtcacctggctggtggggtggcaggtgctctctctgaattaaccctttgagagctggccaggactctggactgattaccccagcctggggtggcatccaggggctctaggaggtaccttttgctcctcaccctggatctcttttccttccacccaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaa

SEQ ID NO: 101 - DNA, 462379 bp, Homo sapiens
gaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagtaagtgactatttttttttcctcctccgattctttcccccctcccccattcccttctccccttatttagattaaaatccctcctcccccgatctcccgagaggggcaaaagcaacaaccagcaaacaaacccaaaaccccaatcggctgcacggaaaacagctggaagaggagcgaaggaaatcgacgcgtcgtgttctgtgtgtgtgcgtgtgtgtgtgtgtgtgtgtgtatgtgtgtacatacaaccgtccccggctccaggctcccgggccgacacccccactctgggcgcaggggcggccggcgggggggctgtcaggggctgggtgggcgcccgccgggctagggggcgcgcccgggcggggggcgcgggcggggagagcggcggcggcgccccgctcccccggctgctggtccggtcgcaagtgcggagagccatgtcctcctccctccgggtggcgcaggggggaggcggcggctggggttggggggtggtccctttcccggccgccctcttcccattcctcctccccggagagggcggtgagagagagggggtctcacggagggctggacttctccgcgggtggtcgcccggcctcggcgccctggggcgggggtctcccctcggagggccggcctcgccgggtgtgcggctgcgggcggggaagggactgctcctgcagccgggacgggactttgcgcgcggccgggtgccgggcggggggcgcagaggggtggcctcggggaccgcgcgggggtagcgggtgtgcgggtgcctggagcgcggctggagtggcggtgacggccctggccgccgccgccaccgccgccctgttggtgcggccgcttcctgatcatgtgcagcggcagccgccgcccggagccgggagcccgcgagcgccccagtccgggccggcgcccccgccagcacccgcggcaggagacgaggagccgcggcaggcgctgccctgagccgggagtgaacggctgcgcggctgctgggagggtgaatgaagccaggaggaggggaaggaggaggaggcggcggccgccgcggaggaggcgctgcggggattgggatgcgccctggagccccactgctcgttcactctgggccgggccggagactctgccactcccgggggcgccgccgcctcctcctacgtggttccagtgctgcgcgcaggccggtcccgcagggggcagggaagggggccggacgggcggagcgagaggtgaggcggtgtcggagcgcggcgtgagtgtgagtgagtgtgtgagtgactgtgtgtgtgtatttgtgcgcgcgcgcgccgggcggggggcgagggccgtcgcgacgcggagggggcccttccttggctacttggctgactctgcagcgccccgacccctcttcagccccccgccttcaggctgccttcttaaactccgtggcttgtgctttcattttgtttcagaccacgtagggggctgactgaaagggatgaaacaattcaggttttctagggagattgagcaagaaccttagtgggggtggaagtagggtggtgatcgagactctgccagaaaacaaaacaaaacaaaaaaaaatccgtttctaaggacggcggggattcggttcgagcccgtggctgctctgttttgttttgctttcttggtatataatcctacagataaaagggtaatataaatatttgagaagagggaaattgctgaagagtagtaagggcaaaaaaaaaaaaaaaaaaaaaaaaaaaacagtcggaagaagctggttatataatgcgcgatgtggctaacaagaaaggcaagctatttttattttgtttaccgtatgctgtgcagtagggactcctccaaactggttctgtccccgaagagattcttagcttccctgcgagatccacaggatacaattagcaaaattagaagaccctattacacccacagaataaaaactaatgccttacagtggctttctccctgcacatcctgtcgtgcatgcacgggaatgtgtgtatgcaaataagttctcctttggcaatctagtagtcacatctcaatgacatttgtgttttataatgcaggctgtttttaatatttaaacatcattgttatatattgcacacagcagtgggtagttacttggttatttttaggcacagctagttactttttcaacagtgttagctgagacatttctgtttgggttttttaggaggctgcagttcctagaagccccccttaagcccacccttcggtttatttgatgggtaaaggtagtttgatacttgagctttttttggagtgaagcttatgtctgaggaaaccaccagagagaagagaaaatcctgcacaggaactcttggaaagggattgcaccataacggctagcgctgtggcatttaatctcctctgattgccctctcactgtgcatgcatcagtcaatattttagcagctccgcaaataaatggacttgaatgccatcttctacataaagcagaggttgaagggctcccctgaacctcctggctgcctgtcagtggtgtaggttttcggtgcacttactccagtcctgatcactcatgtaattagatcaggctgccatggcaacagacagtgttcctcgtccattcaggtgggtttgtcttgtgcctgaactactccaagtgttttatgcacagcatttatgctgcccaagccagacgagagactccactatttcaattgcatcttctttcagtcatttggatgggagacactgaatgaggcttctagctactcaacttttataaaggagaccaacaagctgttcttcctaggtgcagtatgtaaatgcatctccccagacagtgaaaggagcctgacaatcctgctggtgtttattgtgaacagatcaacaagtatttggtacttgttagaaacctttcagagctcactaaagcaacatttcttttgcagtctggtgcctttggccttgcagtcagtcacttaaccctttcaagtgtgaagagcgttcatcatttggaacctccattgcccatagcgatggctggatttctaaagggtttactcaggggaataacttattcggaaaatatattcccattgtcacattttaaaacttgacagccatcataacaaaaactggtactgacagtaggcagacattctgaatgtattcattcttaatttggatctattggctgtgatttgaatgatctttggtagtaagttaaaaggatttttttttccttagctaagcgagaaacgatagaggcctatagctagaggactgatagtgcatggtgcttttggacaataaacatgtactttattttaggatgtaatttagtgagcagttagaaagcagtattctagtctttgcattagggcaccactgataaagctggctaagcaaagagaaataatattatggcaaaaaggaaaaaaggaaaagttgctttagttgctgaagctctgtgctgctcaggcaatccaactaagtggggcagggggcgggcgggggggagtattttcataaccctggtatttgaaagaaaagataattgagaattatgtcttgatttagttgtgactgccagtcagtttacaattttatggccaacaaagctaaactggtaaattttttcccccagggctaggattgagagagctactcaactctattcccagggggtttatgagtttttaccgttttgtgagtttatgtggttggtaaattcattgtggcctggtcagatgaagcactgctgtagttaaaatgagctattatttcttctagctactcaacttttataaggtggtaaatagatgggaagcaaggatgtcaatattacacaatgccttggaggtcctggattctattttgcaacatatagaaaaatgctttacttgcagtaaaatgtgaacatatatttttcagtgcacaaataaattcatgtgaaaataagtataaaaaaatgtacctggtgggaaccgccaaaggcaatatttttccttgcggatttcgttttaagagggtttggtaaacagaagtgacactttgtcaaaaatgttacgactagacttcaggacttctgaattgtcttttacacttagaggaagattaaacagaaactctttagccacaagattacatgtcaaatgcctgtaagtttcaacatacctaagtcagttgcctaggagtcctgggaaaggccagtgctgagattattgaaatattagtaaacattactatgactcctgtttttgttgtcattatggagtccaaggacgcacatttctttgaataatgttgtgcctttattgtttttcattctgaaatgtcaagtggattttacttttttgcacataccttgagtgacagtttctgatgactaacactaacactcattttgtttcctattaaaagttaagcaataaacatattttactaaaattctgaaactcacgtaagtaggtaaatgtgggagtgaatgttaattctttaaactgtagttatctgaaaataacacatagattaggatctgaacagcttaaatacttgcatcggtaaagtgacaatagtgaagtaagacaggctattatttttaggggagagatagattatttgactttccttgctctgtattttcagagtaattcaatagttcgaatgattagtttctgtgagagatttagatctgtgcagcttaattgcttcaaataacagatttagttctggtcatacttccaaggttatcagaagcaggccctccttattttgataaaagcattgaaagcaatacattgtagaaatggtaatagaaataataatttctgttttaggaccttacatatagaacttccttttctaagataagaattttaagtcatcaattatgttcacattttattttcatgtaatttagtttaataaaataaatgtactcattcaaaatttttttaagaagtgatatacagtgtcagttttacagaattttttaaatgttggctgaaagaacggtaattacattgagatttttaaaaatatataaatgcttaaaattacagaagtaataaaaagaatggttttagacaaatcttatggaaagttttttattttattcttttataattatatttatggatatttgtctttattagtgtagtaatatattttataacgctcataatttgaactttcaggctaatgtactataaatatttgtattacgcattactaccatcccaaatgtaccaaaacacgtttagagagaacaattatggacaaaaaagcaacaagcattatattttgtttgacatatttcatgttagcagaaatgtttcattgatttttctgtaacttttaatgcatcccatttgtggagtaatgaaaatgtaatgataattgccacaatgtaagcaaaaattgtatcctacctgaaaattactttccagaaaattcatggtagtgtactcagaatttgagactcaagagggcagaggtttccccgattgtgatgttttgatttgggctaagaggaactctttttttttttttttacacttaggtgccctttaacatgacaagttttgaatgagttaggtagcagaagtttttcgtgacagttattgtagctactaacctatagcatctatccttctaacgttcaaagaaaatatatttttctgtcactgtgtatggcaaactttattttcttgtgcccttaattttgttcccctttctcacattatctcctggtacttactgaccattacctcagttttgtttaggccgtctttcttgttaatcttccaatattaatagtattgtattatgttgctctgctgggttttaaaaatattgagtattccatttttggtgtatattattgtataaaatgtcctataaattattttctggtatattattttgtaagtttttgcagtgaatacgtgctgccttgcttgtattcttgccttcttccctctgatggaatacaagttatgtaaactctctgtattatcctaactagtgcagcaacacaaatacttttgaaataagaaagcatactcatgcaagagtaaagtaatcttctatggcatttacatcatgtttgaccctcctctgcacttcagcaaactaggaggaggttgtaacttggactctataaaaccttatctgccaggtgatatgtaaacaggattgtgtgcacacacattgtcatataggcaaacactctcccaactggtgagctcataaaaagcactgtctgtaaatttatggtacctgcacctcatttgagaatcaagtattttgatgcttaatttgagatgacatcatgatcctccctccctgcttcctcatccttaaagaagtactaagattaaatagaattttgtcaacttctacttaacttggccattatttatatttgtaactcaacaggcttcttggtggagggactgtgccttctaaagatctgaaagaccttatagtgtataacagcttaccttccttctctgtacgcacagatcacatgtggggaaaccaaggactacaagaattccttcttttgcatatcagtcctcggcaggcaatcaatgcttaaataaatgcttggtgaatggattagttagaagtaagaacattttggctactgttcattactttgaaaagtgctggaaagaagtggaagttattttcctttccagctgggctgtgctcttaaaaatagtgagtgtgtatggatgaaaataatcatgagtaccgagatgtgttgccatgtacccaaggataattggctcacttacctgtttacggattattcacattggagatcatattcatagctccagaatagtttctttctgacatccaatataaacctgggcctccttcttcctactgttacctggcgtgagcttaggaaacccaaactaagtttaaaatcagcctaagcaaatgtgcagatcagctccagtaatcaaagactgaaaatcagtccagcattcactagtttggggatgattttatagtaaccctgctactgattttaaaaaaatttttttttctgtttaatgtggataattggtaattaccggtatttaagaatataattttaatggatagggctaaaaaaatacgttagcagatcgagtcctcaacttcttccgtttctatgcataggttttacctcacaaaaactactacaagcaccaagctccctgatggaaaggtatatggaagattcattcattctttctttcattcatccattcacacattcactcattcatcatacaatggaaaatttttacttaaccatgtgcaaggaattgtggcaaaatgaaaatgagatgtacattcagtatttaaataaagtttagtggaaagtttagtgaatataaatgcacactttacactttttttctgcattttttcctttcttctattccattggactggtatgctaatagctgtgcactttcatcattgtgtttcaagttgcatgttgatagataatatatgccacattaaaattaggctttggctcaattactattcaatccatgcccattttcacctgatactccttgtagttaccagcatgtgtttatcagatgattggctagaatcattggagaaaagaatgacagcggctggctcaaatggggagaccatcctcttaatttgatggaagggatgacctttttgtatgttggcctccctctgagccttgttgagtaaaaccagacctgccttttgagctggctgggatctgtgtaattctcatacaacagaatgccgaatgtgatgttcttaaaatttgtatttcggtgcatagacacttaaggtggacttattttttaaagcagtctattctgtttttcattttggatttcctctcctgcactccctcgaccattgcaggagcatcgtgcatcaagtcaccagggtggtccattcaagctgcagatttgtttgtcatccttgtacagcaatctcctcctccactgccactacagggaagtgcatcacatgtcaggtgagagttttgcgatgctctctgttttccatctgaggataaagtcctgacctggaaaattgcctcctagccatgctcccttactttgttggctgttgaatatcattttctttgcaaactctgtttgggcatagtgtgggaagttgagaaattgccaagattgttttttaaaacttcgattaaagtatctatctatttggtttaatctatatgttcatgaagactttcatttgactttgcgatgattgataattgccaattggggcttgaacctcatcattttaattgtcagttttccttaatacaattaagaatgctatgctaccagatatcttaagtcacagtttttgcattttagattactgttgtagtataatatgtgcgtagcaaaacagagacctatttgtttaggggaaccagtatttgttgaatcttgaatttctttgtgtctgtttggattttacaacttcctgattttcccacgtacagtaagtttttctggcctggagagtcatgcagacatagggtgtatgcaatggtgatgactcatggttctctattgaagaaagggccagaggatattgcctcaaattaaatcaggaaggaaaaagaggtttgctagaacttggggcagtaagggcttgggaacacaagggtttgagtgtatgtaaccaagggagattgtgaaatagaaaataggggatcaatttctatttgccttggaaatggacctgcttgaaactgtgaagacagactagattagaggttcccaagcctggctaggcaacagaatcacctggagagcttaaaaaaatagaatttggagctccaccctagacttgatgaatcagaatgtttcctgctggaatcattgatctgtctaggcactgatgctccacaggtttgggaacccctgggtcggccggtcttccagcaactcttcctaagttatgttctgtagacttagttggtgagaagctcattctacttttagcaaatctcccatttgaaaatttgaattttcaaaactcatttttcaagaggtagatggatatttgctttataacaggttcatttaaacaataattgaccagatttctttgaagaaagagctgcctctttaccgtaagagccaatttttaagttacatataaattctctggcatcttagataagagcatggagctccgtaatcaacccatctggacttaagatctggagctgccactatgaccttgagtagtcctatgtcctttcaatgcctcagtttattcatgtataagatggaggtaatattagaactttcttatagggctgctgtgaggatggactggagtaaaatagtagatatactgtgggtagaatagtacctggtgtatggtttgtatcttttaacagatgctatcaagtaacttatccctcaacaggttgattgttatggtcatgttttatgatggttgctcctgaaccatacatgactagaaatatgtaaatatacctggaccttggtctttggacccaccctgtagacatctacggctctgcaaagccaaggagccttttatttgtttttgctgaattttaaattctgaatttatcacaactctctgactgatgggatgcatgtgtggtttttttttttttagattgttgtaaaatgaactgatgaattgcatgcataaatgtggttatttgtggtctgagtaaaaataaacaaaaacctgagtgactgaagtattatgcctcaggaaaaacagccaaaaaagtcccagtgggggacaaggtggaggagggaagagtcatcacagacacgatactcttgtaaaatatggaactggattccttacattttattggctgtggattagagaggtgttctttaagtggaaatgtaacctaaagttacatgcaaaggtaagcctcttaagatctacaagtgtcagctgaatgaaaaaggtagggtgggccaggcacagtggctcatgcctttaatcccagcactttgggaggctgaggtgggtgaatcacttgaggtcaggagtttgagaccagcctggccaacatgatgaaatcctgtctctactaaaaatataaaaattagccaggcattgtggcaggttcctgtaatcccagctacttgggacactgaggcaggagaatcgcttgaatcctggaggcagaggttgcagtgagcccaggtctcgccactgcactccagcctgggcgacagagtgagactccatctcaaaaaaaaaaaaaaaaaagagaggaaagaaaagaaaaaggtagagtgtcttactgctactttatctcttagggatgatactcattttaacggttatgtgctaggctgaaaatcctcacatttagatctttggggaaatagtttaattgcaaatgggttgagtacacgtgcattttttttaacctgtggtgttgaaagggagtcatttgtgataacagaaatatctcaagaattttattgtgaaaaaacaggcagcaaaaagtcatatctcttggtcaatatgggcagcttattgagaagagacctaggtttttataatatgttaggcaagtttaagtgtcttatgaatactaaaatactgacgaagtagcgcaaagtcaccttgaattttaagcgctgacattttctatgattgcatttaaagaaagcttataagcattatctaaacattttgcatcaataatggcctcattacagtcctcacgattgacggctcaacgtaggcagaaaaatagtatcattcatgttgtactcttttatattcattcagtttttttcttaaacctacattatagttctttctggttctagttattttataaatatgatacagctatagcaagttatgacctaacttgttcacagtcactatttatgtaaagaaatgattcattcatttattcattgtgaatttttttaaaactactgcatggtgctgtgggaatggaagtgaataagagctaccggaaggcagttattttcttcctggtcaggcaggggaaagaagaaactctctgaaataatgaatacgaatagaatggggttctaacagtgttctaacagtgaaggaattcagaagagtgacgctgagtaggagtgatcaggaaagactttgaggaggagggatcacttgagttgagctctgctgactagattgcatttctgtgggaagagatggatggagcatgaggaaggccatgtgtgtgtctgggacataacaagccaatgcacggtatgtaactgaccaggacattttgactgaagcctaggtgctggtggacatctgaatttctggattcgagcagacagtagagagtatgggaataaaactgccgagaggtcaagtctgaagataaatttggaggagtccttggcataaaagtgatctttgaaattgggttcttgggcctggcaaaaagtttgacacccaggagggggatgactgaattcagggatgacgtcagctggtgtagaatgtgtagagagaaggtaagaggcagcggagagtagcttcaacattgatgtggcatggccttcgtctgccttcttttcatgatctggggtgaaggaggctgggtggctggaggagttgggtgatgtatgcgtgggccataaggactcttctgcagctcaggcaccttggaaactcagtgctgaactacagttcaatgaaatcttgtcaaaacctctcttcctttaagacctttaaaaaaataggaacttgagctaattttagctaaatctaatgtgtgtgtgtataaaaatgaatgctgcgtttgaaattcagcgtatgcggtatctcgttaaacaaatgatccttctattttcctctaaacagttttattaagattttcagtgaagccctgtacgttttaacaacaattccagcatttctttgatcttttctaccgttgatttattcatctcacatgatatgcgtaaatcacaatgtgccatctacttgactctgtagcaattgttcatttgtggcaattcatttactgtactttgataaaccacattaatttgggtgtgttttgtaactttagaggattccctggaggctttctgcagactctttaaaatgtgagatgtgtgtgtttttgtgcgtgcgtgtatactgtatatacctagctactagacacagctctttgaacaatttggcttcccatttatactttatagaaaataaagagatatagaattggtgaatcttgggtctggggagaaagttagtctaagacttcctgatgtaaagtgaaagagaaggctggagatgatgttacgatgatgttagtgagcagtctgatttaatgtaatgagagaaaatttgaggattaagttgtggtttttttttttggtgctgagttagttaggatgggctctctgtgtagcccaaaagggctcagaataaaagcagtgacttatttaactttcatcaaagacaagaaggttaagacaggaacaagagggatggagcaaacaactccaggggcagatcgttcttgtctgcaattatttaatgagcatctaatgtatgagacgcattatgccaacaaggccctctagggaatatggagatgatcaatagttcacatttactattctgcatattaacttattgaatcctcattacagtcctttgaggtaggcatcattattttctccattgcacaggcgaggaaactgtggcacagagagggtgaataatttccccaaggtttcccagctgttaagtgatagaatcgtgcttggatcccagtctacactctcagccctgttccttaagccctgtccttaagaagcttacagtcgagtgcataaggcaaggcatggcttggagtaatatttaaagagccatgacacaggtaacacagtctaggaagtcaggatcaaggaagggtccttccttggagccttctcttttgatgcctgcctgtctgttcagtcacatatgagctttctgacacaggctgtcccatgcaggctttgtggtgttttctccctttctttcactcttactcatatctccttgagattcctatgcactttcaataattattaattgaagaaaatgatgacagtggcaatttgcttatccgtttcaggggattggcttaagttggatccaaatgttattcagcatcaagagtctcagcgagatgatgaacttttgactcttaaaagaacttcactgggtcattgctcagcttgcaagatttggcagatatgaactatttgtctctccagtgtgataggtggtggtgtggcgctgaacgcaagctctaagaataaaacgtgcagcaaaaggaggtcacgctttagtcagggtggccataaggaagcttagaactcacatcccctctgcccctgcctcgcccagtctcattttctctccttcactagaacagtgaatgaatctgagctcattcatgtcaagatgatagagaagaaagatcactttctcttagctggcttagggaaggccagattgtctttcttacactgagtgaaaaattactgaggacttttgttttttttttttttggtcttcaaggcaacatctcttgcttttacagacccacggaaatcgagaagaggatgcaagatttactattcgtgccctagcctggcagcttcagcctacatcacagctgtaatcatatgtgatgcatttttatttacagattagtaggctctgactctgacatatgactaaccgggaagctcctccctgtaacagttgtatgtcgtctgcttcagagaactaattgcttggcaattcccctttggtaattccctctttattttctgatgagttacttaacagcgatgggcttgttgagcagagcgtggagtttaatgtgtgctccagaaactccactgtaggcctgggggatatgtttttcgagttctgtttagctttactgaaggaacagtgaaaccattatatggcctgttaatatttcactcaataccagattaaacaccgagcagcgtgcagttttccaaaagaaatcaaaaccaggcttctttttaaaatgtgcccctgtgcattagaaaattattaaaaaggaatttaatatgtatagaatgtttaatgatcttttgaaaatatggtttcaaatggagtagtcttccaggaccctacagagtgagtatggtgtgctgttggactggtagtttggaggctcagtttctgttgcctgccctgcaacaggatgacttgtgctactcactgtaccttgctgggtctcagttttcctgtctccaaaacacaaggaggttgaaagaaatgatctctcgggactcttctatctctgacattgtacagttccatgaatagattttattgtaattcttgctcccggctcccccaagacctttgcttctgtcaaacatcatttgctgttgtttgactttgttagattttgtatttaattagaatttatattttagctattattatgtcattatttatagagtaagtcataagcggtgcctaaattcatttatcaccccatctatattagtttcatacctgaatacttcctccgctcctttttactgttcttgctaccatgtcccaaacaacatccatttctggaggtggaatgcagtataactggaaagaatctttcagctgattgtgggattattttttgcaagaggagtgcagaagctctgcttttctaagcagtaatatcaagggccatattctgcttttaatttgcaagtagaaatcgttttgatgtcatttggttttacctgcaggtgcaggttttagtctctaggtaattccttttctcttctgcgtcaactttcccaattagtgtgtgcagcattgccttgtctttttggttaattcataagcagttcatacagatgcctcttgattcattgcaattattaatagtttctttaggcagctagtgcaaatagaaaaggtgacatttgagagggtttgttgttttaatttatttgtttcatagacagagagggagggtgaaaatgaaggctttaaagtcagggagattgaggcttgaatccttctggctctggctcctggctttgtggtccaggtcacattccttaaatctgtgatcctcaatttcctcatctgttgaatggggatgataatatcacctaactcacagaatcactggaaagattaaatgtgcactcactctctagatgttgcttatggtagtatctcaataactaataaaaacagacacacacacacacacacacacacacacacacacacacacggaaggcatagcatttaagagctgaataaaaaaagcaagaacaaaggaaagtgctgcatttgaggtatagtcagggtaggaggagcttctcagagcagccagttttagtaggcagagtttgaatctcaaaaggacctttgaaatttgggaaggactaagcaccctccactaacctgtcagtgacgttttctgcaggtagctcttgggaaggactaagcaccctccactaacctggcagtgacgttttccgcaggtagctctgctctacagaaaagagtgtttactacacatgactgataaaaataccatgtttttaaacatgtattgcccaaaccttacaataataaaggaaagccaataaaagcaaaagttccctttgattccaccattccagtccataaatcaagttcatttttatgtgttgttttttagttcttgatgatgtaacttatatctttttttcagttttgtgtttcccatttagcataaacattcttagtaacttcagctatacagttctcatttgcaaggatcacataacattctatcaggttgttttatcttaatttttaagtttcctatcatttttggacattcgagttgtttctaattgtttactgttgtaaagccgcagcgaatgtctttgcacacaagtatttaccgaggacacactcacatcagaaggctcaatactaagttagagggagcttgctctgaattgctttctaaaaggctgtaccaatttacattgttactaatgatataagaatgtctctagcttcaatcttaataattgtgggacttactattttttggctaatttaataggctctttggttttaaagttttcattcctttgatccctctcagagatggaacatttccatctgtgtttatttactaattgttctttttacaattagcaaatggaagtcttgatgttttctaatctatgtatatgagctctttatatgttctagatattaatccatttaaaaagtcctatttgctacagctacttccctagtccagtgtcctttcatttcagtgatgatgctttttgttgtacaacggttcaagtttttatatgatcagcctctcttttcttctacttgtacccagggccaacctggcaggaataaatgagattaccgcagctcaaattctgcaccaggctggcgagtggtccactggatggctttgctgggaatagctctttctttcttctgctcacttttccccttgggaactgtttcctgttgaagtcccagtctttctatttccaagggcccctttccccttctcccacctgcccctcactccttgattctcacccaccctgtgccggtttcctggctgtggcatcctctctgcccagttctcaaccctccgttgctgacctgtgtgtttctcagggagccctgtcctgggagcagtgggtagaaacatgtctggcagcctccctgactagggcctagagagatcagtcaggaatctcaggcctggccaaagtctaaccattatccaagtctctggggtcggggtctttacaacttctgtcttacatttctgctacgtagcaggctgccctgctaaggaatgggctccttggcgctggttttcatccatgtaggaaccagagaggcacgatgctaccctgattcctttcctgttgtagctcttctccggggatagctcttccagtggaaggttgggaacaacttcctagggattgaattttttgaggaaggctggtctcaaagtgtgagttttagctgagtggctctgctgagctggggtggtttggcatatgatatacctcctaaatggcctgtctagatgtattgttgttctggtccaacatgtttttcctctttgaagccaaaatgaacatttgttagtatttgaaatctgctgacatctctgtttttcttaactccctccctgggttctcatggtcctcaggataaagtctagaatccttagcctggctccataggttttgaggaccttccttatctctccagcctcatcactcacatgttgccctgtattcgtcccacgtcggtcccatcgcacttcctccttcaagtgccatactctgttttttgctccagcctttagacatgttgttcttcctccttagaacccagctcctctctctgcactgtctggctacctttccctcattcttgaaatctcagcttagagtctcttcctcacgaagcccttggactagggactatgttatttgctaccttttctgggttcccatagcaccccattcttccccttgtataatacttcacaacccctttcctggcccagcgataggagggactgccctctttccagtatgtggcatctagtgaatgggcaatacatacgggcattccccctgtgatgcttatgttacaaattggatgtgattccatctattaatatggactgtgatgtatataattgtggtgtgtataattgtggtcaggaaccagcatggggtcctgtgaaccacagtggtggaaaaagctatggcacctgtttgttccactggctttgtgctttgtccatcacacagtgagtgaaaaggtgacaaaaatgtgtaagaagcctgtgctaaggagaaagaaaggtccaatgatgaattttctggaaagaaagctgtacgtaatagagtgctgaattcgctcaatcatatttaagttttatagtactgcacttataaccacacaaaacactattattattgaaattcaatacaggaaaaatgcttttgtttttgaacgtctaagactgtcttcctcctcattgaaaaaattcctactgaatttcgattatatgaagatttttagaaatgcagctattgcatcgaatgaataaatgaatttgaggttcacgttcttaacatctgttttctgactttgatcagtctcctttaagtgctctcgtggtcatactctgcaactcaggtgaaagtttctagtgagatagttatcccaaggagatacttttatctggaagagagtagttctgaagttctaagtgaggttggttggttagatttaggttaaggtaccacatggaaaggagaactgcttaaaggggtagggtgaccatgaaaccttcttctgcaaaccctgctcgtcaagtatgaaaccggtggggtaggaggtccatctaatcttatctgtgcccttttgagttggccggccgggtgaccatccatctcctctgggttgtaaatgacttcatctcgaagttgcactgttggtggtaggtgaggacgccttctccaggtggagggagtgcatttgtggttgatggtgtgagcgaccatatgttggaccatatgtcagaacctgttaagagattctgacaggtatggaaatgcctcccattggaaactgaagccctgggtcctttgaccgctgcagcacccccagaggagagtaccctaaggcccttttaaccttgccctgccctggcaggttccaaggggaggcagaaatgactctggatgaattttgttttgattattcttccccttttccaggctctgtgtccagttcacctctggagctgcctgggtcactgcaacccagactagagagaagtatgaccccaagttgtggcttttattgggagacagccttcatctaaggaagtgggaaagaatgtgttccccagctgctgcctttctggtgtctgatctgatacttttcaaaagatagcagttttgtttggtttgatttggattttttttttcttttgtaagtggtcatagacccataagacaagtttattattgtattgacagaagaaaaaaatgccatggttatttatttaaaaatctctttccatacaactttgctttctattgagtttgaaggaaatatggtgatggcatctaagcccaaatttcggtgttttattttggctttcctgttctgtttaagcctctgtaaccccttgaacctttctctactcttcagaaggaacaagttatattttttttccatctcaacatcgtccaaatgaaccgtactattttaacaatctgtgtaaacagatataaaaggaggaagactactttctttaattttcctcccagcgagctgcaaagctgtttcagtcatcctagtgattagcagaatgtgagtaataaacaacattaaaatgaagaaacgtctttctgagtaggaccttgaaatgtgggtctcaccagtagtatatgagccttcctcagactaaactccatgacacagttcatatcatctttaagtcctggagggagggttttttaatatgtgtaaatgaccaaacacagctgttggctgtcctgctgtacagagaacattcggtgacctgaaatcgcaaagtttctgtctctgaagggtgcacttaatttaactttttgccctgaagtctcaagaaatgagacttcctttaaaaaaagtgttcttaaaactttctcattttaaatgtccagggtcttcaaagagtatactgggaggaaagtcctgtgtttcctgtttctcttgtaggactagtcaaaagtaccctttctcttgatggtattctgcagtctgagcctctgatttagtaactacagcctttaaaaccacagttatccagaccatgtgcagtggttaatgtgtcatgagtctgcctcagctgataatagcacatcacagaattcagagtgccttagataaattgtttcagtggatagtcataatgactgcttgagtagaaaagtaccctcattttctaggggagaaaacagaacctacgaggttgactgatttactagattccagtggttagaaatacatgtagcctgtgctgtaaacctgattttctgacttgtagttcagctctcttctccatctccttgtacagccaagataccccagaaattatttgcgtttccgaagttgtaggatgaaaagacatgtctttgcttaactgagttagccccctagaacaatattgagatggagctggaatggtgaagaaatgcaagagtccaatcccttgggtatgtgcaattcccagttaccccttgaaacagtgcttcattataaatttagatgttagaggctgggcatggtggctcatgcctcgaatcccagtgctttgggaggccaaggcggtgggatcgcctgaggctaggagttcaagaccagcctgggccacagagtgagaccctgtctctaaaaaaaataaataaataaataaaaaattatatgttagatgtttttatagtgccggagcctaaacttgatggataaacagagaatgattttcattttgcagccactgcacctttaaagttgagctttttgaggtgtatttcctttaatgcacccatgacagcaaggttgaaaacatcaggaaatcaaattgatctcatatatggaatcttgaaatttaatgtcatctgctctgagaagtccttgtggatgggaagattgtacaatcagatcatttctctgtgtaggtatctgctgtctttctactagatgttacagaagagattagaagaagctcttccagccacctgtgaatcagctttattctgctaggcaagaaggagctggtgctggacatttgtatctgcaaaaaccatgagttacttccccaataattaagtatctactgttacaacatctagtggctaatcttttagtaaaatacactgtccatctcttggtgccagaagcaataactattatgaagccttttctttctttgcagaagtagtttgctggtgaccatattgttagttgcagaaatactcagaatctgattcacatttagacttgacagaagccagattttatatctggaaacctcattagtgaaactgcaaacaagacaaaggccatctatctctctcttaggtgccctcctcaatctctttacagcttttcccccaggagtcaaggagatacagcctggcagggacttttgcttggtgatggagtagctaagaatgtttctctctaacaggtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttctgaaacagattaccttttttcttctcctcatgatggctccctgagttgcttccaattgttgaaattccataattacccacaaatatggatgtgcccttctaagggtcttgccatgtcaaccagcccagctgaaagctaatagccagtgttagcggtttaaggaactgagcttcagaattgagagcccccagcaaaggaagttctgtttttattctccatttctactctcctcaaggagaaattaggtgtttattgttttgttttgttttttaaattcccagatcattctggcattggtcctggattcgctgcaaatgtaatttttagcaacatctattactcctgaaatattttggctcttcgtggcctgtatgattcagtagactctgaggttttccaagtacattaaggacttaaatacagaatgtcttaaaattttagggctattgatcaagagaaagcttctcgaggaataaagttctgttaggttttagccctattctgctttcaaaattcttaactggatgccgtctattttgttttctttctgtgtttataactaatttgctacttgggtttattgttttcttacttagaaactacttttttttttgttttgtaaatgcacagcacttaaaaatataaaacagttccaaacagttccaacctgttcattgtttataccttgaccatcttttctgtcttattgctgaaccatcgcttctctttctacttctcttctgggatttcatcttgctcagctaaaattctagtgtgttattctgaatattatggctggagtttcctgaccaacttcttgcatctgagtccatttcctgtgcttaaggctgctggcattccattcactgctcctagtcaaaactgaaacttctcctgctaatgagattaggccttacaacactattaatttcttcctctctatttcttgctccattgttatttctcagagatgaaaatctatttgtcattatgagattcattttggcatcacttactaaagttcccttggatttttctgttcttcatacaccctacagcttcaaactgcaacagtcatcaactggtctttgacaaattagttgtctctacacatggtttacaatattacactagctgtttaaaaataattaagcttctttctgtgttctttgctgtgggtcaggaactttacttcctttgccatgcaacacagaagttaatcacaaatgggtcctctgaaccaaataattaaaaatagagcaaagtttctgaaccaggcggttggcagaaacgtctgtacttccatctgtgcatggttaggaaaatatttcacgatatttaaatagcatcagctttgctctcttttgtgtgagagtgtgtctgtgtgtctatgcgtaattcattgctttgaaggtttgtttgactgttagataatcatataaaaaaagttactggcaaggaaacaggaaagcaaatccaggtgttttgtgcatacattctttatttaccagtctctgtgaaggagcaatgatcttgcttttgcttttctctctgactgaaagtttttgccttgttatgtgctgcagaaaactaaataacattgcattttgactttgaaatctttatgtctcttgattttccacttacaaataacctttgctaatggctttggggagctgttcgtatgtacccgaaatgctgatgaatctatttcagtttgaagtgtggcagattaggaatttctgctctctggaaaggggatttatacctggaatatgcatcaaattcacaaacactttgcgatatacgtgcagacacatgagtgactggttttgacaggaatttaatccttcaattggatttccctttgttcttgtgagtaatcagtatctcataaaatatattcagttttggctaattgtacagctatgatacaactttaagtttctaagatgtaaattactatgtgatataaagataattcccctctagcatttttcttttgtaacagcctctttttactcctgaaaagctctttattttaaggttgatttcattctactaggagaactgttgtgttagataacaactaatgcccaataaatacactgaagggagattaggaactgttaaagaaagaacacaaagcaaatgccttaatttcgttctttcagaacgtatatatttcccaaagttgtcagttcctttatgtttctaaaaacttaccaggtaggcatattcttaatactttgataataaaattaaacactgaaatcaaagctgtagattgaacatgctcacattaagtgaaattaaggagagaggaatacatttcattattaatgtatcagtgaattctggagtttagccatgaatatcagctataatcaataacagtttgagtatttaggcagtttgtaattcatgaaatttaaatcagaagggtctttaaacatctttttgtctaatctcattttgcattcaatttaattctattttttctcagcctactatatgcagagtactatgctagcagggaaaaataatgcggaataagttgtggcccatggtttcaaacagattaatctttgattactctttgatgctttttttgtattatttgagggacagtttttttttcttttttgagatggagtctcgcactgttgcctgggctggagtgcaatggcacgatctcagctcactgcaaccttttaaaaagagttaagtggatcttcctaatgattattctttgtcaatgtaagatattaggacttaatgtattttgtgaactctgagtacacctacaggtgagtggtagatatcttcatactttaaattactgctggattttgtctgtaccccgagacagaattttggtcttctcttatatatagcagttaatattaatgaggcttccctgaaagggttcctggatattcagattcttcacacttttcttataaaccattagatttgtttcctccattcatttgggcatcttctagtgacacacggagtggctcttaaaaaagtggaacttgattgctgatagttttattcaataaatcattgttaataaatatttatttgcgatcagaaacacaaggagggagtgtacacactcagaaaagcccacaatgcagggagcctgttcttctaacaataataatggctggctggcatattgaggatttaggatgtgtcagtcactgtactaatcacttaatcctcacagtaaacctacataggtcattattatctccaccttacagatgaggtaaccgggttagtagcttgcccaaggtcacagagctagtaagtggtgggactgggcttcatgcatgccattttaaccttagaccctgtgcttttaactaattatactctattgcctaccacctgtgtcattgtagaacttgcaaaattatgttcaaaaattgtttttactaaatataaaataaaatacagtaaaatagaaatacaaaagtatattcacaaaataaatgtaaattataaaaaataagggttcagtgaacactcctttaactctacacccatattttaaaattaccatcaactggatgtcctctatgtggacctccccaatcttgtcacattcttcccacctcagaaggaaccactatagaaacatgacgttttaaaatatttttaagactaggcacggtggctcacgtctgtaatcccagcactttgagaggccaaggcaggtggattatttgaggtccatagttcgagaccagcctgaccaacatggtaaaatcctgtctttactaaaatacaaaaattagcacacgcctgtggtccccgctactcaggaggctgaggcaggagaattgcttgaacctgggaggtcgaggctgcagtgagctgagattgcaccactacactccagcctgagcgacagagtgagactccatctcaaaaaagtatacatatatttttcacgaaagtacacaaaaatgcacaccagccagatcactgtttgttttctctcctttttctcttcttttttccctactttttcatctctcatccttcttccttcttttctcgcaccatcatggagaacaaagaagaactgggtcagaacaaacctttaaaaagtgaaggcgagcgttccttgcggggatgcccagtgtcatgactagtgttgggaattcttggtgagatgacaatatttttgcctcactcaaatgaggcatgcccttccaagtaaagcatgctatgttttgtagcaaacagaacacctgagaaggatgatttcatatgactgtgccaacagatctctcacaagcttgtcaggttataattcacaaatcttaactctatagtctatagacattttttttttatatggggtctcactctgtcggttgcctaggctggagtgcagtggtgagatcttggctcactgcaatctccgcctcttgggttcaagcgattctcctgcgtcagcctccggagtggctggggtttcaccatgttggccaggctggttttgaactcctgaccacaagaaatccacctaccttggcctcccaaagtgctgagattacaggcatgagccactccacccagccagtggttctttttcatttgagatggagttttgctcttgttgcccaggctggagtgcaatggcacgatcttggctcactgtaacctctccctcccggattcaagtgattctcctgcctcagcctcccaagtagctgggattacaggcatatgccaccacacccagctaattttgtatttttagtcaagatggggtttctccatgttggtcaagctggtcttgaactcccgacctcggcctcccaaagtaccgggattataggtgtgaaccaccatgcctggcctgtttcttttttttttccaagaggtcagttctcagtctgttgtccgaactggagtgcagtggcatgatcacagctttactgcagccttgaacccttgggctcaagtgatcctcctacctcagcctcccgattagctgggactgccgctgtgcaccaccacacccaactaatttttaaaatttttttgtagagacagggtcttgctatgttgccaaagcttgtctcgaactcttggcctcaagccatcctcccgcctcggcctcccaaagtgttgggattacagacatgagctgccgtgcctggctgacttgtggttcttaatagtgtggctcttaaaatagcaaacatttttgggaaccaatgtgagggcacttcataacacaatcaaaaaccattaagtggaatatgttaagataatgtaaccttgttgttgtcccttaatgctttaatgcaggctttcagcaagtagtaatacctggtatggtgggtgtaaaactcagaatgggtcccggcatggcaggaataagagaattctttcatcggttggaaaatatgtttgaataattcactacatttaaaaaataggtaaagaggcttttggttttggttgcaaattgcactcatccatggaagtttttcaagggccatacaattctgtagatggaggtggcaatttaatgcagtcttagctgtttaggatttagaactatgttacttttaatttacttccatgaaattacaaaaacatgtaatgaagctaaaaagatttcaaaagaagcacatctagtcaaacataaaagtacttaataagggcatacatgtagaagtatattagtctttgcacatatttacatatgtatgttttggttgcttaatatttttcaagtgctgcatgcatttgtatgtgtaaatacagtgtgcaccctttatagaactagtgttgggggactcttttatcagctattatgatttggagctttatcaaatggagtgatttttttttgtgtgtgtgtgagatggagtctcactctgttacccagacttgagtggagtggtgccatctcggcttattgcaacctctgcctcctgagttcaagcaattctcctgcctcagcctccaaagtagctggaattacaggcacccattagcacgcctggttaatttttgtattttcagtagagacggggtttcaccatgttggccaggctggtctcaaactcctgacctcaagtgatccacctgcctcggcctcctaaagtgctgggattacaggcgtgagccaccacacccggccggagtgatattttccaatggtcatgattctggcctgtaacaccaagcagtataacgatgagattgaagtgtgaccatgtgcgtctgcctatttttatgttctatctcatctttttgcttggagaaaaattatgttgaaagactacagtgtgcctataaagcttcaaatatgaaaaaagagctacatatgacactttgttgcagttagtccattgtctcaaaaacatgctataaaaatatgacaactagaaaagtcttggcaaatgtagcatgagtgttgccggtttaaaagccgtgtttgagtactctaaagtacttttctgtgacagctattactataggaattggcaccagctaagaaaatttacagtttaatactttagagcaaataattgcttagggtgctttaaatagcacaggaaatgtgtagagtgtttacttgacatttgctatattgaacactaatactgaaacagattctttgaccacagagaatgccagtgtaggaggggtgggggtaggtgggagaaagaggcggagaaggaaacggcaatacaattagataaaaattaaatgacaaatgtactttttcatgatacagagatatcatggggaaaaatgcccatttgtttgatcaagtaatcttctagtgtggtagcagaaagcaaagtacagacaacttcctgggattaggttcctcctgctaaaggctgtcttcaccagaaggtcaaagccttgcagcccttggtcgctctggtttatttttcaagctcctgaaagcaagaggaatgacctccgtttttattaaaaaaaaaaaaaaaaaaaaaaaaaaaaagaaaagaaaaaaaaagcctctctcgttatctgtctaatctgcacatgcttgtgatttttttttatgacgactctgatgccctcatttctcattgcagctcagtgcttgtgatgtttttttcccctgaatgcatcttgcactcccagaatcttcttttcattcttccctggctctgttaatacgggtcttatcttagaacggggtctagtgcagtttagtgtagctcttacatgcagagcattttttttttgcacaaactgcttctcgtggattgtgattcagttgcacttaaagggaaaaatagagtatattttaggctactaaacctccttccatttgtaggcatttgagccagttatacagtgtctttcagggagttttacatgcatatgttaataaccagtggcacctgtgataggtccaggaatgtgaaattgtgcaacgttaatgacatttgtccaagcttcttccttctatcttgtcaatatgagctacttttaaatacacaaaggaattttgaaaacaccaatcaaaagtcaaaatttcaccctgcagcatggcccggcacccagaacactcagcaagaggaaggtctgtatttatggcttttccactgacttgaaatttgacctggaataaatcatgtttaacttctttatgcttcaattagcttttgaaagatatgtgtggttgtgtttagccagtggaaaggcaataactgaagttcacaacgaaaggagaacttgaagggaaattttgttaggaaagaacagtgggcaagaatacaatcttcaggcagggtgctattcctaaaaagtcttggtacacatggttcctaaggaaggtgggacattttcttataatattctttctgtattttgtagaattaagaaatatattattgtacataaatattttatattacattatatatgtataaatacatttatatatatatatatatatacatactgttttaccctttaactccagaaagctttgcgttcacacatctttttccctaacttctacctataaagggatttttagtgataatcttgaatttaaattgtaatcaagcagtaacaaacttcatttaatatgcagacatctaattttataaaggaaattccaagttattgttcatttccatttattaatttatttattttgggacggagcctcactcactctgttgcccaggctggggtgcaatggcacaatctcacgtcactgtaatgtccatctcccgggttcaggtgattctcctgccccagcctcctgagtagctgtacaggcgtgcaccaccatgcccgactaatttttgtatttttagtagagattgggtttcaccgtgttggtcaggctggtcttgaactcctgacctcaagtgatctgcctgcctcagcctcccaaattgctgggattacaggcgtgcgccatcgcgcttggccaatttttgaagtttctttttttaatctgttgccatctctgagatgagaggtttttcattcatttggggaaaaaggaagaaaggtaatcaacatttattgagcacctactgtgtgccaaacagactgctaagcacttagtccttaagtaccctacgtgactgatgttcagagggccattttctctgtgtcaggaatcaggtgggagggccagaatccatagaacaaaaatataaccgttgcaatagataattaaaaagagggaccttttagttagtggcacccaaagcatcatagtgtgggctgtgagatctcagtaaaccagttgttggtaggttcccccaactcagagacctccatgagggttggatggctggattgcaacatggtgctaaaccacatctccctggttaagccatttcagttattgcctcatttaagttgcattgctgtaaaagacataggtatgacaagttgcaatgcctaaaattcgaacgaaagaatacaggctttgaatgttattcagagcttgactccggagtcccagatgcagtttcagggtgagtaaatacaaagccagcagctcccaagtttagatgagaaaacatttcaaagaaagccagcgaacgcttatatatttaacacaatatccatgactcattttctctttgctctctcagtccagccgttattcatttaccgctcaccccacaggaaagctccttttgaagtctgcctttggctactttgcaaaacatataaatatacaccttgggagaataagggtgagagagaaaaaaggcagaggtcataatttttaatcctggttctgccaataacaaactttgtgaccagatactttgtacagtaaaggaggatgtttttaaaacccattctcagttgccagagaggcaggcagtcatcattctgtaggaagacttgtttcaggatttctcagatgtctgctgtgtttggattgctgaggtccctaaagaaccttccctttgagtcagctcgactaggcttttggaagtagccctggaggtgtgatagcaccttaaaaattcttagtaactaggaataaatagaaggagaatgggaaggaatagaagctgggtgacggggaagggaatgccaagctgtcctgcagctgggatccacacttggtgaaggttgtgcctgcgtccctcatctgtggttgggtataccagaattttgatatctctctagttcgaataccagccttgacatttaccaccttggccaagtccctgaacctatctgtgcctcagtttcttcatctgaagagtggggattatagtcaatgtaaggactaagaaaatcaatatacgtaatacccctagtattcacacttcacctgctatgatgatattaccattctcctttggagttttctaacttatttgtgtagcatttagggcaaaataccaggcatatgggtgatggcgtgtagtggagttggtgagagggagaccttgagttgtagaaagggtgggcagaacctggtttctgtcctacatcccagatgttgcccatacatatcctgtttgtttctgaccaccctgctttgctgtgagggttcccagcccctctgcctttacctgtcctcattctgccccactgtccatgcccagcatgaatctccacttctccgggacggaaagttttccccagctgcttcagcccaaaccaacttccctccccactgccctgtgcgcacagcttatttgatcatgtcatttattgcttcattttgtggcttagatgtcttgcgtcccagtcagactccatgtgactggaggcctttgcctcctttcagctccagggtagtgtggcagaaagagcaaggagcagggagggaagggacctgctctcttctccagccctttctctgtgataaactcagcatgctccaggcgtttaatctctgtaatcctcacagcctcctcatgcaaaatgagggtctagaccaagtgacctctacagctgcccttgcagcttccccattttagagtagtagatggtgaataagtatggcccgaatgaatgaacaaatgtgcagtctcaagttggtcagttgtggcttaaattatttttgtgcccactggcatctcggcttggtaaatggaggaaacggtctctgacgaattttcactttcagtagacagaaattttgttaattttgatcattttatagtccgaatttgtggacacattgaattaatatttatattagtaatatgtctaagaagaaaagattttttatgctaacaaataatataaataatgtcacagactaataacagctaagagtcagtaataaaggaaatttgtttttaagcactttggaagttcctgtttgcatgcattatatgattatatatacataatttgtattacattattatataagctctcttagtctattcattaagtaatttgatgatcattttgaaatttttttataagtacttaagagagttaaaactatatttcttcttgaaacattgtaatttggacttgttttcttattcatattagatgtcttctctgagcccagttactgagtatgtagtaacttttttgtgtgttacaataattgacagagacggtggttcaaattttcagcatcaaacctcactttggaattatttatttccattttttctcttacctactagtatatatggatccaaaattaattgcttttttattatatttaatacatctatttgctttgtggttttactgatacttgaaaattgtaaacaattatgaaagattttgaactttaatcatcttaatttgcttaattaacataatttactagaggagagaaagagaaaacagacttggttacttatttatgtttgtaaccacctttgtatatgtagtaacaccagagcaggcacttcataattgaaaaggctttagggtaataagtcactgtctgtttcaaactgtgatgactttctggaaaaaatagcttttgtaatatttgtcatactggcccagatccagaaagtagtatgttcagtgtctaattgtactccatatggcctgaactcttgagcaatccatctgaagtaggaccctgttaagaaattattctttgtttttttttgagatgaagtttcgctcttgtcgcccaggctggagtgcaatggcatgatcttggctcactgcaacctccacctcccggcttcaagcgattcttctgcctcagcctcctgagtagagtagctgggattacaggcacccagctgttttttgtctttttagtagagatggagtttcaccgtgttggccaggctagtcttgaactcctgacctcaagtgatccacccgcctcggcctcccaaagtgctgggactataggtgtgagctaccgggcccggccaagaaattattctatgtcatacataattgggtgcaagaggtcttagtaatttgcattttaaaatgataattggtatcatctacgaagagaagttctaccttagtgttttagtttagcagtgacactaagatattatacatatgaaaatctcttaatgttagtgggcagaactgggaacccttccctttttttttttttttttgagacagagtcttgctctgccacccagactggagtgcagtgatgcaatcttgactcactgcagcctctgctcccccgggttccagcgattctcttgcctcagccacctgtgtagctgggattacaggcacacgccaccacgcccagctaatttttgtattttagtagagatggggttttgccatgttggccaggctggtcttgaactcctgacctcaggtgatccgcctgccttggcctcccaaagtgctgggattacaggcatgagccactgtgcccggctggaacccctccctcttacagttcacagggtataagaagctactttctagggcttcatcttaatatggtgattgagttctatattatggccaaaaggaaaattatgtgggtattgtggggaggaggagtcagagggctaggggcaaagcgggcagagaaatatcagctgcctttatttagcaaatatttaccagtcgttcctgcccatatgcacttgttccttgtgtacttggatctgaattgattaaaaaggtctgtatgtattgagtcttttcccttaggagcgcttaagctttcttttgatgctttttttctcttcctttaaaatggtgcaggaaaatgttggaataaacatagtcagcttgtgaaaggatgattctctcccttatctgggcataaatattgttgaatgtgagaatgtgggagtagctactgggccaaatatgcacaatgagtgcaagtgattattgaccttactgatgagaggaaggaagagaaatactttaaaactattttcacagggcatttcaaccaagatgtttttctaaattcggtttctgattcaaaaactggatttagctctttttcttgtttgtttcatctgaacaaatttaccctgaattgaatgggagagtgtttcttaatcccccatgtctttagcagtgagtcatttccatgttgttgagacattttctagcctttattgctgtgtgtagttcatgcttttctctggatgttttgactccttaaggaactcgcaataacaaattaacaatcacactcctctggaatgaaaacacgcagtatcggagtaataaatagcagttctcgaaacctaaataaacacagaaaactcagctctcgtacttaagaaggctctagaggagtccagtgtccaacattacaagcaagacacaccatttaaagccataggaagttaacatactttcattttaattttccaagggatcatgttataaaaccatatagccacttccattcttcaaaacttaataaacggttagttttagtcatctgacctgccttctctcaaatggatcataatttagtttaacaggtttgacattaaaataagttgtgtttctctgggaaactcatgttagcctggacttctccacttcctgtctttctctggtgaagctggtaatagtgactgagctcaggccatggcgggatcctcacagccctaagactaggtgccacctgtgtgctgcaacccagtaccaaaataacaggaaaaatctaaagttatccagataaaatatgtcaaattataaagcctctgagtcatgacagtaatcaaacctgattctatatcagcaatcaaacctgactctatatcagctttaccaaacactattaatatatcctataataaaaattaaggcgtcattcctcaggttctttagcaagtaagtcagtgcatctatctaatttgctaaggctgaaacctattgtacatagaactcgggtctgaatggttgtcccgtagaaagttttagagcagagcaaggttgtaaatagccagctccagtggctgtttttcaccctgttcatgggttgcttgccctggttgtatatttagttgcctgtgatggatggagtgaagtgcacaggtcgtctctcaggggtgaacactgggtttgattagaggccattgtcatgaaagatactccagctcttccatgaccatacatgcttagaagaaaactttgatgcacaaagaactgaaagccctaggcactggaattcctgctcatcaaaaagacacctaaaaaattcttttggagacttcatgaattttctctcgattcatactgaaggactggtgccagtaatatttttcctctttgcctgtttcagtttctcatgaagtttttccatatttagacacactgcccagttaaagggaatgccagtcactcggggtttaagacaatgaagtatgtacttccctcaccaatcagttgggagagctgattgggctgaacttccagtctgaggcatgtgagtcacacacaggcagagatttaaatgttattaacatgagaaagatcttttgaacgtgaagtcatcatgcttgaggttactttgaactttcctcatagtctcttttatgatttgtgtaagaatcaacatgctttagtcttatgttaaaaaaacacagtcgagtgaaaatggacatgaatttaaaattgcatgatagccagaaacttttcatactgtggaaatgttacactgtgataaacatttagtgaagctgcttggctcatgggctatttttttaatggcttttgggttcagaaatttcaaaatgtcagattctttgtaatttaaatttccttctaagtaaggaagtgcactatgttattaattttaaaaatatatatacttagaagttgaaattgtgtaattatcttaatgctccagagtctcttttctgactaaacattggaacttattctgttgaatgcagggaatttgtccagaaaagcttaaggaaatttagcctacgaggggaaatgcgctagattcataaataaaaggtttatccaaaggggtgatatagaacatgattttatctataaaagattgtacttgagttttgtctcttcctcctccttttaggattaagtaatgattgtagcttagtttttatagttgatttatagtaataagttatgtgtaagctgactgtgggtagttgaactcatttcaactgcagaaggatagattgttgtttaaaggatcatacaaaaattattattttttaataaaatgaaaatgtccccagagatgttacacctggaaacttaaaagtaggaaaaatgataatatagtatgttactctatctctggaaggaatgatctctcccactgaaaagtaaatagtccaaagtttacaatgtttagttgaaatagcttataaatcacggcagtgacttttaatccttagtagaattctcctttatttctgagaagtctgtataaatgtttatggaaacacagtctgaaatattttaaatgtagcataccaatagtacttaaagagaactttacgcatgatcacacacattcagagttgttgggtaaaaacaccttgtaccttctttggtagaaaatacttctgtatttgcgtgtgtgtgagagagagtgtgtgtgtgttttaaattcttaaacataacagatcttttgaagcagagcagaaaactcgcatgttactgacactgcattctcagccatggggaaagcaacagtgtgtttcagctttagcaaattacatgtgttgactcactaaagaacctgagtaactacacctcagtttttattacaggaaatattaatagtgttttgtaaagccaatagagactcaggtttgattactatcatgactcagagactttataatttgacatattttctctggataattgtagatgtttcctgttattttggattttttattatcgttatttactgtgagttttgcgctcatatacatgtagcccagaaaagcgatagtgagatggttcagtgtatggaatcagttttattgaacaaacagtggggcaggtggggggagatacttttttgtaattagactattattagtgagcacttcctttggcttttgttcatttaaatgtatcttttctttataacttcacaggacgtggaacatgtaaatgcattttgagttgaaagcagaaaatcacatttcagtaaaattaaaagctcaagatttcattttcttgtaaaatttctaatcatccccatttgctgaactttgggccctttcttggcattgggaggtcatggctaatgaatgcatctcctgttgcctggcttacagccgccccctgctgcagtgccatttgggagaagtgtgtaatgtgcgtgcttggactcgttatctcctttcatttcctcaacatcagttaatgctgcatagtttgcaacatgatattgctttgagttggtgcctaattgtgtaggctggctagaagaacgaatctttgcagtggtcaggtgaggccactgagtgtgcccctttgcggccactgcaataaggtggttgggaattcttcatttctgatcactgaacttttccagaacgtcccaaggctcccccaggaactgtattacagcatgacattctgtgtatgtgggtttttctgggagaggattgtagctttcaatcagatcctccaagaattctgtttctcaaaaggttcataggaaccatttatttagaattgaaagataggcacatcttctgaggaaaacaaatgaaaggcttaacaaaatgttaaggctgagttacagaaaacaagccataagctacctattttattcaattaaaaataaccatgacatggccattttgtaaattattacattaaatctgcattgcagacatacctggtacgtatttatttatttattttttaagaggcagggtctccctctatcaccctggctggagtgcagtggcatgatcatagctcactgcagcctcaaatacccgggctcaagcagtcctcttgttccagcctcccgaatatctagaactacaaggacgtgccaccatagctggctcattttcaaattttttgtagagacgaggtctcactatgttgcccaggctggtctcgaactccctggcctcaagcagtcctcccacctcagcctcccaaagtgctgggattataggcatgaacaaccacccccagccacttggtacatatttcaaatgtggtttgtttcttttgaaataatgaaaaggaataatgtttcagggtttgtggcatccacattttgggatggctacatgccgtaaccttgttcgtagtagctcctgatttttatctgtattagaaattgctcggcatgagacaaatgaggaacatttggggaaatgtgtgagtaattgagtaaaaactaatagctgtcttaagggaaccatcttctggtttgcatttgtattaataggtatgcagagcaggaataatttggaacgggggagctggttatcctctgggtgtgtcaagcacaaatctcagattccattacatctgcacaagtcttgacagtttgcaaaatgtgcctagaggtatgcttgataaggacagacatttcttgcctgggttctaactgtgtcactgctagcacagtatctggcctgaacagcatctaaagaaatattttgctggatgggttacctcaatgggttctcatagcagccctgtggatatagacacagcatgttttatcattcttttctacaggctcaaagagggtaattacttactcaggctcacatagctggtaggaaaaggatttaggcctctcctttataccatgctttagctcgacccaaataataaaagcaaaaaagccatgtttggatcaactgagttttaatagaagagcattggagagaggttgtaaaccctcagatattttcaaaaataatagtaagcattcttgacttgcaatgcagagaatgtcttaagctcatatgtcttgatggtgctaatcaagtcaggcttttataattgagtgaaagcacagaaaaataatttattcattcttatacaaccaagtatttattgaatgtcttttctgcaccagacatggttgtatgcactgaggacgtaacagagaacaaacaaggttgtctaagtccctgccctcagagagcttatgttctcatagtggagacaaccacaagtaaattgcataagtagactctatttgcagaccccccaaaatagagtaggatatgttaggagaaagagtgatggcaggggcgaaggggattcttttgtttggtggagtcagggaaagtcttaggggatgggcttttgtacagagactgcagtaaggtataggagccagccctggaagatgggagtggtgaagggtgagatgagaatctgaggatgagcactgtaaaggaagagaatggccaggtgaaggctctgaggccagaaggagcctttgaattgatctagaggctgcaggagcttggattttacgctaaatgtgatgggaaactctgttagttttccagggctgctctaataaattaccagaaacttggtgggttaaaacaacaggaatttgttctctcaaagttctggagggcagacgtctgaaatcaggtgtcagccgggccacactccctcccgaagctctgttgggagaacctttccttgccgctgtcatcctctggtggttccaggcgttccttggcttgtggcagcgtcactccagtctctgcctctgttttcacatggccttctcctctgtgtctgtaccaggtcctctcctgtctcttagaagaacagtggtcattggatttaggacccacccgggaaatccatgacatttatgtcaggggctggaaaaggaaggacaggtgggatgtgaccatccggagagcctatctcagctgtcatgggttgtcacaaaggccattgtgtggttaatttttatcttcttattcttgtttcctctttaatctttcattctaagccctatagccctgactggcagattcgctgtcgggtttttctagttgtagatgacatgctttttcttaaagccatcttcatttattaatctacattcgtttttaattttaatgcaccaatcaataattatttcacttgacagtttttgacagcatgctgcttgcgacatttagctgtttagcatgaattcaaaaggtgatctatcaatttgcacaaatgaaataaagttgctctttcttcctgtgctttgggggaatgtataaaaaaatgtatgtttatccttccctggagaatttttgatgtagaaatactgaatagttttctatataagaagacagaggactaaagagctttaaaatttgttgtgcttattttgcttgtatcataaattcacgtgaaaggccagatttctcttaattgcgttgatattgtggagatgaatcattcaacaaatgtttattaagtgctcattgtgtgcatggcactctgcaaatgttatgggaaataaagacagagtccccgggaaataaagacagagtccccaggaagtctagtagtcagagaaacaaagccacttcccaaattatggtgggtagaaaaacttaggaaatgacagttttatcatgctacataccttcacttaatgaatcctatgtgaaaattcccagtaaaaacctatgaacaaaagtgtgtggttgtcttcatgtatacattgtgtgcacacatctgtgcgtacaatgcacagctttgtatgaagctagctgaaaactaaacagctaggctgaacttagctgaaaactaaacagcaggggaaatgttctttctcactaaaatcacagtgttaaaactcttggcagttcagatggtctccactgtagctgttggtttacattttgataatttaccaaagagcataatatatttaattcctagttggatggtgtaactcaacacagcatttccagcgaaacgctttgcaaatgggaagtaagcattttctttggaaaccagcagcttccttactcccttggttcttctgtgggtataagcatgacctataggttagaagttctggaacagaaggagaaaaatgaattatgtcacagttaacaggaaaggaggtgctttgcattcttgctccgttgcagttagttttgttttccttccttggtttgggggcatttggccttgcatatcctggcaagatttaggcaaaacaggcactgaccttctttctggaatgctctttcattttgccccatgcatattattaagaggcataattcactgtcatatttttgtggctaaaagttttctaacttctatacactgagcctttgttttctgcttaatagggcaaaagagctggcattttctgggcatcattgacccttcactatgatttagattttttaaagaaacacataaactgttcattgcaccttgttgtgtggcaactctgccagtcactaattggtactgtggatatttggctgttgctcttatttactttcctctggtttttacatcacttaattaaatcttgtgccagtttccattctatacatgtatagggaagcaaacagaaactttgtcctgaagcaccaggttctttggcttcatcatcctaaacagctctgtgaaaatcagttgaaagtgagtagagccagaagtggcgtgtaagccatgctgtcagcgagggctggctggatctgcatacgatcgccgccttctgcccctgcttttggagactagagatggcttctggtctgtgtccagggcttgccatgctgattcagagagctatgccacagatgagcctgagttgagaccatgatgccagcatatcctcagacccacgagatcgttatgccagaatgttaatccgcagtggaaaccattactaacatactctcaaggcccacatgatgagcacattctctctctgtgttaagctgcatgggaatgtaaatcctaactggaagctactttattgatgtgccttgagaaattgctgctctctggctgcaggtatcagcagcagtcacagtgcacatgctctctaaggaagatccatatggagtcaggtgtttgcttggtgagcagggaatcggaacaagggagtgggatgagttgactgttaagtggcaccaagcaaacatagcctgcctctctgttcatctcaggagaagggtggcttttctagtgggaccaggaacatgtcagtcattgcctgctactccctacagtcatctcactagggtggccttgcctgtgaagacactgtattctccccaacaaccttggcattgcctacatagactttagtgactctgtactttcctggctaagccagccctggcgcccttttgaggacacagtcttttcttaaattcatgactatatttcatcaggtgctggctggggcaggggtagtggtgatggtagtaattatctttcttcagttggctttgtatgtccatgttctcatccactaaattttgttcttactataaaccgctaactaggcaatctcttccccgttgtcaagttcttggttggggaatggtaatctttattgtccttcttataagtccctttggaatggatagaggctttgggatggacatctcgtgaactgtatcttcatatcaagctctgtgaactgaatggcaacaaggaggcattcatccagaccaggagtaggcaaactatggtccatgggccaaatccagcctgttcttgtaaataaagttttattagcacatagctacatccaataatttgtctaatgtctatagcagtttttgcactacactggcagaatttgatttgagtcatggtgaaagagaccatagtccaagaaagcctgaaatatctactatctgatcctcatcagaaaatgtttgccaactgtagtctatacctttgcacgtcagagaattgcatcagggaagaactagaagccctccttttgcacccccacaaccctgccacaattcagtgaacaaacagaagatcagagagggaatgtgacttgaccaaagtcacacagctggttcataggaaagccaggacctgagctcagatcttccagttcctagtgtatttgtcttctacttttggaggacgttgtgagttttctggtttacagatgattaaccattacaacatactgaaagaaagcttctttagtggtcagagctattttccaaactgacttccccaggcaaaatcactagccagcttggcattgatactcatttattaatcttacaaacagtacctaccatatttcagggatggggctggggctaagacactgatgaagaagcacaatccctgcccttgggaagtttggatgagaagagtggtcagatagctagatacagagatgcatgtcattttatctgtagtgtgttacttatcatcataggactgtgatcatatggacgaaggatgcgttaatttagccttgagtgggtgggggtgttgtcaggaatggctccatagggttggagatgtttgagctctgtctcaaaggagattgagttcttcaggtagagaattgcagcagaaatggctgtggtcctctaggcttgagtgtgcatggtatccagtaatttgggaatgcttgtctaacacaactagaggtagggcttaggggacgtggtatggggttacaggaaatctagttggaaaagtaagttggagccaaactgggaaacttacggcatttcaaatgctaaggagtatggactttggcttatattctaggggttttctaatctgtagattccaaaacatatgggagaccacatttcttgtaaaagaggacctgcacattcataccaacacaaagcatggtctgtagatttggtcatcagaatcactaacagaaataggagctttcttccaaatatatgtagctggctgatattgtaagtcattagccagaattcattcacagcgttactaagttcatagtatctttttgaccattgtacatcttcttgatcaacagatattaagagttaaacatctagtgcctgaagtctgcaacatttttgattgaagaaaatgttgggaaccactgccgttgatggcagtagtcatgaaattttttgaattaacacatgttataggttccagagtcagctgccctaaattttactagctttgtgactttgagcaagttatttaacatacctcagctgtaagagtctttatctctaacgttaaaataatagcctctgtctcttaagattgttataaagatatgataatgtctgaacgcatgtagcatggggccaggctgatgggatatactcatgtttaaatagaagctattgtaatgatttttagcggatgtggcatatgcagatgtattttagatttgacccagtgtggacgatgagttcaaaagggagagttgtacgaccttcctgttatccaagtgagaaataatggggccagggtgggcaggggataggttagggaaggagaggggagagggagtatgggaaggtgtatgtccactttaggtaatgaagtgagaaatgaaagaagccacattctgtttcatgcccaaagcaacagacaaggcacaaattagagtgtagggaagccagtttctgtgacttgatggcatagaatggtgtggcttatctggcaaattccacgccccgtaactcctggaattgatctggataagaattcaccttgagtaaattttaaaaattaatttaataaattaatagccccccctttgaaacacagaaaaattagaattacagcatgagtatctttttttgctctaaaacagtacagcccagcagttcagcctacacccatcacagagctttcaaaggaatgtatacaagaaaatacatatacaattacaaattttaaaaattaagtaacatgtatatactgttaaatatttatatattgatgcttagaaaaagatgggacaaatgttaagtgtcagctgggaggtttttactttcttctttgccatttctgtatttttcaaaatgaatatgtatataattttaaaatgtgttaacactatttcaaaaggaaaacaatcacaaaaaggaatagattggaaaagcttcaggggacttgctatccttgtctttttgggtagctgttctacaaaggcgggtggtggtgggtgcctcccagctgtgtctcatttcagtcagcggatgctctgctaaatctagtgatgggcggcctacctccgaaaggtgggtgggagtgagggatgagtgtagcagtagtacatgcaaatggggccaggttttggtgtgtgtgtgtgtgtgtgtgtgtgtgtgtgtgtgtgtgtgtgtggtgtgtggttttttttttctttctttttttctacagtcttactctgtcgcccaggctggcatggagtggtgtgatcttggctcactgcaacctccgcctcctgggttcaagtgattctctgcctcaacctcccaagtagctgggactagaggtgcacaccaccacgcctggctaatttttgtatttttataaagacgagatttcacatgttggccaggctggtctcaaacttctggcctcatgtgatccacccgctttggcctcccaaagtactgggattataggcatgagttactacgcgcggccagggaccagttaagatttgacgattacattttattgaatgtttgcatcagaggcacctggaaggcttgtttagaccacagatttctgggcgccaggcccaggggttctgatttaatagttctagggtggagcctgagaatatgtatttctgacaaatccctccgtgaaactgatgctgctggccccaggaccacactttaagtgaggggtagtaagcgggtggagaactgcatggaggatgaaaagcatccagttggattttatatttgctcccccttcttcatatacacacactgaaatcactccactctatgttttctcagattctttccctgtctggaatatttggttctctcttcatgttcagtcagtagaaacaagaagtaactcttggattgagcagttttcacacaagtagcccaaatgatattgacacatcatttctacacagcatcagcttgttcacacacatacgcccccagaggccaatggcgtcctttggctttgttctcctttttaaaaattcagtgagtaagctaattttataggaatgtctcagaaagctattcctgtaaacccagcgtttgtaaattgaaatagaggaagcggtgctgattaccgcaattgtattgaaacttattcatggagcggtccctctagattcagatagtttggacagaaaccctccaactcttcccttaccactccattgtttggtaaagtttaatgtgctcacatggcatctactttttcagccagggttaatactcctagcgattctttcactggaagggatgactcagagaggaagagttggcattaattgcttcatcaactatgcttattatgagtcatctcttgcttgtcttagtaattcagctggaaaaaggagaaatgttatctctggttcctgaggccagcttgggcttcagtgaactaggatactccctcgtagccatttgtgagtttcattcagttactaagggaatgaacagattgtgaatctcattatcctagcaggtacatataaatctataaatggcgaatggcagttacttcctgatgtttatcagtgatgagatgccacaggcaggacgttagccctagaaaggcactgttttgaaggtggctgattaaggggcaaaagaaaaaaaaaaaaagcaaaaacggagggatatgttcaggtccctgcctttactcagttccctcccctagcttccaatttgattaacagaggtgtcgagggaggaagagaacaatttccaaataaaactgcctttggttctttttttgagtgtaatgtggtaactggattatttggaaacacgaatttaggtctcttactttctacttcttgcgttcagttcactcgtgtcttcctgtttggtgtataccttccccttctgactcagtcttctctatttctcttctcactgtagcagaccaccgttcttcccctgccttaggcgtttctcacttgctgtctgccttgcgtggctgttttcactcaagcatgttcactgttcctttgtacggaataggggttatccccacagaccctccaggtagaaagtacatctttcttttcactaataaattagtttattattaatagtgaaaagaaagtacatctttcttttcactaataaattagtttctatttagggagaacatacagtgaaatcaacacatcttaagcgtacagcgcaatgagttttgatgaatgcatacatccacataatcagcatcctaatcaagatatgggacatttccatcaccccagagcccctctgcccccttcctgtcaactttccacctccccgtcatcaaccactgctttgatttctgtcactgtaattgaattttgtttgttcttgagcttcatacaaatggaatcagtcagtactttttcgtatctgctttcttttgttcagcatatcatttttgagatcatctgtattgttgcaggtagcaacagttaatttaaaaaatgctagccagaggccaaggcaggcatattgcttgagtctagaagttcgagatcagcctgggcaacatggtgaaaccctgtctctattaaaaatacaaaaactaggcggcagcagtggcacgcacctgtaatcccagatactcaggaggctgaggtgggaggatcacttgagcctgggaggggtcaagcctgcagtgagtcatgatggtgccactgcacttccagcctgggcaacagaatgatgtgtcgcaaaacaaacaatctatatctatatagatatagatggtttttttttttattttgtgaacttacatatatgtgtgtatatatatatgtgtatatatatgtgtatatatatgagttctttatatagtctggatttaagtcatttatcagaaatatgaattttttctcagtgtttggcttacctttttcattttttaaactgtgtttgatgagcccctttaaattttaatgaagtctaatttatcattttttaagatatatgctttttgtgtctttataacatttttgcttaccctgtggttgctaagatgttatcctcctgttttctcctggaagatttctagtttagccttaacatttaagtatatgagccatttcaaattaagatatgaggtgtaggggtcaagattcagtttttattaaaatgtatgaaacaacaattattgaagtgattttttttccttatgaaattgccatcacacctttgtcaaaaatcatttggttttatatgtgttttaagactctctgttccactgatctgcagtctgtacttaggtcaatactatattgtcttgattaaaatactgtcatgggctgggctctatggctcttgcctgtaatcccagcaccttgggaggctgaggtgggaggatcgcttgggcccaggagtttgaggctacagtgactgcagcattgcattccatcctgggcagcagagtgagaccgtgtctctattaaaaataataataataggctgggtgtggtggctcatgcctgtaatcccagtactttgggaggccgaggcagaaagattgcttgagctcaggagtttgagaccagcctgggcagcatagcaaaaccccatctctactaaaaatacaaaaatcagctgggtgaggtggcatgtgcctgtagtcccatctactggtgaggctgaggtgggaggatcgcttgagcccaggaggttgaggctacagtgagctgtgatcatgccactgcactccggcctgggtgactgagctggaccctgtctcaaaaataataacaataaaattcaaaaataatgaataaatgttaaaattaaaaactaaatagctttatggtaaatcttgaaaacagatagcgtgagtcctctctgtcttgttttttccctcaagattattttggtggtgttctatctccttcagagttccatataaatccccctaccccccaaaaaagcctgttagaagttagttcagattgcactgaatcataagagagaaatttaaggaaaattcaccttaacaatattgaaacttcaattcaaaaacacggtatatctttctctgcctttttaatgaatttctgccaggaatgtttccctgtttttcctgcagagacattgcatatctttggtaaaatttaattgtactttatgcttttcgatataatacatgtaatttttaaatcatccttttcaaattatttatataaccaggactttttttctgatcgtacagggaaagtattaactatttcaccactatttcatcatgatgttagctgtaggtttttcatttgccttttattggattgacgaagtttccttctattctcttttttctaagaatttgtgtttgtttgtttttatcgggaatgtgtgttgaattttgtgcagttcatttttgcctctgttgagatgtcatatggttttccgctttatgtggtgaattatattgattggttttaagtgttaaaccaaacttgagttcctgggataagaaccagttataattatgtgttattttgacctattgctggatattttggctaacattttattaagtatttttgcgactatgtttattaagaacattggtctgtaattttgtttctttatataatatttactagggtttagtgttagtgttagtaatactgattatataaaatgtattcgtggagtcctcctgttttttactattttctgaaagaatttatgtaagattttctttcctcttaaaattgatgaaattccacagtgaaatctttgggcttggagttctctttgtgtgaaggttctaagtttttaaaatttaatttaaaaacattataaagtaaaatattcccttttttgatgtacaattctatgcattttaacatgtgtagagttgcataactaccaccacaatcaggatacagaacagttgtatcatcattgtgccaaggattttgatactgaattcaatttcttaacatatagccaactcttcagattttctgtttattcttgctattggtaagttatgctttctatttttcaagaagttttttatttcatccaagttgtgagatttattgacataaagtttttagtaatactttcttcttatctatttagtgtctgtaggatttatagtgatatccccttttccatttttaatgatgttttcatttacttatttttgtgattagttttgctagatgttaattaattttattaagctcttcaaagaatgaactactgtttgctttctgttcttctcattatttccttctttttccctactttggatttaattttccttcctccttcctttctctttttcttttcttttctttttttttttttgagacagagtttcgctctttcacccaggctggagttcagtggcacaatcttggctcactgcaaactctgttccctgggttcaagtgattctcctgcctcagcctcccaagtagctgggattacaggcatgcaccaccgtgcccagctaatttttgtatttttagtagagacagggtttcgccacgttggccaggctggtcttgaactcctgacctcaggtgttccacctgccttggcctcccaaagtgctaggattataggcatgagacaccgtgcctggcttgctttcctttctctatatcactgatttgaacgtcttctttttttttctgttcctaggtacacacacttttaagattgatgtatcttcctaataagtacaccctttaattattatgaaatgaccctttaactctggcaattctccttgtctagaaatctactgatctgaatatggctacaagagctgcaggctgttcagacttcagccgaggtcttgcaatgagcccttatgttttaattgcattgtacaaattttgatatatacttttattgtcacttaactcagtattttgtatttccattttatttcctctgggaattgtctagtagtaaacattttaattcacagacgtggggaatttttaagcttcccttttttccttaattgctaattacatttttatttatttatttctcttcatagttgttgctttaaatatctctgtgccattttgttagatgcatgtatgttgacgattataaaatcatctttattggttgttccttttgccagcctaggatgtccctcaccatcatttataatgcttttaaccttacattccattttgtctgatattcagagtgctatcctggtttttgtttttagttttgcttatattttcttttttaaaaatcttttagttttaatgtcattgtatatgttcattttacacgcatcattcttcccccccaccacatattgtgcatagctctgtacttgtctctgttatttgattagtgactttatacccagttatccttactgtaatcatttttattaagatttttagcttcatttaatgttttctacttggctttactttttgttttgttttgttttgctttcttcctttggatagatcggattttttttcccgaacacattttattttattcttgtagcatttatacctttatttaaacataaacttaggtataaacatagtttcctttatgtctaaaaattatcagtaatttttaagttccccaaatgactcccccactcataaccattggacctcttctctctcagtctgctattttccccagtgttccctctactgagacttaaccaccttctttcctgcaagaattccccatcacatggaaaataactctcagctgcatcaacctctagcctgtgcaacttccccaccttgcttggaaccggaaatgacttctacttttagaaagttcattctctgggcagagtagaagatagaattcattggggtgttattgagacagagagaccatctaggtactcttgaagaagtccaggagactttaggagggtccaggttagagtagtggcagtagagtgggaggactggtggaacaaccgggaggatttggtgttgtatttgaggagtttgagaaaaagagaagttgatggtgccaagtatgagtggcaaatatcagatttcttttattttttcctaccctattctcttccctcccaaattccatttgcatgacttcttaccaaggtttggttctgccattttaaatgaaataagacatgtaaaacacatggtatatgtcctagtatagaaatagtaattaaaaaaaatagatgctagcttccacatttctgtctcaagtgctgactgtatgaatggggaggaggagcctacagattcctgaggaggaacaacttctttttcttggtggcagggtggttagaaatgtaattatttcatttcttcatcttttgaatttgagctgccaatgagacatttaggtgacagaaaattgtatatctaagtctaggattgaaaagagatgatagagattcaatagctgttaggaaaactgtagaagctcgtctagcgggaggtgataaagtgaagagaagagaaatttgaaaagcatttatgggatggattggaagaaggaggatccatcagagaaagttaggaggcctgaattcttgtcccagtctggtttatttagccctgaataaagcacttaaccctctcagggtcctctttctttcttcctttttttttttttttttgagatggagtcttgctctgtcgcccaggctggagcgcaatggtgcaatctcggctccctgcaacttccgcctctgggttcaagcaattctcctgcctcagtctcctgagtagctaggattacaagtgtgcactaccacgcacggaccatttttttgtgtttttagtagagacagggtttcaccttgttggtcaggatggtcttgaactcctgacctcgtgatccacttgcctcggcctcccaaagtgctgggattacaggcataagccactgtgcccggccctctcttcctttaagatctctttctttctctctgcctctcgttctctttctccattcttcattaattcaacaaagatttcttgcatacgtattgggcgccaaattctgctctaggtattgaggctaaagcataagataggatgtggtctttgacctctagtactgggagcaggcaacagattaatcattgctctctgttaagcattatggtagggtatgtttcatacctgagtcaggttgactggaggaaagggtgctgagaaggcctgcagagcacgtccttcagtccaagcttttcagaatgaggagttgttcagacaagcttgggcaaagaaagacaaaagaagtgcaaaatagtattatatggatgggctgaaggagcaataagcagtttggtaggtccatagtgaggcaggcctgacaccgctagaggggctcagggtctcgatcaggaagggcccttgtgagccaagcagagatcttggattttatcttggatgcaatgtagacccattcaaggactgtagggatgtgaaaagtcaggtgtgtgtttcagtgatttcattctgttagtgctatgcatttggcatgataagggaccaggtggtgggcaaggagaccagagaggaagcagttgtagaaatccaggtgacagaggaatgttgaaaattccagaaccacagagcacctgcttcatgctaatcacaggtctgtgtgctgcggcttctgcagggaccaggacagacaggccccttgttctcatggagtttggagtggcaatggaagtgacagaatggaaagaatgagcagattggagagatgttaataagcaaggatttagaggacttgatgagcaattagatattggaagtgaatgagaggggggtagtgtctggtttgaggaagtgaatgggcaaatgacaccactcactgtgattggggaaccaagagaataactgagtgggaccttcagggaaaggtgcccagcctgcacttgtataaataggtctggatctcaggaacggcctccgtgacttactggatcagggaaagaattggactatgtggatgtttacgttacttgattttattctgctccatcattcagtttgggtctgtgactgttgagtcacctcacagaggacgaggtatccttatatctctttccctaaaacctagtgtggggtgagcaaaacagtagggctattgtttgaagtaggtctggaattctgtatcattaatttctttgctcaccctctgatccctgccttcactttagccctcccccaagtcccagcataggctcactacctggattttggcttctgtgtgaactgctgtgggcaatcgtgtcatattcctgtcacagagactctaggatgctccagcgggtagggattttaggatcactgggtccaatctctgcaattacagatgagagaggtgaggcctgaggaggcaagggggcctgcagagcactggtgtagggctacagtgtggtcgcttgattcactggtctgttttgcactgtgccccctccccctcgctgagtgcttagagagcagggcaggaaaagttctgcacattggtgcagacgtttggaaatgactaagcctgtgtgtgtaactttgagacttctcgtgaaggttgtcaagaagcatttgatcacttcagctctgaggtagggagacagtctccttgggcatcacacttgcattccagcagcccccttgtttggggtgctctccaaaggctccccgtaaggaattgtttcaccccgggtgtagaatcacattgcactgcggcttcaaaggaaaagtaaaaaagtgcagaaattaccgaccggagtgtgggaagtacttcttgttggtaagattttcaagtgctggggaagagatgtgttgaaaggacatttactttcatcagcttagagcatctgttttttatactttaaaaagaagcaacacctcaaattatggcagtccctgggcaagtaagcacttgagattttgatctgtacagattcttagagggagcgcctcgcaggagctgttagtagtgatttgtagcacttaactgattctgtagaccgacagtcaatcttggggggaaagggggttcagaggcaatgatagttaaggaactgctccgtaaaacagcaaataagccattgctcttgcacccgagtagaaatggaaactgtacttagcaggctctggagaccaaattagataggaaatgaaaataaattccatgttttttatttttaactcagtgcgcacctccaaaacattcgtacagtgtgggctccatgacgtgttttgcctgctctcttatacagatttaagtttttaaatggtagttagagacactcaacataaaagctgctgctttaaccgttgttgttattgctttgtttttttgagatggaatctcgctcttgttgcctgcactggagtgcagtggtgtgatctcagctcactgcaacctccaccccccaggttcaagcaattctcctggctcaggctcccgggtagctgggattacaggcgtgcgccatcacacccagctagttttgtatttttagtagagacggggtttcactatgttggccagattggtctcgaactcctgacctcaggtgatccacccgcctcggcctcccaaagtgccgggattacagtcgtgagccactgtgcccaacccactttaaccatttttaaatatgcatttcagtggcattaagtacattcaccatagatgtactatttattataggcacagtttcctaaactgagtaaagaaaggaaacatttacccccacagcccagtatagtcattgttaaaattaagatgttagtctccaagtcttttgtttacatgattttgttcaaacctagttgcaatacttttcatagaggttataaagagaaatatagagttataaaggaatttttttaaaattatactttaagttttagggtagatgtgcacaacttgcaggtttgttacatatgtatacatgtgccatgttgttgtactgcacccattaaatcgtcatttacattaggtatatctcctaatgctatccctcccccttccccccaccccacaacaggccctggggtgtggtgttccccttcctgtgcccaagtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccctggtgtgtatgtgccacattttcttaatgcagtttatcattgttggacatttgggttggttccaagtctttgctattgtgaatagtgccgcaataaacatacgtgtgcatgtgtctttatagcagcatgatttatactccttttggtatatacccagtaatgggatggctgggtcaaatggtatttctagttctagatccctgaggaatcgccacactgacttccacaatggttgaactagtttacagtcccacaaacagtgtaaaaatgttcctatgtctccacatcctctccagcacctgttgtttcctgactttttaatgattgccattctaactggtgtgagatggtatgtcattgtggttttgatttgcatttctctgatggccagtgatgatgagcattttttgtcttttggctgcataaatgtcttcttttgagaagtgtctattcatatccttcgcccactttttgatggggttgtttgtttttttcttgtaaatttgtttgagttctttgtagattctggatattagccctttgtccgatgagtagattgcaaaaattttctcccattctgtaggttgcctgttcactccgatggtagtttctttggctgtgcagaagctctttagtttaattagatcccatttgacaattttggcttttgttgccattgcttttggtgttttagacatgaagtcgttgcccatgcctatgtcctgaatggtattgcctaggttttcttctagggtttttatggttttaggtctaacatttaagtctttaatccatcttgaattaatttttgtataaggtgtaaggaaggggttcagtttcggctttctacatatggctagccagttttcccagcaccatttattaaatagggaatcctttccccatttcttgtttttgtcaggtttgtcaaagatcggatagttgtagatgtgtggcattatttctgagggctctgttctgttccattggtctatatctctgttttggtaccagtaccatgctgttttgattactgtagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttgacgatattgcttcttcctttccatgagcatggaatgttcttccatttgtttgtatcctcttttatttcgttgagcagtggtttgtagttctccttgaaggggttcttcacatcccttgtaagttggattcctaggtattttattctctttgaagcagttgtgaataggaggtcactcatgatttggctctctgtttgtctgttagtggtgtataagaatgcttgtgatttttgcacattgattttgtatcctcagactttgctgacgttgcttatcagcttaaggagatttgggctgagacaatggggttttctagatatatgatcatgtcatctgcaaacagggacaatttgacttcctcttttcctaattgaatactctttatttccttctcctgcctgattgccctggccagaacttccaacactatgttgaataggagtggtgagagagggcatccctgtcttgtgtgtaaaggaatttaaagacagcctactccttctccccttctctgccccgtttatagatgaagaagtgaatggccaaaagggttaatggcttgcttagctggacagtggccatgcttgtcccagagcataggtgctccatcgcctgagcgccattccctgggctagtctgttgttagtttcaacatgtgtcataaaaaattcattggtggtttatttttagggtaatcttcttttttcctctgtctctttctttgtgtagtttctgtatctaaacttttttaatggcatcttcaaataggaacttgttttaaaccagaacgtcacaacacgtatgccattcctagggtttatcaccctgatgccaacatcccctcccaaacctcgcttctgttcagatattaccatacccaggaggtcgctgctttttgttttttttttttccatttgttttgctggttcacggttcattccagagtttaaaggtgctaaaaccaaagtttaaaggtgatagtaattgtcccatgttgggtttttagctggtttctttttcttcttaagatctgttttccacttagaaatgaggtgaaaactcacagaagcaaagcctagcagctaaaagcagcacgtctgcttaccacgttacaccctccgggctgatctgcagcccagatcccctttccatcctctacctagctcctcaattcccatcggtgagcagttttcacctcctcctgcccacgtttggaggtctgtgggtggcggttaggaagccaaaggaggctgaagctggggtatattgtttgggtcggccatggcaaccgcggcaggaaaaggaacaggactagttttgtgctgctctgtaaatggccaggattcagcagctatctcaggacttctgcttggccccagacaatctgatctcctggtaaggttattaaacttggctctcctcttccaccctcctttgatcatgttgtcaggcagcgagtaggaatggccgtaaggggtcggctggtgggggttgcagagcacagcaagatatgcaccagcagaaacataagaacaggggcagaggcaaatcagggactgtgttcttatcttttctgcaccccagatgcagagaagtacatccccaagtccttgccaatactattcttcaagagttgagcaccttgctccaaagagcctgtccagatcgccagtttgaccagcatggaggagaacaaggaagggccggtcctggaagaccccaggatttttttaattgggaaagcattatttgagttttctctgctgcaaagcacaaactgcctaccacatgtgtttcataaaaatgtcactgaaaaggagagtgagaatacagagtaagcttccatggcttaataatagtttattttgtgacttggaatagcttttcttttcattcagcggatcattttaggtgtcattcagtttattttaagtagtgtgtttcatcctgagcggattaagaattttattttttaaaactctgtactgtgttgcttcctactgggaaatttacattaaaaaaatgttcgtgagcaaaatctatttggtcaaaaagaatggcccacgattatcactgaatttgggatgtttttcttctaagggacacagttgattcttactcagaatcatgcgagtctgacatttcatttggggaagtctgaggaagttggtgaggtcttacgttaataaaaacaagtgcttctttttcttcttatcacctttcagtgtctgctctgctggctcatgcagtgtaggttggcttacctctccctggaagtcacattgtccttcagaactctttttactatgacccacaaacagttttcagacctcactctgatgagtcaaaggtaaagctgtgaataaacagatggtgaaacaacatttgcagttctctgacttcagtcctccctgaaacccacttggaatctagctctgaattcagccggacatgtttgttcttcccttttcccatcctcacctactcctaaccttcagtgttctctttaccttttatttttatttttgtcattttagtagtaaatgacagggacatagttactcaatttgtaaaacattgaatggtgaggtcaaagattctatgacgagcttgagatttctaacaggttcagatggatgacagcaacattttgctggcttaattttggagctgtttttgtaggttttgaaatgcagtttaatagtgagtaatagagaagtttctttctgccgtggagctactgaacccttgaaagtaacatgctggcacatacagatgaactgtagccccacatttattccttgcttagtggtaagctgtacactgaacaatagaaaacaaaaggctatttttctttggaagagcagatactgatttctggacaaagtttatgttgtacaagttaaacattttttattcttttctggttagattttctgccttttaaaaaattagcttagttgaaaaagcaggtattattaaatacagtttattttattgaattggacggacaatcgtagaattttaaagcttaaatggctttaattgaacctaatgttctaattttacagaggaaacatttgaggcttagtgcggttaaatgaccactcctacaacacacagcctgtttgtttgatggctgaggctgaaaaccagactccagactcctaatttaatgcttttccttcattggtcatgtctttttagcttcagtgaagatcttttttttttttttttttttaatttttgaggttatttaaaaaatactttgccttgaaaatttaacatttccacttaatcattctcatacttcaagaacagtttctctgttaactttctgtttaacttcttaaaccatacactgtggaaattatctgtctatatgctgaacagtctttaatgactgcatgtgtgccgtagctgttgagatgttttaatccactttagcaaaaggtttatttgtttaagaaaagtgcagtgttgtattaagtctaagcttagaacaatgaagcatcatctcccagctactgggagtgagaatgggaggggcagggagtggttggtactatgagctgctctaaagaaaattcatttcagcttcctcacatgttaatacaatcatatttcagtgaagcccttcttcagcaacagtcactaatgatagagtgatgtgtttagacttgaaggttctttaggtgctgtttaaatgaataatgagtgtagttaattcacaatacaggtgaaaagttaaccacagagtagtggcactgctctttctttccccgtcacctctgtgcatgatctcttgctgcgccattagaagggatgattagaatgggcaaatattccctcccggtgctcctggcaataggaaagcactgtgggtgagatatgtctgcagagcagtggtatagtttcaggaagggacctcattctgctctctggggcaaagcttccgggtgcctgagtgggcctcttcctagtcgatggggcagcttgatggggtggctatttattggtgaaaacagtatccatgtcccattggttattgggacttgattcctaatttgaacttaggtgctgtgaagagacttatgtaacgctgtttaatccatgtttggctttgttagaagagtttaaaatactcagaaggaagaaatgtttggttcctttgaaaaggcagactgttcatttagctagggagagcctcaccaaatgagtcaattaaaaacatttggggattaagcccagtgagagtgctgtttttatatgagacatgaagagggtgggggaggggcgggtggaactatggggaaacagcataggaaaaaaaagatctttagaaaaggaaaaagttagccttagctcttcagagagcactgggtgggaaaaaggatttaagtggaaagaagaaaagccctagagatttttgtaccaaaaaaaaaagagtgctgttaaaaagatgaatcaacagctatattctaaatggcgtctccttaactgggatttgaagggaagagaaggcctgagtagagtcttagacaagtccaagggtaaaaaagcaaacagatagttgaagaagtggaaattataagtttggtggcaaaaacttacttgtaattagaatttttgtgtccttaatacttgttgttatgctgatatgataatatgctaataatatgctaaggaattttcccaattcataatctaaagcaaaattaactaatatatgttctgttatggaaattcacctaaattgcaccagcaggtgtattcatcccgctaatactaacactctgttactagctccactgtggcgtttccactgtaacgtggtggtgttggtgctactcattgtgacagtgtggtgtcccaaagagtgagcaagcctcgccaacgcttccttaaaactcttactgatggaactaccatgtttatatagcaagaatattagagaaagaagagtcgagaaaggattccacaacacacatctagtcttttcctctcttagcttttagggtcaacactacctttctcttggaaatgagaaggggagaaaaccttttccactattctgaaaagagggttttaaaaattctctcaggtcgcctaagctggaggggctttatgacagcactaaccagtaggtcaaaaaggaaatttattttttcccatcataggttcctctctacacagagaatgcaaaaccgtaattcttaagagttcctcaatgattattcacttttgttcttacttccatatttctctagtaaagatttaaatatttaattttgtagactcctgaaataactgcttccagatagtatatttactcagaatattatttaaatgcattaatgctgacattgttagaaaggggagaaaactcaacattttccggcagaaatcattgtaaaatgtattataaaatttcctcccttcctaagtagagtgctactatatagtgaatataatttaactttttttcttggagacttattgtcatttctgtgaagttattacctcgacatagtagcgtcctgatgcctcaaaagctcataattcttctcgatgccacagcctctgtcctatctacttgtcttggttgtcatgtcttcaatctcctttcatatttgcctatatctgtaaacttaagagaaaccagataatcaatctgataaaatcactaagctgaatcatatacattaattctcattcctagctctctccacctagccagtgtggcctgaggcattcatagccatgttctgagtggtgaaggctaagagagcccaggagagctgtccagggttaaataagacattaatatataaagtaaggactgtcggtatacgtgatatttatatgttatcatattacattttatttatttatttattcatttatttatttgtatatatagagagagaaacagagtctcactctgttgcccaggccagagggtagtggtgccatcatagctcactgtagtgtcgaactcctgggctccagtgatcctcccgcctcagcctgctgagtagctaggactacagacttgtgcgaccacacttattttttgtttttaatttattttttgtaaagacagggtctcattccattgcccaggctgcatttttaagtttagtaactgcccaaatggacattgggtaaaataaaaataaatacagtcacttctcttcttaaatcattcacctctcaagatgaaggtactaataggacattttctagaacttcagtgttaaccacagcaaggaggaaagacaggcctgttagatgtagactaagaacttcagaagctgtctccgtcctaggctgggcccagggctctagaattgtcccacacacctggtgggcttgcttgggtacttgggtggtacctgggagatgatgacctgttcatcttcagcttctgttattccaggaaacagaggtagtcatctggatactacaggtttgccagctctgctacttctgcttctactgcaggaggaggagctatggaatttttatgcatgcatcaaaacactgacttggctcataagactgcttaaaagacagagtgataaattacgccttgtttctcatgaaacagatttttcccaaaagtagaaatactaatttataatgtatccttttcagaaagattgtaagtctaagtttctcagagaaacagtgtatgtgatggcaggaccccagtaaagtccaaaatatcccataatggccttaggaccatgcccatcatagtctccatagagccatggtccccaagagccatggtgcccaagagccaccacttcagtgggtggtaggtggttgtgaagaatggtcactgtggttcacagaataacagtgacaattgtgaatagaagccagtcattacctaactgataaaatgagtgaggctagcaaagggcctgacaggaagtgaaatcacttactgaagtggtggtagagtacgcaaccaagaactaagaacaggagggaagttaaccctagggagagttcgactccacttgaggaggaacattctggcaatcaggactgtctaaaaatggaacaagctgattgatttagcagtgaaacctctgtcactggagatgttcaaacagaggtagtaggaccctcttatcaggaattctccagagaggagatgtgagttggatagaaggttattgtagacgaccacttgtttctctctcagctctgaaatgtagtccttaaggctgacgtgtgtttcccagtttctaatcggaaaagataacataatctacagtgttgaaataatttaaacaaagtaaataactgtgcttttacaaccataatacggtttagcctttcattattttgttacgttcctcattaacatagacataatttcttttaaagaagggacaattgtgacgagcctgggcaacatggtgaaaccccacctccactaaaatacaaaaaattagctgggcgtggtggcacacacctgtaatcccagctacttgggaggctgaggcaggagagttgctagaaccaggaggcggcggagcttgcagtgagccaagatcacaccactgcactccagcctggcgacagagcgagactccgtctcttaaaaaaaaaaaaaaaagaaaaaaaaaaaagaagtgacaaaacttacccagtaaactaaatgttaatttcctcttctcaggagcataatactaacttactcctctgtttttatatttttgagtactgataatcggatagtgatatatttgtgttattttttgttcaaacaattgaattcattcttagcaagaacaaaagtctatttgaaacatgtaggcatcttaggtagattaaatttttcattgtttcaagttttgacttttgtatttctgcacattagtgatccttgaagattaggcaaggccaagttcttttgacttttataattagtgtgtcggaatcccagtttttcctaccctagggtggactgtattttttacaattaactctgtgaagggtgactgggggtggactggtgaggagaggcttccagttaccagagagcctgtgacttactctctgtgcttttcctaggtcaccaattttcaaagaatttgagtataattaaatacacttcataataaactaggctgaacataatttaatctttccctgaaggtacttcagagtcttggagtgctttagggccatgatgagcatcaattatgttctcacggtgggtgtgcagaaggaggtagttaatagagttctgtttgatcaagtcctgggtgactggacatgtgttctgttatgattagcagttcagtgtccaggttttggaactgatgcttagtattaaattctcaggcaggagagaatggaatagagattgacctctttggctttgagaggctgaaagttgatgacgataattcacatgtacatggtatatatagcactttttagcttccaaagccctttcacataccttgtcttccattgcttgtttcttgtgatgttctggaaaggaagcaaggccgctggtatcccatttttacagatgaggacagtggagctcaggaagcttgagggacttgcctaagctcatacagtagatcaatggcggagaccactggacttcaaattcagtgctctttttagtatttcaaaggatactaaacatttgctcacatctctgatgttctttgtgctgtatgtgtagtaactcatttaatcctcacagtggccctgttagtaggtagatatcagttcttctggtactattacgattctcatcttcagagctgaggccactgagaggcacagagaagttagggcatgcactagtgagtggcggagctgaaatctgaacttagagctttggctccagagcccatgcactccaccattatgctacatggctactcagtgtacagatacactgagcttaagtagaggagaaagcttatctatccatatcttcccatctgcaaagacctctgcctgtatgggaggtctgggctcgttctgactaaggttttgaacccagatctgccaatttgagatcttgggcccattacttagcctgagcttcagtttccacatctctaaagtgaaaatatagaacatggaatgtacctgtaagaacacaatggaatacaggtaaagtgcccagcacactgcttattccttagccttcatgttttagaaagtggttgctattgtttttgttgttggtggtggcggtagtggtcttcttcttattattatttatatatttacaatggccaaaattatatgaaatgttttccaaaaattaggtatttgtacccttcatatgaatgtgtgtgttaattgggtataattgtctttcttgagtctttaaaatagacaaatcttttgattacatttgttaatattattgtacctacctatatctgacttgacttacaattttacttcattaaatacatagcaagtcatctgagaacccaaagtaatcatacagattacttgccatatagttaatttgtgactgtgatatggctgctaaggtagaggtttgaatttaaaagcacaaagaaaaatgtttacttcaatggttacaaatagattaatcatataaagtacatatttgcagagtctcgctcagtcgcccaggctggagtgcagtggcatgatctcggctcactgcaacctccgcctcccaggttcaagcaattctactgtctcagcctcctgagtagctgggactacaggtgcgtgccaccacgcccggtgtatttttagtagagatgaggtttcaccatattggccaggctggtctcgaactcctgatgtcaggtgatctgcccgcctcggcctcccaaagtgctgggattacaggcttgagccaccacacccggcctattctaaggcttgttctaaggctcacagatggcaccttctctgtgtatcctcacatggtggaagaggcaaagcagttcctgggggagttctttgataaaggtgctaattccattcaagagggcacctcccaagggctccactccctaatactatcacgtggggagttaggattcgacatgtgaattttggaggcacacagacattcaggccaaggcataaacagtgaccacttttgttctgtctgtccacacactgcctagagcttccatttatttcaactacatttgcttttttcttatttatctgttcagagtatcttctcagtggctatttatttaccaccctttaacatgttttcttgacattgtacttcagcctgtatatgctttgcaactcaggaactatgctggcttaactaatagtacctacttaacaggtgaaactgacagtaacagcttaataggtgctttccatttttaacatacctcagctttttataaatacaaaaaactctcaatcttttaatgtggttttaaattttaaacaggtcttctttcattttcctttacagaaaactgtaatactgcatatgcattttcaaactatgcatatttcttcttcattccatgtggaagtttttattcagcctttcagtaaattttacttagcttgtcccatggatgccgtaggtgtaaggaatatgatagtgaacaagacagacagagctcctcccctcagggagctttgccatgatacacgatgatgacaatgataaaaggagcaaataatgatttgggacctgattccaaagggatatttctgcgacacttacaatgaaattccaacctggcaccatctttttcactgcagaatgcatgaaggtggttgcatcatgtcatttcgacatgcatttaaatgtaatgaaaggcacaagtagtgattgcaaacactacaataagttgcttgttgactctcttactgtcttccttcttatctccctttcttcctttgtctcattctcagttttcagagcttagtcattatttcgtaatcctctcctaaaatgaaatctggggctctaaggacaggaggcacaggttgtgtttgaacagcatcatcgtgctttatgaaggggattggaggggagattctgccccacagtatggtcaggtctcgctccaggcagcactgactacattggtgctggttgggtaactgtggctcggcaggtcactctccctctttccacctccgttttctcattattagtagaagtcgaaatagcatggttttctaaggcctctgccaatctacaattctgtgattcatatgttcctaaacacttgagttactttttctcaataaatggaaatatattttccaatgaggctggaaatacattttccaattatcctctcccctggtttataacatatcatcaatgtgttgggacttctaacactgcttctgctgtaagcccatcaagaggttaattacctttgaagaatgaggaactgctggaaaagaactgtaaaaccttcaagagaactttggagttaatccctctggtaataggaatcaatgtcactcacacatctagttgccagtggaggaggaataacagcactgggccaagtagacttgaaggaaggcaggttgctgatagagtggagagctgaagattctgaatcaagctcatcatgactctcttcctcctctttgaggctacccaatcagagcaaaaacagtattttaaaaaacctcaactggatgagcctgatgcagtggtgtgctcatgcagtcccagccaaagggtcacttgagcagaggagttcaaggccaacttgggcaacatagtgagaccccgtctctaagacaaataataaacatcaaaattaaaattaaaaaaaacccaacccagtgttcccttcagaatcctgagtggtttgtttcatcttcctctattctggcttgtgtcatcttcctctcttgtaatggataaaaactccaaatgaagacaaaaatgaggaatttgtcaaaaaaattgaattgccaacaaaagccatctttggttgatcaaacggtacagacgtttcagttagacaagagggctaagtttctgagacccattgtacaggattattaatattattcatttttagccctcataataaggtattataaatgtcaagattgctaaaagaatacgtttttaaatgtcttcattataaaaaataagtatgtgaggtgatggacatattaatcagcttaatataatcattttatagtatatgtagctatatcaaaacatcacattataacccataactacatgcaattattatttgtcaattaaaaatacaaatctaggccaaggtgggaggatcccttgagcccaggagtttgacagcagcttgggcaacatagggagactccatctctacaaaaaaaaaaaaaagaaaaaaaaaagaaaaaaaaaggaaggaaaaaaaagaaaaaattgactgggtgtggtggctcttgcctgtagtctcagctgctcgggagctgaggtgggaggatcccatgggcccaggagtttgtggctgtagtgagctatgatcatgccactgcgctctagcctgagcaagagagtgataccctgtctcaaaagtaaaaacttacaacaatataaaaaataaaaatttaaattataaaaagccatcttctttcccactccttcccattttgatacaacagtcccagaccccagacttgctttcctcatgagtcatgcagactcaagtattgcagttccaaaacactgcctgactcaccagctccatccaaaagagtatgtattgtcttcatatgccagataggaaattcctgctgcatataggaaaagcagtgtgtttaaatacatggacacacacacacatacacacacacagagtacacatatacacatctgcatatacacgtacacatatgcgcacatattcatactatatatgtacatacacatgcaatacacatgtatacacaccacacacacacatacacacacatgcatctccaagtctatttccatgctttttttcagtaaagcacctagacaaaggagagagatgtctaatcaggttttggtggttgtcagggatatcataaatgagaatctcaagttactaaacttgatttcacaaaatagtttattggtagttttagaatggcattgcattttaggcagccccaattgtaaataagtgagccgggtaaaagcagattggatgtcacccagaatattttctggaaaggggacatacacaaaattctctctttgcacaattaccctgttttgggtttgcaatattatgttgagcaaggctggctattttccaccaacaggatgttacagcttgtcaaaagttattcaacctatagtgttaagcaggtacttcatcattactgaatttggttgatgctctatggagaaagccaaagttaggagttttgtctgtcattgaggtagagaccctcaactagggaagctttgaactgttcatccagctggtattctgtaccaccttgcctctggagttgagcttagaaccctacttccattttttctgtcacttcagggctgtttcaactattgtttcttcatttacttatatcaagtgtgttttctcaattcataagcatgggagaccccaagagacagatatcgcattagtccttttttgtttgtttagcaggaaggtttttaagtaaagctcctaaatgatatgtctcattctcatggaaattcatcaatattgttttactgtctcctatctggttactttttattttaggtaaccactgtgatacaatatacacaagtccctggatcatgaaaataaattgaagagctaatgttaatagtaagttctcaaccaggggttatgctggaacccaggatacataacccacaggagggccctccgtgaactcagttttcatggaattgtcccataccttcacaggtagaagcatggctatgttaaaagtggccaatgaaagtatagtttctttatgccttatactttgtttggtgaggatttctgccagaggtgtttgtttcctttagttttctggttgctatgattttatacagctttggtgacctctatgagtaccagataaagttaggtatgataaaggcacaaaaagaccgtagaagccatttgtattctaaatataaatatacagactaaatttgtatgcatttgtgtcttcattcttcacggtgctgtatcctccgtgtgtgtgtgtgtgtgtgtgtgtgtgtgtgtgtgtgtatttcttctttgattccaggctgcttatacgaaaatgctgattcatagtgtcactgtcttttctttttcctgcgaaattctaaatccgtttctaaactttttctacaactctgagtttaatctctctaaagtttttttttttccctcttgcggacacaaggcactttgctttgtttatgctaataaatgtcagactagcccccaaaaattagaagaaatgccagtaatttcaaagggctcttgagcatgattttttttcctgtttcttaatacattgtacttttcagagtttaagtttaggtgcatgtaggtggtattagaagattcttagattttattggtagcatccagacaatcttgtcatcacccgatatatatcacctctatgtggtagacccttgtggaaattttctcatcacgaaagtcgaaagtttaattttggagaggaagaggtttttcagatacattaaataggttttgctacaataaggtgagatggtactttcaattgagcatttctcatatactagcaagcagacagcttggcctcctggttgtaattacatgccaatggcttggtgctttttattttagaagttgagttcatcctgaattctctgagcatatggagtagtgcactctgattgttcccattaagattgtaattccatccaaggcttatagtgtcattgtaaacactagatggaattacagccccatgcacattttggaagactgcattattcattgaaatactttataaagttaaataattttgtaaatatgctccaagttcatgggacttagatagaaacataatcctggccacaaaggaggttctcagtaaatatttcttgtttatttgatggactttccttatatctttaaataaactgtatttttaaaaagtgtagagaggttatacttaaatatttgtaggactttaaaagatcttgccttgaaatgctcttacggtttcttgcttttcattgatggaaaaattgacttcccatatgaatatgttatttaatcttttctgtttctagcctagagagaaatactgagtagctcgagtggtcaagaatctttattttagggacatccgcatgtcctaagtaattcccttctatataaatatctcttttcggcataatgtgttgcatgccttcaaggtggaccactatgaggtgaataattacacaacgggaagcctggctgtctcgtggaatattggatggatggctttcttattggtcttaattaggacagtgttgttaagataattcactaattcacagtgcgttatcagatttgaaatgacctcttttttttatactacttcggaagtgtatgtataccttttaggaaagacctggaaggataagttgtatattttagtatctgatatggttttaaaatttaagactctgtgttatgtatgttttgggatgactataaataatctgtgtaacaaggtattaccaaaaaccttattgcctttgccaccatgcactgcaaaatatagtatcaggaagcgaaaagacaatgcattttgagtaatttttagaatttgcatttttgtgaattgacatgtatgtatggaggacttttcaaaaaaaacagaacttttcattaagaatattcggtattaagatattgttttaaatgtcagatatttttaaaatatatgaaaccatattaatcacgtattacttatactttttgtccctggaaatattccatttttaagaacagagataacaaataaatataccagtaaagctaaagtcagtgctttctgctcttaaaataatttattgaacgataaaatgaatgtctttgctttgtgaaattatatttttgtttaggacttgataatgcttagagaacattttagtttttacagtttaaagaatgaataatgactggttcctctgctccctgatttgtttccatgtagatagtacttcatttttattacctgtaaacatgtgttagctttatcaattaggctcaattgaatgaagcataaccccctgaaaggccttgccagtaaaataataatagtaataataatattcttttcttcagattctagcagggagtactgctggcttttatgtaagaagtcaactttaaaagtgtttttgtgtgcgtgtggtgtgggtgcagcagcaatattgtgtattcctttcaaatcaagatgcctcatagtctgtgggcgggggaactccctaagatgccctcactagttactcattcatttgttcctccccagaaagggaaaacccaatgctccacactccacttattctgaataatgggggcggggaggtggtggcgtgaggatgtcagtgtcattgggcaaaagccttcatttttaaagtttagcaaaatgcagttttattgctttatgatcagtgtgtattacaagctaatatacaaatggcattagtgatcaaagtgggatactgatgtggcaaaaatttacaatacacttaacagattgacctgacataacagtgaaagcatttgaattccttcccacatagtaagtaacaagtaatttctggagccagaagtgggagggtgtgtgtgtatgtgtgtgtgcatgtacgtatgtgtgtgtgtgtgtgttgtctgtagaagttaacaaatatgttagttcattgaccatttctttcgttgtcctaaagaaaatttcactcacttgtgcttctgatttgtttcccgtgaagtctcttatcactcttagaacatgaaggcgaattaatgaagaatccttaattcttcaaaaaaaaaaaaccagccctaatttaagaaaggagacatttaacttgctaataagatcctaaaattttataggttatataatacattcaaggaaattgaattatatattcattaagaatacattatctctattagcagagagtaaatgattgaggttttactgaacgctaaatgctcagaaagtaaatgcaaagaccatcactggttgagcacgctgggaactgggtggaagtcttaggcctgtcattaactgttgtgcggcctttggcaaataaccgaagttctctgagccttaggaaaatgaggaagttgggttatataagtggttttcaaatgtggcttcagaaaaccctggagagccactgcactccagcctgggcgacagagtgagacaggcctctgtggaattagccaagggtttgggtaaggggtggggctgagacctgagaatctttatgttacaacagctattaggcaatgtcagttcacaggaccactaaatcaaacaatccttcagaccacttccgactctcaagtttcaataagtccctagaaaacatcatccttggtccacaggaagcaatccaataaggaacttggtctcccataaagaatccaataaagaaaactttaaaatgagaggagggttatggatttgatcatctccaaggacccctgtcaagcaagtctaagatctttccaaaggagatctgagaaatatgtctgtatcccaagaaggtttgacaatagtccctgaagtttgggggatgacttctagatatccctgtgccttcaagcgtgatcatgggctggatttgttggccccatggtctgcctctgagtcacagacaaatgatgaaaaaaagaacaattttctgtcagcatgccagaccaagggaggggccaggagaagaaccgtgaaccatgaactgtgccactgctggaggcactgacagctccttggcaccagatgtgtgacctcaacccctgcagcttgggcacagataatatctcagggcaggggatgaggaatagaggaagaagggaaagttgcagggatcctggagtgttaatacccatggtggcggcagagcaatttgccaggaagaaaactctctggttaaccctccggcactagttgccaagcatgtttgtactagaatggagttcaaagttacaaacagagcactgtctgtttttaaggactcatatgaaaggtttgcttgtcctaagcctgaatccaagagtctgtctgtcataaacactttcaggtagcccaaaaatcccttcaatgtgatctccagaataggggaagacaaaggactcaggtcttcagctgtctgatgaggagtgagaaatttttctaatgaacatctctggcttatggatattaaggagagttcagtgtcaaaagtttctgcagcgtagttaacagaggtggaaagttgaaataaccttaaaggcactgaagctgagaaactgccctctttatcctaacagccacagttagttttggaacactgtccatggagaagctcagggctgtcaatttagaaagcagctgtgtgctggcccattgggcaccatctttctctcataggttgttctagtccaaggtgaagaaagctacattttgctctaagctagactgacatatggacttctagatttgaaccctaaacacaggaggaagtgattgattgtattacaaaaagaatcttctttggtaaataactatttttttttttaatggccagatgggagaaagcaaaagatgccttttcgtggtgttttggaaacctagatctcatcaactccctggttggttttggcggtcaaggctttttatgccagagcaactgtgagccaggtttctgaggttcttcctgacccatgttggtagcctcttaaaaataactgtcattccaagttcagctaaaatatataactcaacaaataaatacatataaagcatatgaatagaagcgggaaagtgaggattaacagactggagagtaagagtcttgccatgtaaaatactataaaacactcttaggaagtctcttgcttatgttattacttgtacagtaaatgtggagacctggatctcttcctcatggtcccttatttcttgttttcctgctgggaggtttcaagtagctgatcccttgcacatgtactttaaaacttcaattatatttgtcactggcttatcatgggcaatgtatgtgaatgtgactaagggtcctgataaattaaatgccacttttacatgttcctttctttttcttctattagtgttctttaggactttgaatgggaaatcctcaaacatgtaagtctatgtggcttcagaaaaccccagagaggccaggcgcggtggctcacacctgtaatcccagcactttgggaggccgaggcggacagatcacctgaggtcaggagttcgagacaagcctggccatcatggtgaaactgcatctttactaaaaatacaaaaattagctgggtgtggtggtgcacacctgtaatcccagctacttgggaggctgaggcacgagaatcacttgaacctgggaggtggaggttgcagtgagctgagattgcatcactgcactccagcctgggtgacagagtgagactccatctcaaaaaaaaaaagttctccccagtggcctctactgaattatccaagtgcttgggtagggggtgatgctgaggcctgggaatctttaataagaaagaagaagggaaattccttatgttggacccaacattgagtgtgttcagatacagatgttggcaggtatgggggcattcggaaggagaacagcggctaaccaagctaactgagactgagttcaagattcgcttctggttcagggggactttcgttttcaggctctaatacattcagaagagcaaatattggtactttaatcatgcatcttttccccctcaagttctgtatctgccacgtgtatattttatttggcatttaaatgcacagttcttataattgctgataaatagtctccattgcacattttgctggcactgtggcctcactgtaaatgctctctgtatgttcttgggaagttgcataatggcagttactctagtttactgtgcaatatgctcagtgactaatggcctaatcatgacttgaaaaatatataaacagttcaacagaagcagttgattcactgagctctttcatccagacaagggtgagctaatgggaataaaaaagacggaggtgtgcagcagcgtctttgatgtattgaagttagagcattcccacaaatcccatgcattattgctcattgatggcggatcctttttcatatgcatgaggcaggagtgccaaattatcgtcctaattggctctgacttggtattccttaatgttcgtgttacacttgttacaacttttttcctttcctctaaatactactgacagtaacagctttggagaggcaggctgtcacgtggccccatggcgtcaccctacactgcaggcttaagtgtggctctggtcctgtgctctggtttcttgggatagaattacagctgagactgtgcagtgcggacctgcctggtttacttcaggggcattgttgattgacacagattcttgttcccttgtcctcagtggcaccttttcttccaagaggaacagagatagagtcttacaacagccattaaatagaagatcctggggtctactggagcactgtcccattggtggggagaaataacaatcatcatcatcatgtctcccttcctttggaattgattaggtagctcctatattccacattcctctcacctgttgaccacacacaatttttggtcttgtagcttggccactcattttagctcaatcactggtttaatttttttaatgaaatcactcaatcgatagaggctaacctctcgtagatgtaataattccaaccattctcaaagaaataatgaagggtggaatattatgctttctaaaataatggaatttattttttctttatgcccacagctgtttagtcctaaagagggggaagaaagaatctttcgatcttttggcatgttccatgtcccgtattgatggtcatacttcagcttttttctggttgtttaagaattatgtggccaataggctgccttgtatataacagtgaaaaacacccattacttgtatttgtttcattttaaggtttaggcagttggagcataggacagtaactggtttcccttgttttctggaacctgccccttgctctctcttgggtgatgcctcacccctgccccagtgtcagagctgccctgggtccttcttcccttgaagggtctgatgaatgaaccacacagcttgttagtatctcagtttgttaatcctcccggaggaatgtatgtttcaaaaaagaagctgaaaagtataatggatgagaatttgctttggaactcagcacactgtagattagagaaggaaaagaaagaaaaggaaggaacagaaggacatgtttggggggtagggggcctttctggggcttctgaaagcaaatgttgtgataattagttacagtgtcccaaagatgcctgggtctacccctgaccctctacacaggccaattctgctcccaccagaaaaaaacaagagtacagagcaaagaggcagggcagcagcctctgatacctatttgaactttacacattctgatagaatttattatctgtattgaatatgggagactgtgggtaaaagacttcaagacagtgaaaaactaggaaagaaaaataaaggtgtattgggccttggcaaatttttgacacttacttgactatgtgctttaactttttgaaaaggcagataatatagcaatcacattaaatatttatctttaaaagaaattattttaaaaattactcttaatattaccacattatgaactcaataggagatcctacagttcctttaactttaacaacagtacatttgttaatattcattaaagttaaagaagcttactattacaacagaatgaagtaatacttgctggaaaacaccaatattttacttatctttatctaatccccccgtttaactgtagtgatacaatacttaattttaaaagaggaatggtttgaatgtacagacttttacatgtgttcttccattgagttctttcttgtagtctaacccaatagttatcacacttcagtgtacatgaaaagtgcagtaaaggattgtgcagtatacataaaatcctgtgtggagtgtcttgtgggaaagccaaaggattttcaaagttaattttgactatatatgacttttgcttaacttttgaacttaaccgcccacataaaaactcactccactatatttcccttctctttgcctccctacttctgtcccccctttctcccttttttccttcctcccttgtattcttccatccatccatccatccatccatccatccatccatccacccacccacctatccatctatctatcctcccatccacctatccacccacccatatatccatccatccatccatccatccatccatccatccatccacccactaactcatccatccatccatccacccacccatccatccatctattcatccttccacccatccgtccacccacccacccatccattcatctatccttccatccatctattcatccatccacccatccattcatccatctatctatttgtccatccatccaccctcccacctatccatccatctattcatccatccatccatcttttcttccatcactcctttctttttttttttttgagatggagtttcactcttgttgcccaggctggggtgcagtggcgtgatctcggcttaccgcaacctctgtctctcgagttcaagcgattctactgcctcagcctcccaagtagctgggattataggcatgctccaccacagccagctaattttgtatgtttttgtagagatggggtttcaccatgttggtcaggctggtctcgaactcctgacctcaggtgatccacccgcctcggcctcccaaagtgctgggattacaggcgtgagccaccgcacccagccccttcactcctttctttttctctttccctgccttccttttgataaattaacttaaacattttttttggtgaaattaatatggtgatgtctacttatatttaaatcagaaaattattagtatgctgaatattccaatctcttaggaatgataaaaatattctataaaggtcaatcttaattccacatcctatgttcctactcagctttctgtctctgatttctcatttttagctgggaacatcccagccaaaagacagccaggttctctgtgagcatagcatatcaaactaactgtaagaaaataacattttggcttaaaagccatcttctaatataagatagaataaaaatgataatgattggtatactatgtggcattgttagtaagaatttgaagtaagatttacctaaatcgctgaaaatattgaatagttggctgagactttagaattggtacaaacatgtacattttctcaaaatcaaaagaattaaaatagatatccaagaagtcagattatgaaaaaataagatagtcaacggaaatcctaaaagtaacttaaacattggcattggacatatttcatttgtatttctgccatagaagagttaagttaatgtgcatttttgccatgcaatggcaaaatgaagagacttttttttcccttctttttgctcttggtaaaattaagtggcaaagaaaagatagctctgaggttattgctagaattttgtgctaaaaacattttggctagagcagcaagtttttaggcaaacagcccctgataaaagttgcaagaaaaaaatctcattcgagtgcaccaaacacttttcagatgaccatttaatttttttaagttgcataaacaatttcaagtgcactgtaaatatagaaaatagggtatgatagttgacagaaacagaatgaattaagagcagtaatagaaaattgtaaacaattatatctgaatttcatcagttgtcttgcttacattcacaattagtcatcccgtgaaagacataggtgaacatttagctgcttaaaaaggaattagctgcttgaaaggacaaatgttcatgttaaatttcatgaagactaaccttcagcagacaacggcacaaatgtgtcagctttttctggtgtgaatgaagcaagatacaggcaaaacagatgagataaataggacttggaaaaaaaattctactatacaagttttgtatccccatctttttgctctttgtggagcacctactggaaaccactcctgacctaatgatgaggacacagagagaaaattcaataagcaatggcctgaaaaataatttttatctaagtattagataaacgcagtagcatatttgacttgtaaaaataacatggctaggctttgtatgcctccctgtcctcttacctacgtgggattttcaaatagcactgattctggggaggggaatcaaaaaatagaagactcccctctcccagagcacacgtaattaatgcctgtgttgcagctgggagctctctgccagcagagttctttgctcgtcatctctcagcgctcacccacattccccttgattcacaccgtattgtttgtttacatgtttgtctccctgactcaggttggaaatctttaaggacaaggacaacctcttgttcctttttacatttcccatggtgctttgctcgcagtggccactacagacatgattcattcattgttttaaaaaaagtgttaactagttaagtgaaaataaaatgaaacagcaaaatgagacaaacgcctagatctgaaaggctacaaaatacagcagagggttcagtggacataagaggaaaggaacacaatgatatccccaatcttgtgatggaatagaaaaaaaaaaagtgattggtgttgatgtaacacttttcttggccagttgaacattccagagtagaggtcagttttgtagttaaatctggtaggaagatgtttccaaccagaaggaatcatactaaaattattttatcacaacaagcagtccataaccgaaactttaatttgtgagttgggaatcaggataggaaacccaattttatattctttttataggaagaagaatccattccaccactcagactgctttcctctttcataatcgtggcatactctgccattgtttgtttattttccccacaactagatggagagtgcaaggaccatattttactcatgtgtatcctcagggcctagcacaaagtaggcactcagtaatgaagaagtaagatgtttcaatgtccctaacatttaaaaggatgtatgaaactagtgctaataccagaaagagttggttttcataggctgttaattgtgggttttgaaataatgtactactttgtacattgattttatacaactgtgttatatacttcagtaactttcaaggtaaaaagttagaggttattaaatctggcagggtcttaaaacctgagtctcagtccatgtaagagcattcttttgctcttcttgactagccatgtaaaagggtgaatgtaagttagtgaattatcttttagaaatcttcagttgtatatatatttttttcatcgaattgcaaactcactcacacttaccaatgtaatactaccctgttgatgagcattagtagccttatttgggtagccagattagagacacaggcttcatggtgttacctgccttgatgttttcattcataatgcagcatttgggaatgcagcatttttctatattggagacatgtatgatgatgtgtatgttccttccccataaccctgtccgcttctcctttggcagtgtcttgcatcacaattttattttatttttatttatttatttattttttgagaaagagtctcactccgtcacccaggctggagtgcagtggtgcaatcttggctcactgcagcctccacctcccaggttcaagtgattctcctgcctcagcctcccgagtcgctgggactacaggtatgcaccacaatgcctggctaattttttttatatattttttttagtagagatggggcttcaccatgtcagtcagactggtcttgaactcctgacctcaaatgatccgccagcctcagcctcccaaagtgctgggattacaggcgtgagccaccgcacctggcctccaattttaaatatatgtaggctccatctccacctctccctgaaaaaactttccctgctcctttcgccttcatgtgtgccataagttgactgccatcaggccaatatcattacatataaattccctccacccttcgttttaattttaaaatatctgaaagggggaaagggagaagattccctaatgagtatgttgtgtgattcaggaccttggctcttagatcctcagtcatgtgatattttcagattttatgggactatggtgcaattgaagaaaggcttttgacagaaaatgtgaaatgatgaagtcttagcacggactcatacggcagtatttgattgcgggttaatctccaaacgttgaaataaagtggatctgttaaaaagccattggttactttcagttgccaggggtgtgtatgctcacattcctggaagcacattctataaagtcaccaatctacaacacagacacccacctccccctagacttcagagagctctgctgggctgcagctttctaccaaaagagttgtgtgcctctgaatttcacatccaaccttggaagctgcagtctgtttaagatttcagaaagaatgggggctatgtttccagtttactgctttgttattttgaaattgaaagtctgagcagaattcagaactacacaaaacaggatcttttcacatgtttgtttaagtcatgttcttggcaaaaacttgctgaggaaatgatctgtttctctaggagcattgatttcttactccagtacagtggccatttcccaggatctcattccaaaccatctgttttgccatcagagccagcctttcagtgaatgatctctttggtctacactgtgctaaaccttctgattgaaaggatttttattaatgaaatctaggtaataaagttgcagtgaactttaggaagttctctgtaggcagggcgtggtggctcaagcctataatcccagcattttcggaggccaaggtgggcagatcatgaggtgaggagtttgagaccagcctagctaatacagtgaaaccccgtctctactaaaaatacaaaaaaaaaaaaaattagctgggcgtggtggtgggcgcctgtaatcccagctacttgggaggctgaggcaggagaatcgcttgaacccatgaggcggagcttgcagtgttgcagtgagccgagatcacaccactgcactccagcctggcaacagagcgagactccgtctcaaaaaaaaaaaaaaaaaaaaaaaagaaagttctctgtaacagtcaaatagcaagtgctgacctctgtcgcctctgtagcagcagtatggatgaattgtgagcttgttggctaggttgggctgcgggtcattgtggaaaagccatgtttcccttgcctgtggctgggaataagtatagtggggccattttaaaaaaaagtcctgtggttgaattctgagtttgagctgttttaaaatgtcaaacagactgaatccttgggagactcatttgaatgagaccagcagcaatgtaagaatatatatatatataaaacacgttagagcatttccatgtatgggagggaactgatggagagaacacagaccaccacattaactgccacatgctgtcaaccagtggatctcaactggggaccattttgccctctcaggacatttggcaatgtttggagacactttttgatcgtcccaaatgggaaaacaaggtagcaatactggcatctagtgagtagaggccagaaatgctgctgaacatcctgcaatggggctgggggcattggctcacacctgtaatcccagcactttaggaggtcgaggcaggaggatcgcctgagctcaggagtttgaggctgcagtgagctgtgatggcgtcactacactccagcctgggcagcagagtcaggggtctcttgaatgaatgaatgaatgaatgatttttaaaaatcaatcaatcaatcaatatcatatcctacaatgcaccaaacagtcctctgcctcaaccaaggatcatctggcccaaaatgttaatagtgctggagttgagaaaccctgccttagaccctttccttctcatagtttccaagctgataaatcagcctgccttgacaaaggtgaggaggtaagctgcaggcgtgagtgggaagagcaggataaggaaggaaacggagaaaagaggtagcagcattgcatgaaaataaactacccgggccatatcccatttgtgccaaattaatatttgggattctgtctttatgtgtttggtaaagccggaaagtatgtgggtggctggctgggccatggcctttgtgttagaggtgacctgagtttcttcaaagcacctgtgttagtttttcattgctgctgtaacaacttatcaggaactttgtggcttaaagcaactgtttttatctgacagttctgcaggtcagaaatccaatacaggtctcaccaggctgaaatcaaagtgtcagccaggctcattctctgtagggactctagagaataattcatatccttgccttttccgttttctttcttttcttttcttttttttttttttttggcgggggggaacggagtctcattctgtcgcccaggctggagtgcagtggcacatattggctcagtgccacctccgtctccaaggttcaagcaattctcctgcctcagcctcccaagtagctgggagtagcccagcaccatacccaactaaattttatatttttactagagtggggtttctccatgttggccaggctggtctcgaactctcgacctcaggcgatccacccgcctcggcctcccagagtgctgggatcacaggcatgaaccatcgtgcctggcccacctttttccattgtctagatgccattgtatttcttggctcctggccccttcccctatcttcaaagccatcaatgttgcatctctctgtgctgtgtttccatagttgaatcttcctctgacacttcttcctccttctcagacttttaaacttccttgcgattacattggacccacctgtatcatctccccatctccagatccttaatgtcatcacatctgtgaaatcgcttttaccacgaattcacagactgattctggggattaggacgtgggtatgtttgaaggtcccttgttgtgcctaccacagactccaaggcatttactagagccacattttgctgacttgagctagatgtagcaaaagaagtgttataaaaatgggtttttaaaaaagcctttttttttcctgtggtataattttagtgtttagaagtaatttttcttttaatgcagtatgacacagaaaacatttggaggatgttgaaaagtaattgtttaaattggcaaagacacatttcagtaagggagtaaacaagagggaaacgtgttggggggaaaggtgtggggaggaaactctagaccagaggccctaggacttgaatatacaacttagtcctgttgaaaattcagattcctgggccttaaagtatgttaaataggtcaggggtggggcccaggagttgtacttttaacgagcaccctcctgtgattcatttaacataaaaggtccttggctcacacttggagaaacactgctgtagaaactcaaatacctattttaaaacaaaggtacattttaatcatttagtttaaaatgaaatcattgcataatactgatgttagaggttagaataaacatgtacttaagttcttgatattcttgtcatttcagttacatgtcagggaatgtgatttgtgttttgacgtattcaaatccttgtcatattcaaccatattcgtattcaaaatatataatgattttgacccttgattgttcgaattaagactgtcatcttttctgtgtgattaactcttgtgttgatataaatatgcctttggcttactaatgttcagtaagaactaatgactcttgggaatgttaatagactctgtgagtccctttttaatcatttgtaaccaggctgtcattccatgtttgtttggaagcttagagataacatttatgaactttgtgacacatagtagttgctcaataaatgttaactgtagaaacacattgattagtttcacttcagaaatagacacttagagttcaaaattcccatctgcctagctcctgaggcccactttcttaccagaatctttcctgataccctctcctgcataaaatggttcctcttttgagactttgtagctcttttgtacttctcttattctgttacgttactgcaaaaaaaaaaaaaaagaaagaaaagaaaagtgccaattgtgtacatgctttcctccctgctggaatgtaaactttgtaaaggcatgatccatagcagatacttcttattacaaactacctggcagaatttctttctaaagaacctactcagtaagcctgttggtgaactgagcaacatttggacaattatggcatcatcttacaatttttcagctattggttttcacttgtttagaaatgtaaaactttgcaaggacttttataaaagcaaatttcagaatagttattcactaagcttttttatgctaatgatgtcatgctatcaaaaattagctagagtaaatggactgtaatgaggatggtttgtaatctagattatatgttccacatgtaacatcgaaatgaaatataaaattgagttgttggcatgtggttgtggtgagcagaagcagttattatacattacttggtaaaattcatattcatatcttgtcagtttacagtgagccagagattaaaaataacatttgtttctgttttagtaactgcttaaaaatatccaaaatcattttattttctttagcctgacttctagtagtgttttgaatatgtggcctttcaagcagtaatgaaatgcatcaatgcgacttggcagtgcctcacaggacatgcttctaggatcatttttaatgattaaaagtcaaattgagttctaaaaaactgacccaaaatatagatgagccaagtaaaaacggaaggaaatctgaataaaatcttggttcttggtcctctgcatgtatcctccacatctgttttctccagatctcttttttcttgcttgttgatagcacagaggaagatcgcagagagtaatgtactgtatatgtttcacatcccccttcctctttagtgatagtttggagagtatactgcagtcaccatggttttcagtttggagagtacaaggatcagatctgtattttctagagccagcttttgtggcattctggagaggtgattggagaaccatgagagcaggcagacatctgggtgagagggcacgaggggtgagtgacggcagagccagacttgctggagaggcagaaagggaaggattcaagtagcataaccaggaaatagaattgataggatttggtccctgctgacctgtggaataagggggaaggcagaggagttgattctagtatttctaagttgggccacttagtgatattggggtaccaggaacaggcttagtggacccacagaagtgaccagacccaggagtctctctgagcgcccaccctggcttctctgtgttggcttaccctttcttggttgggggtcatggggtggtcagcttcagtggtgtggtctgaggtgacaggtgctcaggagtgaggacagggagtagacatcaccaatgtgaatgtggaggtaggcaacaagagttattctagaactgacaaatttaatatattttgctgactgctgagttccatttggacaaatacctaatgcatttggggcttaaaacctagatgacgggttgaagggtacaacaaaccaccgtgatacatgtatacttatgtaacaaacctgcacgttctgcacatttgtcccagaacttaaagtaaaaaaaaaaaaaaaaaaaaaagattgttcagttcagttcagagagcaataggagcagtttgctattcaccaaatagggacatcaattctttactgattaatagcagtgattcagaaaactgccttttgtagtagagcacaccaagggggtctgccggatggaaaaagagaacagtgctttgtgaactataattgttgccataagtaaatacttaaaatacactaaaatggcaacatcaggaaacatgactaaggagtcagtgtacgccacgccctttcccccacctttgtggttgttgaaaatttccaccaagagtgatgtatacaaaaaagggtaagatcagggtgttaggtttcagaggaaggcaaaaacttgtgtgattctataaatggagcttacaaatggaaatgcaccattcaaggcagaaagtctatcacagtcattaggaataagcattagagtgattctcctttcttaacttctgcacagaagtttgatgtggtaaagaaacagtctgctcttagccatgttccttgaaaatacatgtcttcaattacttggtttgtctgagagaaaggagggtttggaggagaaggaaatgcctcgtgagtttgacatactatgggaggattgttgttattattgcttgatttacatgctctcattttatacaaagtgtacagcacaatttctcaaagagtaattatgatgccaagaaaatggggtggattctgggcttcctgcagtctgtcatccaaataataatattcattacaaagatccttacccaggaggccaaggtgggaggattgcttgaggccaggagttcaagaccagactgggcaacatagacccctatctcaaaataaaataaagtaaataaaataaaataaaataaaaaataaaataaaataataaaagctccataccagtttgtggcattcctactgaaaacagaggtatacgaaatgcttgaacagggcatggaactggaggtatggatgtcattaagaatggctgagaattttttgccaagagttagtatactatcctactttattctatttcagtttgcagtaggacagacctaattctcttccctgagaaagtcacaaataaactagcatggagcttctcagtgggcacccttggctgaactctatagactcctgttctctttaataatatctaaagcttctggttcaattacatggctaatatcttgactctcaagaccaaaaggcaagatgtttaaaaataaaatcaacgttaaaaacatgcctgtgttccatggacacaggaaggggaacatcacacactggggcctgttgtggggttgggggaggggggagggatagcattaggagatatacctaatgctaaatgacgagttaatggttgcagcacaccaacatggcacatgtgtacatatgtaacaaacctgcacattgtgcacatgtaccctaaaactttagtaataaaaacaaaaaaataagaaaacaaaaacaaaaaaaacatgccagtgttctttagtcctcactcaattagagaaaaatgagagcaagcatgatattttgtatctggcactatgtgcactgccttgagagatttctctagaaggttttaagaacatctgtcatctattaatagttacgaaagccgagactcacacaaatgaggcaacattacagggggtcagagagcacataggtaagcccaccttgatgggagtcctggcccgaggcactttggggaaagagtgagctgcagtggttatagaaagacaaatgtcttgagccgggcattgaaaaatgactaagaataatctagaaagtgttcagtatgtttttaacgattgtgggttagcagaaggaaagccatctgaggtgagagaaataataagcaaaggggacagaggtggatggtgaatcaactgacccaagggagttaagcgtttagaaagcacttcaaaaggataacactacatagctccttgccttactgtggtgccttagagatgactggcatttttgcagagcttgtttcataaatgtgctttcagaggaataaacaggggattcgggctgggctgaggataccttgaattttgtttacagaccatcattttgtttacagaacatcagtgctctatcctcatgtccttctaagaatcaaaagttttaacctcacagaatccagcgtgtggcttgtgagtgagactcctttttccatgtgataaccggtctgctttggggaggcaaaagaatcttaccgacacgtacatattttaggatgggctctgagccaattcatcaagccaactcctcactttgaaacaagaaagtgaagaggatgtttcatgattgtggaatacctgccagaggaagaatctaccgaagttcagtcaactattaattggaaaggaggcagcagactgaggagatagagaatctttgctctcaggtggatggaggttggagtcctcaatctgtcacttgtgggtacattatgtagctccttcacctccatttctttatttattagaaggcgggtaataaaagtgtccactgcctaggatggttctagggcttagaggagataatgaaactcaagggcttaacatgtgaatgttagctattatcattgcatgtgtccattaacacccaaagataaccagtgttgtttagtagttctttgcgtattttctttctaaatagataatgatttataatttacctagttacttcatgaattgatttcatgaaaaaggtctttctgaatctctttccatgtactttaaaagtttattcctttagttaaaagaaattttaactagattcttaaagcctagattggaagaaagtgtttgctaaaaaaaaagtcatggctgggtgcagtggctcacacctgtaatgccagcactttgggagaccgaggcgaacggatcacaaagtcaggagagcaagaccatcctggccaacatggtgaaactccgtctctactataaatgcaaaaagtaactgagtgtggtggcatgtgccagtaatcccagctactcgggaggctgaggcaggagaatcactggaaccagggagtcagaggttgcagtgagctgagatcacagtactacactccagcctggtgacacagctagactccaaaaaaaaagaaagaaagaaaagaaaagtcatgtatatatccagaagaaaggaaatcagtatattgaagagatacctgcactcccatgtttgttgcagctattcattatagccaagatatggaatcaatctaagtctccatcaatgaaggaatggataaagaaaataaggtacatatacacagtggaatattattcagccatacaaaagaatgaaattctgtcatttgtaacaacatggctggaactggaagacgttatgttaagtaaaataagccaggcacagaaagacaaatatcacatattctcactcatatgagggagctaagaaacatgacgtcatggagacagagagtagaatgatggttagcagaggatggaaagggtagtgaggagggaggaataaagagaggttggttagtggctataaaaatatagttagatagtaggaataagagctagtgttcagtagcacaatagggcaacaatagttaacaataacttattgtatatttcaaaataactagaggaatgaatttggaatgtccctaacaaaaagaaatgaagtgatgggtatcccaaataccttgatttgaccattacacattgtgtgcttgtatcaaaaaatcacatgtacccaataaatatgcacaacgatcatgtacccataaaaataaaacaaaattaaaaatgcacacttctcacagtttcttgcctagtagaatccaagtaaatacagttttccgcccacagataactcttccctctggtgccctcatggtttatctcatgttcttgaccacatgggttaatggtctttgttaggttgtactcagtgatccccaagaggacaaatggtgggaattatggaaattgaggccagaaggaaacctagagttctgtgcttttacttccagtagggatctgtggggtttagaatgtctgcctggtcagcagttctcactttgggaacccccccacccccacccaagaccttttctggagggacatctgtaagatcaagattatttttatggtaatactaagacattatttacctattccattcccattctcttccatgtgtacagcggagtttttcagaggctatatgatgtgtgatgatattgtgtaatgaaatgtgtcaacttttggaagatttgcataattcactgaactaatataattttccaaatgaccagggtatgatgttacaaaatcatgcatagctaaagatccatccaaagttcaagatagactaatgaattttaatataaaagaatacttagagtttatttctatgcttcagattccatggtgctgctcccctttaagaaactaccacttattgagttttggtatgatataaaaaaagaatatccacaattgctgaaactattggccacatcttctccacatacttcaaccaaacaacatatcacagaaaactgaattcagaggcacagaagagaatttaaccattttccattaagccaggcattaaagagagctgcaaaaatctaaatggatctcactcttgtcactaacttttttgttctgaaaaatataattattttttcataaagatgttatttcatgtagtatgcaatgggtatattagtatttctattaaatgaactaatgaatattttacatttttctcaattttgcttctaatatggtataatagttgttaaatatgatctacctaatgaaaagttccttggggtcctcaataaattttaggagtatagaggaaactttatactcttaaaatttattgaggacccaaggagcttttaagtgtgaggaccaaaagtgtgaggaccactggcctagtctggtcagtgtctacaccctgtgtccactggtttcacctttcttctggaaaaagtgttctgtggtaaaatatattttgggcctagatgagtgctttctcccctcatagatttacaatacacatgaacatatgagaccctccaaagtctttcccaaatttatcccaacctttaaaaacaaattatcccaacctttttttatcctccttttaattttggcacaacataatgttccacaatggaatataacatcctatggaacgtaccggctggtatatgatatgggctgccctctttccgttaacaaaaaaattaaaagcaagacattttccttcaaatccatactttatttagagagaggcctataaaattcacttgcgaatctgattgactttcttaaaaaaacatactcttcattcattgtattatgccattttgcttatactctttgaagctgtttctacttctgtttccaaatgcatatgtttttttaaagctctgttttagacatttttgtgtgttaattagtagcatctgctccatgtgtcataagacaaagtaatttcatccccacaaaattgtccaaattgcaggttaagtggtagcagcctagctgttgagctgttactactgtttggtatttttaaatggcaaaaaataccttcggtgatgcatcacatgcctttaataaaacacagtcactttgggtaacagaaagatttagaaatggcagtgggttttgttgtatttctttttatgattctttctttccagtgctttagtttccattggttgtgggtacaatcctaagagtcagaccaaaataaagaatattccatcagtatggatcaaaaacatgttcctggccggacatgatgggtcacacctgtaatcccagctacttgggaggctgagctgggaggactgcttgagttgaggagttcgaggttgccgtgagctatgatcacaccactacactccagcctaagtgacagagcaagaccctgtctctaaataaataaataaataaataaataaataaataaaaaattaaaaaacatgctcctggctgctgcgtgatgagcatcatcttcctaagacatgagactgatacttgcaccacccagcaccagtttcttcccggcacagtgccattctaaatttgtattgaggcaggagtgcagcgagaatttctttctccttctgtatttcacatgtctatgccacagaaagaatagaaacatcttaatttgttataataattatagggacaatagtcactgtattttatataattcaaaagttctttttaaaaaattttttggtcttgccggttcctactgaaacacttcgtacagtttgaatccttagtgactttctattgccaactgaaaattgattttttcctatattaaaaaaaaatccagccgggcacggtggctcctgcctgtaatcctagcacttcgggaggccgaggtgggtggatcacctgaggtcaggagttagagaccagcctgaccaacatggtgaaaccccgtctctactaaagattaattagccaggcatggtggtggacgcctgtaatcccagctgcttgggaggctgaggcaggagaatcgcttgaacccgggaggcagaggttgcagcgagccgacattgcaccattgcactacagcctgggcaacaagagcaaaactccatttcaaaaaaaaaaaaaaaaaaaatccaaacagaaaatactgtggctatcttattcagtatcttgttcttttccttaccactgagtagtttcagggaaaaccctttacaattgcaaaaagacattcagtttataggactatttattacagcgttggcaaatggtgctggaaattctctaatagttaaatgacgcaaattaaccagactgaaatggaagaaccatactgaggttgctcttcaaacagcaagaggctacctttctgttttctttgacaactgaatatagcttatgatatagttaaggtatcaaagatgcaagaattgtagagctatgtggcaggttaagaagcctgatgaatggccgggtgcagtggcccacgcctgtaatcccagcactttgggaggccgagaccagcagatcacctgaggtcaagagttcaagaccagcctggccaacatggtgaaatcctgtctctactaaaaatacaaaaaattagctgggcgtggtggcgtgtgcctgtaatcccagctacttgggaggctgaggcaggagaattgcttgaacctgagaggcagaggttgcagtgagctgagaccacaccattgtactccagcctgggcaacaagagcaaaactctatttcaaaaaaaaaaaaaagaagtttgatgaagatgcagatgcttcattgcttgtgcaaattgtgtgattttagcatattctacagtggaaagtcaaatttcaggcatgcacacctaaagtaggaaaaatggttcttaaaggggtagtgtgatgcagggattaagaacctggtttctggagtcagatggcctgagtttgagtcccacctctaccatgtatgtgtgctgttgaacaggtgatttaacttctttggggctcagtttctcccactgtaaaaagtcatgtaaagttcccagaagagtgtttcatacattgtaactgtagtagttatctactgctgtgtaagtaattactccaaatcttagtggcttaaaacaacaagtgtttattatctctcagtttttctaagtgtgaatcactgcatatcatagctgggtgtctctagctccaagtctttcatgaggttgtagtcaagttgttaacctgggctgacgtttcatctgaaggatagggtgggggcggtagggatctgcttccaaatccactcacatagatgctagcaggcctcagtgatatgccatgtgggcccttccacaggactgcatcacagcctggcagtcagcctcccccaggtgagtaacccagaagaggatgcaagatcccaagatggaagccaccatcttcatgtaacccagtcttggaaatgatctcccattacctttgccacagtctgtttgctagaattgagtcactaaatccagtccacactcaagaaggctttacaagggcatgaattccaagaggtgggatcactggaagccatcctgcaggctgcttataacagtaacttgtgctttaatttatatccccttatggtctattcctgacaatcagaccaaatgagcccttaaaatgtaaggcagatcatgatactactgcattaaaaattatctctggtcttcccattttacttaaaagtcggtatctttacaatggcctacaaggcctttcatgcttataaaattatttttctatattttgtaaaataatatatatgtataataaatgctatatatgtatatttgtataaacacatgtttatatgtttagttatatatctagaatttattttccatatggtgtaagatagcaatctctttcgaaacgaagagccaggtttcccagcactatttattgattacaatacccttttcctgggccaggtgcggtggctcacatctgtaatcccagcactttgggaggtcaaagcgggtgaatcacgaggtcaggagttcaagaccagcctggccaacatggtgaaatcccgtctccactaaaaatacaaaaattagctgggtgtggtggtgggcacctatgatcctagctacttgggagcctgaggcaggagaattgcttgaaaccagaaggcagaggttgcagtgagctgagatcactccactgcactccagcctgggtgaaagagcaaaactctgtctcaaaaaaaaaaaaaaaaaaaaaaaaccaaaacaaaataaacctcttttttccctgagttgatattctactgagaacctgtttgtctcttattatgcaatctgtgtctaattgttgcatttttgaataaagatatacttagtgggtctagtaaatcatataagatagttgtgtttgttatgattttatttgatttgaaacattcaaatacatgtaaaaacaaattataattgagaattaattatggcaaacatttaataagttcctttatttgatagattaggaactaattttatttaaaaggccgtgacttacatttaaaagtccaattagctacaacattaagactaaaaagtatatttcatgactcccaggtcactgtttataggttgttgatatcccatactttgctgctgctgctgttgcttataactgttcagaaaattttcaccaaaatgtctatcaaattggaaaaccctctggagtgagatcctttttaaaatatagccaactttcacatatgcaggcatatctgtgaatgccctaggcccctgtgctttctcttctgctttttgggcttttggccttatctttgcttatgataacttcaaatggtaaacaagaagggataggtgacagagattaaacccaagccagtttgttttgttgattattattaacggtattgataaagagtttgctgaaagagggaagcatattgaaattattgcttaaaaagaagtgtgtagaattttcagttgttttcttttgataagagttgcctcatagctgttgtagtatgtgcaaatgaaggtcagcgataaatcacagaatgaatcacttccaactccttcacatctacagatataagtaagaatggaaaatattgtcacttagatgagtccttattttttttttctgtatgaatagtataaaccttacttttctggacacctagctttggcagctggtgaaggttgttaaagtaacaaatgggaccattctgcctctcccagatcgattttgctgcaagatagttgaaaataatataatccagaaatgaatttattttcttatggcaaaaacaaaacagaaagagagtactatgaggaagtatcatgctactggtaaatttttcaaactaaaaccgcattacatttcattaaatgagtttatgtccattaagcgtcaatgagcatgagtggttgaacccagaatccagtcaaagtacatattaactttctgtatgactttaaaaagaggtatgtcaacctccctgggtcagcaggttcctttgcagaagacattggaatgaaacgtcaaggacctcttccaattatagaatacctcgagatatgaagttggtaacaaataagagaaatgcagcaagatatttttagttaaaaaagaaaagattgatacaagccagtaacttgcagtgaacttgtttaaatcctcctcctctctccaaattctgtttttaccaagccggtaaagtaaagacagtttgtcatgctttgaacttcctggcttatgttgatttctatcagtatgttgccttacacatttgagtgggagctgagttacataaaactaataaaatccttacaaccccattttctgtgggtactgatagcatccaaaaaataaaaaaggcttttgccattttcaggcagttgttcctccggctagatggaaaattgaatggcattatctcaactcacatgtttaaacattaacggagagacactttctcctcctcaaaagtttttagtgttcccaggaatttaaccacagatagacacaactcctcaaacgtcccgaaaaaaaggttgactattccataaagtaatagttacagaaggctttcaaggaattagttattcacacagtaagcttctgaggcatacgagcatatcctctttcttacaacttggtcacttgatccaatctttgatgatcaccgtgggacctttggagatttatggagtttagggttacaagtatgatgtggccaccatactcagggaactggatgacagtcagccgatgggttttcaacatagatgaggatgagctcataaaaggctaaaaaaggaggcagacacctttggaagactgtttctaggctctcaaatggccattgtcaaaaaacaaacagtggggtggatttgactaagcatcagaagatgctttaacaacagcctgtgacaagtgagcgttaaaagctcacaaggcagaaaggaacttttcagagtgaccttgtcagacgaggttctaatgtgtaggctttatcagctgctctgagtgggggtaaagaggcatgcatattttaaacattcatttcatattcagtgtgtaaagtaactactgcttttcagcttgggtggagaaagtatttatcaagaatcacacaagggaaacccatgcattacctacttatagggcaaaatggaaaatgttctctctcttatgctttatcttttttgttccatcttaatagctctttatttaaaaagtattcacatcagttgattagtctgagtctttcatttgaagcaaactttcttcactttctgcccttgatactgcacatcagtctttaatcacttagacgtactgaatttttctttattcacatctttcaatcggtaaacttgaaattttgcaagtgcattcccactggtgtacattctgattttcaagacctgctacctcccccagtgtcatgcttgttttttttttctttctttcttccttcccacaccccacctccagtattttagggcaccttatgtagataagcagtgagatggcttcatcctgataattaacatgcttgtttgaggttatgaaatatacatttgagaaaggccagggatttccccctgaatatccactaactgcttgaagtggcattttcattctgacttggtattttgttttgtttgactgcagcatactggagcatagtgaaagagtctattttgaagcttcaaacttagtgctgctgcagaccaggaacaagagagaaagagtggatttcagcctgcacggatggtcttgaaacacaaatggtttttggtaagtcatccaaaagacttgacatcttttagctttaaatgtcatcgggcatcacttcactggtgtaccagaacttcttcttcaagcgtattgctatttctctacatcctaaataacaggacatttgaaaaaatgttgtcctagtgacagagcactgagagagcaaccgcatttactttatgtgtttgtttctgaaacttgcagaatagtatgatctgaatagaatgtatttgtggttagaaaaaagaacaaaagcaaaaacaaagcaaacccaaacaactaaacacacaaacagcaaataaactacatctaccagatactccattttagctgaaaacataagggattaatcgcacgagaggaagtagattcaatttaatggcaagttttttgcgtcttgtgatcaaatacagtcatgtgccacataatgaagtttcagtcaacgacagatcacacgtattacagtggtcccataagattataatactgggctgggtgtggtggctcacgcctgtaatcccagcactttgggaggccgaggcgcgcggatcacgaggtcaggagattgagatcatcctggctaacgcggtgaaaccctgtctctactaagaatacaaaaaaaaaattagccgggtgtagtggcgggcgcttgtagtcccagctacttgggaggctgaggcagcagaatggcgtgaacctgggaggcagagcttgcagtgagccgagattgcaccactgcactccagcctgggcgacagagcgagactccatctcaaaaaaaaaaaaaaaaaaaagattataatactgtattttggttgtaccttttctatgtttagatgtgtttagaggcacaaatgcctaccattgtgttacagttgcctacagtattcactacagtagcatgccgtccaggtttgtagcctaggagcaataagctataccgtatagcgcaggcgtgtagtagggtgtaccatccaggcctgtgaaagtactctgtgatgttgcacagtgacaaagtcacctaacaatgcatttctcagagcatatccctgtcattaaatgatgcatgactattgtgatgggcaaggtgaaagatgatgggggtttccaagtcctgttcagcaaacatttactgagtaacttttaagtatacatgggcccttgaatgacagtcttagtctgggggttggaattcaaacactctaaactataaataaatgataaaaccattccagagcatacaccaacataatgtggacttccaggaattttttttttatcaaccccgttcatgatattacctggaagcagagtcctcaaattgaagcctaggtctgccccacctatcttggtcaccttggagaacttgctcatcatcttggaacgacttgcctttaaagatgtatgtgcctaactgatctccaaggtctcctgcaaatttataattcagttccctctagtgcaatgaattaaataattatccacttcagttcttgcccaacagaatttctgtgtaggcttggtggtcatttgcagaggggctcattgtatcaaccagtgtggaggaaaggagccaggtcctcggggggtccctcctggccccatttgcccatttgacagccagccctttggtcaaacaggactgtcagcatctgcagtaaataatttttttgttttttttttttttgagatggagtcttgctctgtcaccaggctggagtgcagtggcacagtctcagttcactgcaacctccacctcccaggttcaagcgattctcctgcctcaacctcccgagtagctgggactacagatgcgtgccaccatgcccagctaatttttgtatttttagtagagctggggtttcaccatgttagccaggatggtctcgatctcctcacctcaggtgatccgcctgcctcagcctcccaaagtgctgggattacagatgtgaaccactgcacccggcccgcagtaaataatttattcccttgcaacattaaaaaaaaatgtggcacagtgctttatgaatattatattcatttttatgtatttaattttaatttatttatttatttatttatttgagacggggtttctttctctttgttgcccaggctggactgcagtggtgcaatcgtagcttgtgctgggaccatatgagactgggactatcctggctgtcattcataaagtcttcactgaatttttaggacttcgctgactggtctctctttatgaacttctgtcacatttagggcctgcatcatataaaatgcactgctatgtgttgttctgttagtgtttgtcatcacgccatcaggggtacacacagcttcagggcaggaatcatcatcacagaccagtagccgagactacaggcacgcgccaccatgcctggctaatttttccatttttttgtagatacgaggtctcgctatgttgtccagactggtctggaactcctgggctccagcaatcatcctgccttggcctctcaaagtgctgggattacaggcatgcaccactgtgcctggcctgaatattatatccaaataagtgagataggcttcttttgaaatactgtcctttgtttttctttaggggatctgactttttccttctctgtgcttgccgtcattgtgttactggttaccggccagcctgttaaccctgtggatccccacactttgttttacgttgaatagcatttattattgttctttcttactaaacatcccctttctgaagcagagcttcagaaatgatgctcagatgtcactcttgttagcagctggctttctgccttcaagtgatgcattattggggtttcataacagcatttttttttctcttacaaatattaaattatgaagtgcaggaaaccacatgaatgtggtagaaagcaaatgcaaacacagtgttatctggaagtgctagttttgtgattctcctggtgacagtatccttcctgtaatcaacataggaaccctctttacctgtttgctggtggttttctatcctgtatcttcctctccatttatgctgtatgccatggccactttgtcatgctgaatcgggaggtttgattaagacagttgcttggggactatctctatcaaagttctgcctcaccacaaatcctggctgtcacttacaaagtcttccctgaatcctcaggacttcactgactggtctctctctctctctctttttttttttttttttttttttttaaggcagagtcttgggtctgttgctaggctggagtgcagtggcaatcttggctcactgcaaccttcgcctcccaggttcaagcaattctcttgcctcagcctcctgagtagctgggattacaggcatgcgccaccgtgcccagctaatttttctatttttagtagaaatggggtttcaccatgttggccaggatggtcttgatctcttgatctcatgatccatctgccttggccttccaaagtgctgagattacaggtgtaagccactgcgcccggccctgagcagtctctctttatgaacttctatcacatttagggcctgcttcttacagaatgtactgctgtgcattactctgtgagtgtttgccatcagcacaattgcacatgggttgcacatggcttcaaggcaggaatcaaatcacagaccagtgtttcccaagggtggtctaatcccagtacctcctgcttccgaatctcttggatatgtttattaaagttgcagattcagcaacaccaggcttatgaatcagaagttctggggatgtagaacccaggaaactcaccttagttaacttttgcacactgaggtttgagaataactatctgaaaataattgtgcatcctcctctttgcctcctctcccacagcaaagggtccaggtctgagcctatggtaggtgtccaggaaatatttgcttgttgacctaagcaacatcaagccatgagggttgcattccctcttcagttgccaagctttttcaggatgtgaggtcagcatattctctgaacctttagaaacccactttcttccaaatacgtaaagtgttcccctagggcagaggctcttttggaaatctttttttgtctctttatcttttgtaatcactaactctgttggtggtaatgacaggagcccctgactaagattgggatagtggggacatcagctatgaggagctgggctggagcagcaggctaggagaaagatctgaggataggaaccggactgtgctaaactagaagctttatccttggctcccaaagccacacctgctacccttggcagtttattctgagtggtatttctttcagctgttaggcctcgcaggttgtcagttttggtggcagaagagcggtcccgctgctgaaaaggatcaagtttagctctagtggacgcacatcaaagcacctacagtgcacagtggtggattcaggatttgaatccaatgttagcagactgcagtggtgacacttggccctctccttccgtccgcctcttgttccagcaagggcatgcctggtcttggatgatccaggagagatttgcagggcgttgctgcttctggtgcacctcctgaatgcccttgctggtggctccagccctggtagatggaatccaaacagaagaactcacagaagcttagctagcctagaaaggaaccagcgtggccatcaggacatttattagctgttaatctaaccactaccaaatgcattaacacattttttttgacaactttttctcttttatttggctgttgcttagttcagttttgcttggagaagttgtggcaatcctgaattcagtttgtgtgaaaaagcaagcaccttcaagcccagtgttggagaagtatcttctcccaggtctctattcagttttgactaaaggaggtttggcgagcagaaaggtattaccgagtggattcttctcaaattctcatctaagtgaaggaaaaaagcccagtttgctgaagccatgttaagggcacattaggcttttaatatgtgcttcatggagaccttactagattttcctctgcgtagttctttccatctgatgggagcgagggctgtttttgggttgcagaaggcaagagccaggttgtcagctacagaagagaaaggtgccattgtctgcataattgactttgagcctttgtctaaaaggatgtcaggtggaggagtaatgaggggcgagatttttaaaaaattatagagtacaggattttagcaaaatgccagatgttggcatttctgttttggaggtctttagtggtccatgtaaactatttccttgcaagtaaccatccatggtaggaaaacagaaaaaaatgattctaaaagagcatttgtctagttagaaactgtgtcacttgtatcgtttaccgtgaggcatccttgagaggtacatgatttccaaacagccacctaaatcataggtactgcttttggaacagatgtaaataggaaaagcgccagtccagtacccccactaaagaccatcgttagaaagctctcgcagtgctttccagcttagaggagtgtagttcccttcaggtacttaagccagtgttcggtaaagcagcacccaaaatgccttttgttaaatgtgttctaactcgttcctcttgctgatgctatcacaggctaatgattgtctaagtccttcagagaagctgtgtggttttgtatagctgtgagtaaaaccacacccattcaggaaatgcaatgtactttcttctaacaggcatcatcaaaacagatgctgatttacatggtaggtccccttctttagtgacaatttgagagctttgaagggaggcatttgccgtgcatcagaagaaatcagaattaaactggcacacgtgcacattgttggagtaaaaaggaaaagcagtgacctagagtttgttaccgcacatgctttccctgaaggcatctgcaccatcatgatgtcctcatcaactctgcacacacaactagtatttctgtctctttctcttcagagtttaagctcaatgatttccaacttcctcccacatgactccagctggatatcacataggtgtcttcaatttgaatctaaacctgactttgtcattgtcctacgtttatgggctccagggtcactagctcaccatttgttgatgctggacacctcctcttcctctgcttcatccctagctcatatgctggagttctgccttttttttttttttgagacagagtctctctctgtcacccacgctggagtgcagtggcaccatctcagcttactgcaacctctgcttcccaggttcaagggattctcctgcctcagcctcctgagtagcttggattacaggtgcgcaccaccacacctggctaattttttgtatttttggtagagatggggtttcaccatgttggtcaggttggtctcaaactcctgacctcatgatccgcctgcctaagcctcccaaagtgttgggattacaggcgtgagccactgcccccagtctgagtttggcctctttaatatgatagtttacccactcttctccactctcgggcccctgttctgttgcagaccttcagcatcacttgcctggactgctgcagtggcttccaagaagccccttgcttaaagtcttttctttctgtgttccatttattctactcttttgagaattctcatatgaaagaaagggtctgattgaattactcctacacttgaaaatccttggtagtatgtggaaatatggaaaagtactcataatctaatgtgttaaaagaaaaactttagacaaattaaatttaacagagtttaattcagcaaagaactatttgcaaatcaggcagctcctctctactcctttcctcccgaactagaatagattcagggcatttctgacatgctgttgtgtggttggagaggatttatagacagaaaaaggaaaacgacggacagaaaacagaagtgaggtacagaaacagccagattggtttcagctcagcgttcgccttatttgaacagggtttgaacgataggctgcctgtgattcgccgaaacccagagattggtacaagaataggttacagcctgtttacacatccaggtaggttacggttcactgcatgcggagaaacctttaggccaaacttaaaatatggaagaaggcagctttcggctaaacccaacaaatgttaagtataaaattcatatttcaaaattgtgcaaacacattgattacaaagcagtgacaaaaatctatgcctatccacaaaggctagaagtaaagaaaacaagaatgaaggtatttttaatattagggcaattcatgtgtgtgtgtgttttttaatactcctttggtagcaaatgaatatggtgaagtaaaatgaataattgaaaggattttgttagctttctgctcctgataaggtaaaatgtgaatttcactgcatggcctctaaggcccctaggaattccttatcaacttaccatttaaatctcatctcccgtgactcccatcccttccatctctccatataatatttgttttcttcttaaacatactatgtatataataaccatgcacctgtccctgttgtttcttctcgcatgagactcttgttctctgcctggtaaactcccactcattcgttgaggcctaattgaaattcctggccaagcatggtgtctcacatctgtaatgtcagcattttgagaggctgagggaagaggatttcttgagcccagaaagtttagactgcaccattccactccagcctgggcaacagatagagagctcgtctcaaggaaaaaaaaaaacaaaacagaaattatcctcttgctgtgttaccgctattatattgcaattttctgctcatatagctatcttggtaaatgattcatgaagacagaaattgacttatcttaaaccttgtattccaagtgttaagcccattcctgcatataatacagtttaataaatatttacaaaggtaagaagaaaggaaagagcccatttagaaatacagaaataatccttcaggtaagatattaaaaatgtttttggataagcttagtactaattactatttcataaaaattacaaaaatagatgtttttggttaaacagtttttacagtaatagttggattcagcctcacatcatttaaactaaactactggcgtatatctttggcattagaaaattctaacatcagatagaattgcttcagcttcactgtaagccatatttatgaagttactaaaaaccatttttttaaactgttttatgtcatgcataaccatgtcggccaaatcagaaatccaaataaatgacacatccagttctggccacattttgtgaatatctggtatttttttcttaagggaatttaaaaagactgggtaacattaaagggttgatgtaacattttcaattctgaaaggctactctgctctaggaatatacttgttactattttttttttcatttctaagaattctgtttggctaaaataccaaaagagaaaaaaataacttggcttaaataaaatgaaaagtcatctccaaaattaattcggctcctcaaaagttctttccaaaggaaggaataggatgctatttaatattacatgtcaaaaacaccactaaaaagaaaatcatcatttgtacgtgtgacaaggaattcagaatggaattttatgaaggctagtgtgtgaggcacgctgctcacatcttttaaaataatattttgatatcggggaagattatttaatactatatattattttatattatatatgtatgcatatgtgtatatacatatataaaatagagttttttcctattaatgctttagagtcaataagttgtaatggggaatttcagtttgagatttgtcattttttttgcatgatagccttgcccagccttcagttttcttgtttataaagtcatgccaaaaggtgaactgtcactggattaactaattaagaaattagtcagtcactaacatttattgattgaccactgattggaaacattaaatacccacatcattttttagcatttcatgtaagttgatccttgtctgttttgcagagtaaagaaccttagctgaatttcatttttgtctgtcctgatctttgcattcatttaaaaacctgacccttcagctgtttacaagatccatcatgaaatataccatggctaaggtgaatgtgcagactcccagtttccctttagctattctgttgcactagccatggggttgcaaacttttttggtgactgttacagttcattcatcaggaggtactgactatattttgttgcactttcatgagagccagggctcagaagcatcctaagtacctagtgacaaaaactcaggaaggcaattagactatgacgcttttcattacaacctaaggtgcctctcaatatagtaggtgcttatgttgaactgccctctgcagactgtatgtgtgggtccatgtggtgatattgtggctgtaccctctccaaggttgcctagtgttggctgtagcaggaaaggaagtgtctgtaagcaatagtagcttcaatgaggaaggatataaaagagaagtgaactagtcctgaaatcttaaggatctacatacagaccagagtaccttgatggatcccaaagttttattttattttattttgtttttgagatggagtttcgttcttgttgcccaggctggagtgcaatagcgcaatttcggctcactgcagcctccgcctcctgggttcaagagatcttctgcctcagcctcccaagtagctgggattacaggcacctgccactacacccagataatttttgtatttttagtagagagggggtctcaccgtattggccaggatggcctcaaactcctgacctcagatgatccacccgtctcagcctcccaaagtgctgggattacaggcgtgagccactgcgcccggccttattttatttttccagcattattgagttatgattgacaaaatttgtgtacaacacgatgctttgatatacatatatattgtgaaatgtttattatcatcaagttagttaacactttcatcacctcacatagttattttttcttgcatggtgagaacatttaagatttactgtctcagcaaatttcaagtgtacaaatatcattattaaccatagtcactgtgctgtatattcaatccccagatctcaaagatttaaaatctagccctgagacaactgattacagccaccatatgttttcttaggtagttcacaataaatagttataatgctgctgagaaacagtatgatgtgttgaaaagtgtaggttcttgaggcaaacttcctgggtttgaataccgaacttccacttaatggctgtgtaatgttgagcaagtgacttaatctctttgggtctcagtttatcaatccatgaaataagaaaaataaaacaggccaggcacggtggctcacgcctgtaatcccagcactttgggaggccatggtgggtggatcacaaggtcaggggttaagaccaccctggccaatatggtgaaaccccatctctactaaaaatataaaaattagccgggcgtggtggcaggtgcctgtagtcccagctacttgggcgtctgagacaggagaattgcttgaacctgggaggtggaggttgcagtgagccgagatggtgccactgcattccagcctgggtgacagagcgagacttcttctcaaaaaaaacaaaacaaacaaacaaacaaacaaaaaaacctaaatgagtcttgatgcacgtaaagctttcaaaaaatggtagctgttattatcataccactttcatggaatttcgttagttactcagtttgtggtaaaatttttccagtgtttattcttcatgccttcctacaaacttggtttaggaatttacactgttaggggaaacatgtaggtgaacccagctagggaaggcgaagcaatgctgtgggaacacaaaggagtgggatatttagtctgatttgggagtggtgaggacttggaggaagcatcagagctgacttggaagaatggctaggattccacctgacagagctgggagcaaggcattccacacgggagggcgtgtgcccaaaggtgtggagaagggagagtgcagagcagagcatatttgaggaaagctgtggaccagtttgagcccagggttaaggtgtgtgaggtggaacagtgggagactgggaggaagatagtctgatttaatgataatgatgataacggtgagtgtgaactattcactgagtggtgccatatatcagattctgtggttggggctttacataaattagctctgattacaactcccttcaacatagctatccacattttacagatgagaaaatgggattaattccattttttcttaagtggcggagagccactgaaggttgttgaataggagagggtcatgatcactcttagcaggaatttacttatctgctttttcacttccctggagtggtagacacgtcttttgttttgtttaagagacagagtcttgctctgtcacccaggctgagtacagtggtatcatcatagctcactgcatccttgacctcctgagcccaggtgatcctcccaccccaacttcccagagctctggaattagaggcatgtgccaccacacctggctcatttttaattttttttttgtagagatggattcttgctatgttacccaggctgttctggagccctgtgttccagcaattctcctgctttggcctctcagagtgctgggattatgggcatgtgccaccacacatagccttggagatacatcttgcaccatcctgggctccccagaggagtggtattagactgtcagtatggtgaatactccataaatactggtggagtctgttttcaaagcttccttaacaaaactctggaaacatgttttgtacaatttcctttttaaagaagaaataaactggttaagttactgagcaactcctttttgcctgtgcatgtttcatctcatttgatccccataggaaatcttaaaggtagagagtgtaatttttgcatttcaattatatgttattaatattataatggatgaggtcactgggactgaagaaagtaatgctgcttggagatggtaaagctgggattcaatctgtggctccctcacccttggtctgtagtcggccaccacccctccctctattgaacctctcttttattgctgttttccagtctccactaagtatttcttccactggtttaagtccacgttgctaagcaagtacacagttgcttttaaggaaacgaaagccccacaaggacccagtctactttgcagaggttaaatggaaatagattattttcaataatctgtcctcaggaccagaattcttctaaatgatgctgctggcagctggccatctctgggagcccatcagacaaaccacttgtaggagcccagcatcctgcattgggtcagaatgcaaagtcaactaactcttcacagtagatgcagtttgggcgtgagtacctagcaggaaccctagatatttggggcaagcactttgcttcttccatctggtggaacccacgtttattatctaaaagacacatggcaacaggcaatgcagtgtttgcttccaaagacagcctggaatttggaatgacatttagtgaaaggggaaagttcaatttcagctatcaaaggtcatggccagtgaacctacaagcacatattatgtaaatttggcccaaatctgtatttattagcttgaacagttttggagtggttatctgctctacaaaaatgatctaccgttaagagtctcaaaaatatcaagtctgcttgatgcatttaaatcaggaagcgtaaatatttggcatccatgctagtgctgattttcagaggctttgctcacctgcagctgtgctcactttgcgaaaatggacatggtgacctctactttcctggtgagtggccacgtcagtatcatcccttcccgttcctggcaccactctcacccactttggagagccagcatagagcagcacgctgtgtctcagggaccaggctatccatcagataccctactctgaaagtgtccttaatttgatttttaaaatatatataaatatatagtgtgtgtgtatacacacacacacacacacacacaccataaaatttaccataaatttaccattttaacctttttttttttttttttgaaacggagtcttgctctgtcgccaggctggagtgcagtggcatgatctcagctcactgcagcctccgcctcctgggttcaagcaattctcctgcctcggcctcccgagtagctgggactacaggcgcatgccgccacgcccagggaatttttgtatttttagtagagatggggtttcaccatgttggccaggatggtctcgatctcttgacctcgtgatctgcccgcctcagcctcccaaagtgctggggcgtgagccaccacacctggcccagtttaaccatttttaagtgtacaattcagtggcattatgtacatttccagtgtagtgcaatcatctccactatccatttccagaactttttcatcatcccgaacagaagctctgcattcattagacaataacactccattctctcctcccagcccctggtaacctctattgtacactgtgtctctatgaagtttcttattttagggaccacatggaatcatacaatatttgtccttttatgtctggcccataatttaatttttaataacagtgtttcaaatatactgttcttttccaaagtatttgttatcaatactttattatgtcagtaattatcaataagttctcattctaatttcagaaactgggttgtattggaatatgggcatagagaagatacagatttttttttcttcttaataactgaagagaataacatttatcaaacaaacgatcgaactctttctgagacatagtttcatgtgcctctttggagttgatttcccctcactttattttaactcctatttggcccgaattcttctcagaatttctgcaagcaggctcatagtcctgcgttcttctcttctctttttttttttttttttttttggcagggtctcactcttgtctcccaggctggagtgcagtggtgcaatctcagctcactgcagcctcgacctccgggcctcaagtgatcttcctgcctcagcctcccaagtagctgagattacatgtgtgcacgacaacacctggctaatttttgtattttttgtagagacgaggtttcatcatgttgcccaggcttgtcttaaactcctgggctcaagcagtctacccgtcttggcctctcaaagtgctggaattacaggcgtgagccaccgcagctggccaggcttacatttctgtagtgcctgttaggaagagttcagaattttttagacacaggcatagctcagagatattgtgtcttttttttttttttttgagttgggagtcttgctttgttgccaggctggagtgcagtggcacgatctctgctcactgcaagctccgcctcctgggttcaagcctcccaagtagctgggactataggtgcctgccaccatgcccagctaatttttgtatttttagtagagatggggtttcaccatattggtgaggctggtctcgaactcctgaccccaggtgatccacccacctcagcctcccaaagtgctgggattacaggcatgagccactgtgcctggacactcagagatattttgggttcacttatagaccacagcagtaaagcaagtattgcaatacagcaaatcacacaaattttttggttttccagtgcatataagttatgtttacaccatactatagtctattaattatccaataacattttgtctaaacaaaagtacataccttaattttaaaatgctttattgctaaaaactgttaacgatcatcttcattgaaccataatcgttttgttggtaaagggtctttacgttgatggctgctgactgatttagggaggtggttgctgaaagctggggtggcggtggcaatttcttaaaattagacaacaatgacgtttgccacatttattgactcttcctttcatgaaagatttctctgtagtatgcaccattgtttgagagcattttacccatagtagaactttcaaagttagagtcagtcctctcaaacctgtcactgcatcaattaagtttatgtaatatttcaaatcctttgttgtcattttaacagtgttcacagtatcttcatcaggagtagattacatctcatgaaaccactggtttttttgtttgtttgtttgtttgttttgagacggagtctcgttctgtcacccaggctggagtgcagtggcgcgatctcggctcactgcaacctccacctcccaggttcaaacaattctcctgcctcagcctcctgagtagctgggactacaggtgcgcaccaccacgctgggctaattttttgtatttttagtagagatgggtttcacaatgttagctgtgttagccaggatggcctctatctccggaccttgtgattcccctgcctcggcctcccaaagtgctgagattacaagcgtgagccactgtgcccggccatgaaaccactttctttgctcctccatagaggcaactcctcatctgctgaagtttgatcatgagattgcagcaatcaattcagtcacattttcaggctccatttctaattctggttctcttgctgtttccacctcatctgcagttccttcctccaccgaagtcttgaaaccctcaagtcatccatgggggttggaatcaacttcttccaaactgatgttcatgttgatattttgacctcttcccatgaatcaaatgttcttaatgacatctacaatggtgaatcctttccaggaggttttcaatttacttttcccagatccatcagaggaattactttctgtggcaatgatagccttacagaatgtatttcttaaataagaagacttgaaaataaaaattactccttgatccatgggttgcagaatgggtgttgtgttagcaggcgtgaaaacgacatgaatctccttgtatatttccatcagagctcttagatgagtgacgaagtgcattgtcaataagcagtaatattttgaaaggaatctttttctgagcaattaagtctcaacagtgggcttaaagtatttagtaacccaatgtgctttcatccaggctttgttgttccatttctatagcactggcagagtagattcagcataattattagggctctaggatttttggaatggtaaatgagcattggcttcaactaaagtcactagctgcatttgcccgtaacaagagagtcagcctctcctttgaagctttgtagtcaagcattgacttctcctctctagctatgaaagtcttaaatggcattttcttccaatagaaggctgctttgcctacgttgaaaaatctgtagtcaccttcatcaatgatcttagttaaattttctggataacctgctgcagcttctacatcagcatttggagaagatttctttccttaaatctcacgaaccaacttctgctagcttcaaacttttcttctccaagttcctcacctctctcagccttcatagaagtgaagagagttagggccttgatctggattaggctttggcttaagggaatgtatggctggtttgcttttctattcagaccactctaactttgtccatatcagcaacaaggctgtttcactttcttaccattgatgagttcactggagtagcacttttaattttcttcaagaacttttccttagcattcacagcttggctaacccttcagtcacaagaagcctggcttttgacatatgtcagctttcaacatgccttcctcgctaagcttaatcatttctagttttcttatttaaattgagaggtatgtgactcactcttcctttcacttgaatgcttagcggctattttagggttattaattggcctaatttcaatattcttttttttttttcttttttgagacagagtctcgctctgtcacccaggcttgagtgcagtggcacgatctctgcttactgcaagctccgcctcccgggttcacgccattctcctgcctcagcctcccgaatagctgagactacaggcacccgccactacgtccggctaactttttgtatttttagtagagattgagtttcaccatgttagccaggatggtcttgatctcctgaactcgtgatctgcccaccttggcctcccaaagtgctgggattacaggcgtgagcccccgtgcctggccaacttcaatattcttgtgtctgaggaaacaaggaggcccgagaggagggagagagaacagccagtctttgtagcagtcagaacacacatgacatttactgattaagttcattaccttatatggggtgtgtggttcatggtgaacaaaacaattataatagtaacgtcaaagagcactgatctcagatcaccataacagatataacagcgcaaaagtttgaaatactgtattaccgaaatgtggcagaggctcaacatgagcacatgctgttggagaggtgatgctggtggagttgcttgacacggggttgccacagaacttcaatttgaaaaaaaaatgcagtatctgcaaaggacaacaaagtgaaatgcaataaaatgagatgcgcctgttgcatctttcaactgatgtgtcctttcttttcattaaaaaaaaataacgttctgtccatctgcctctgtccaacaacaggcagtcacatgtgatgcctactgttggagaattggtgaatcataggcctccacttctggtgctattactcagagaagaagtatttctttctgcatagaaggaaacattgtaattttactgcagcaatgaaattgtagtagaggtgaacataattcttctatttacatctttaatgagccacaattaaaagtagtgagttggcatgtcagagtgaatgtgttattttcagatttctgttagaacaatggctgctgctggttgaagctgcacttccctggccccttggagctccaaaagccttaagaaagaaacccaggggccgggcgcaatggctcaggcctgtaatcccagcaccttgggaagctgaggcaggcgaatcacctgaggttgggagttcaagaaccagcctgaccaacatggagaaaccccatctctactaaaaatacaaaattagccgggtgtggtggggcatgcctgtaatcccagctacttaggcggctgaggcaggagaatcgcttgaacctaggaggtggaggttgcggtgagcctgtgtctggagttggttccttccgataggtttgtggtcttgctgacttcaagaatggagccacggaccttcacagtgagtgttacagctcttaaagatggtagggacccaaagagcgagcagtagcaagatttattgtgaggagcgaaagaacaaaccttccacagcgtggaaggggacccgagcgggttgtctctgctggctggcgtggccagcttttattcccttatttgtccctgcccatgtcctgctgattggtccattctacagagcactgattggtccattttacagagtgctgattggtccattttacaaacctcaagctagctacagagcgctgattggtgtgtttttacagagcactcattggtgcattttacaatccccttgtaagacagaaaagttctccaagtccccactcgacccaagaagtccagctggcttcacctctcaataccacttctgcatttaattatagccaccgactagctgcactatgatattaatctgggctacttgcttaggaacctgcagatgggtttccataagctagacattgctgcctgataaatgactgtgggatacaggttttcctgatgaggtagtaaagccacatattggaattcatttaacagctcgacaacataatttgtaaacatttctatttagtcacgtgtactcagcaaaaatgtatactaaagtgtttaccatatacttggcattgaagggaattataatgaaatatgttgatcttggtcatttataggtgttcccaccactgtgatgtgtgcatgcattgtgggccaggaggttttatctggaagctagtgacacttcagcgtcaaggcgtctcgctcctgcaggccctttgtaagaccctgtacctaattttatgttgataattttgtgcagtttttttttttttttttttttttgaggcagcgtctagctctgtcatccaggctggattgcagtgttgtgatcttggctcactgcagcctcaacctcccaggctcaagtgatcctcccacctgagccttctgagtagctgtgagcagatacatatgccaccatgctcagctaatttttgtatttttttgtagagatgggggtctcactatgttgcccagttttgtcttgaactcctgggctcaagcgatcctccacttcagcctcccaaagttctgggattacaggcgtgagtgaccatggctggcctttgagatcttttcttaaagaccctaacaccccatacacactcctctaccccttgactagttttataaactgcagacctcacagactggatccacccctgattatgaatatgtttaaactgtgcatatgtatgcattaattaaaacatatttatttctctttcatactagtatgtgaaattccaaaaaatctgctagcccacaaattaggaaaattaaagggctatgcctacctctgccagctgtttccaaggaaatttatatcttggacatttggcagataataatatcatgtttgactgatagtgatcatgtcctaaatttcccaaactgatgagtcacaatcgtgattcacatatttctgggaatcgccccccaacaacttgcgatttgcctggcgtagctgtagtatatcagagttttttaggtgtttagcagaactgaactatatagcttcttgtcccatgccaattcaagaaaattaatttaatagctattttatgaaacattttttcctaactcgacatggatattttaaggtgattttccctgctaagaattcacttgttataggtgactctaattggagaaacagctgttgacttctagtgtgctcaattagtttctttcttcctttttctttttttattttattttatttattttttattatactttaagttctagggtacatgtgcacaatgtgcaggtttgttacatatgtatacatgtatcatgttggtgtgctgcacccattaactcatcatttacattaggtatatctcctaaagctttccctcccccctccccccactccatgacaggccccggtgtgcgatgttccccttcctgtgaccaagtgttctcattgttcaattcccacctatgagtgagaacatgcggtgtttggttttttgtccttgcgataatttgctgagaatgatggtttccagcttcatccatgtcccaacaaaggacatgaactcatccttttttatggctacatagtattccatggtgtatatgtgccacattttcttaatccagtctatcattgatggacatttgggttggttccaagtctttgctattgtgaatagtgccgcaataaacatacgtgcgcatgtgcctttatagcagcatgatttataatcctttgggtatatccccagtaatgggatggctgggtcaaatggtatttctagttctagatccttgaggaatcgccacactgtcttccacaatggttgaactagtttgcaggcccaccaacagtgtaaaagtgttcctatttctccactttcttcctttttcaaagagttcctttattattcccaggccgtcgttaggtgtaaaagctaatttagtttagattattttttaaagtgcacctggcattcaagctatgacatttcctgttgaaacagcactgctatgacctgggaagaaaagatcccaagaaaatataactgaggaatcaaatatttgtctgtataaaaggtttcatattaattcatgataccatttattagtcacttaccttttatgttagtagccataaggaggtgtgatggcatagactattcagggcgaatgacagttgtcatgggcagaaggtgcccatgcatcaggcagagcagggtgaccacaaagtggggagtggccaaatatactttgtcctactcaagacatgagggcctgtcccagtggcttgcttgagaacaaagctcatcctgatgactcagcagccacagtgaagggctgcctgggggctgggggagaaacaagtaggcagatgaggtccagttggaaactaaattgctttgggaggaggagagtggtcacacaatgtaggtttcagttccggctgcactgctaattttgtaaccttgggaaagttaccaacctctctggaatctcagtttcctcccctatgaagaagaaagcagtagcccagatcatccttggaggttccttcccttcagctgtgacattttgcatttgaaagagtaagagaagtcacaggaccatgggaaaggaaaacagaaatgatgtaagggaggcaggtcatggggagggtggtcaggaacacaggttggaagtgcccgtggtgtcaattcaggtgttcggtgatctccacgggcgagtgacttttattgggagaactgtgcactgcctgaggttagggttgtgctctggggaaaccggaaccttgaaaacaccttgtagggagccgcgtttcccttgcacggactgtgctgcctgtgcttccccagcacagtgggcgtcgtcgctttgtgtttgtgctggctgctgtgcggggttgcctgcctccccagcccacacctgctcagccttcctccactcatgttttcaggatgcttttggatgcttctggctacagtggattttccttctccttctgaagcccttttgaaattatttctctgcagattcagacatatttatttatctggtcaatgtcctgcctaaagaatcagataacgactgtgtttttgcctgaactcacacatatgaatgagcttttgtaagcggcagcagcagtgtaggtttagttggagctgtctgagcccttgtcaggttgctacttagttgtttagttagctctcgttgaacttctgtcacatcctcagtttctgggcagtgtgtaagaagagctccttctctctagaccagtggtccctaacctttttggcaccagggactggtttcatggaagacagtttttccacagactagggtggagcgggggatggttttgggatgattcaaatgcatttatattcattgtgcactttatttatattattatgttgtaatatataatgaaataattatgcaactcaccataatgtagaatcagtgagatccttgagcttgttttcctgcaacaaaacggtcccatctaggggtgatgggagacagtgacagatcatcaggcattagattctcataaagagggtgcaacctacatccctcacatgtgcagttcacaatagggttcacgctcctatgagaatctcatgccgttgctgacctgacaggaggcagagctcaggtggtaatttgaacaatggggagtggctgtaaatacagatgaagctttgctcattcgcctactgctcacctcctgttgtgcaggaggtctgtagcccaggggttgggaacccctgctctagagcttaataatcaactggtggagaccagtgcaattgtaaacaaaagtgacaaaacgatagtaataatgccaatggtaatgaaagctacagacattttcagagtgctgtgtctccaagtactgagctgagcactctgcactcatgaaatatgtatcctcctcacacacacacacgcaaaataaatgtttaatggaatattgatcaggaaaaaaacaaccagtaagcaaagtattaatacatgctacaacatagatgaacctcaaaacatcatgtgaattgagagaccacatacttcaatttcatttatatgaaaggtccagaatagacaaatccatagagacagaagttagtttgggggttgcagaggccggaggtgggagaggaatgcagagtgactgctaatgtacacagggtttcttttttggagaagaaaatctaaaattagattgtgatgttggttttacaaaacagtgactatactaaaaaacatttgagttatacacttgagttatatgtaaattaaatcttaataaagctgtttttttaaaaataaatgtttaattctcagaaacaaccctatgaggtagggagtattatcctcctacagatgagaaaaccgaggcccagaaaagaggagaacctgctcaagattacatataaggcatatgtaggattaactttttcattacagagaaatccatggtagtgcttgctaagtaaatgctaaatctattgattgcatggatgccagaactagatggggttagtttagatggattaagggaggaagtggtttaaactgtgttttctaagaagaaagagtagtgattgtataaagaagacaaaagggcatttcaagctggagataattgcttgtgagagttaaacatcaagaaaccagacatctaataggtttgttcaactggagtgaagaatagcctttcatatgacaggtaggtaatcagaagcaagtgaatttagagttatattgttagctgtagtgcgggcttgctgtaattagtagcaggccgacaccttgtaacatctctctggagtgtaaagacatatttctaacagaaatgtgttagtctgcaaagcaaataaggtgcaagcgtaaatgtcctttttccttggactgtctttaccgaatgacatgagcttcacacccttgccttgagctgtcactatcattgcttcactttctattaattagctcggagccttggttctatagtcaacttgaaactgctctggacatatttgctctaatcctcctggacaacctgtgagatgtgccttttcctacacttctgccttgccctggcagccacatgacacactctcgcaaggcaggaacctcagggaggggaggtggcggtgtctgttggcaagtactcagctccctttgaggctgcagatagtaggcattggttaagagtttaaacttgggcaagaactggaagcaaattgggaggacctggaattgtgggtgcttggggaaaaacattacaatgaggactcatatgggtcgtgtggtcatgtttgtttcaagggctttcccttccaaaactggaaaagaaaactgataaaacaaacattgggtggcatttttttctaggcttgtcaatgggtgacttgtttgccgaattaattaaataattaattaattaccttgtttataatcttccttgttttgaaaagatttatggcagtgccttaaatctgtaaatctacccaacaagagaatcttatgaagtaaacaagttaacaggtgaaacatgcctccttttaaatgtttctttataacaaaatgaccatatatcaataacagactgtaacaatgcgtagcaaatgtatttatgtttctcatctattttccactttcaaaaatgtgcttttcccttaaactccaaattgtcttaacaatttcacattttcatttctttcttttcttttttttttttttgaggcggagttttgctcttgttgcccaggctagagagcaatgacgtgatcttggctcactgcaacctccacctcccaggttcaagcgattctcctgtctcagcctcccaagtagctgggattacaggcgcatgccaccacacccggctaatttttttgtgttattagtagcgacgaggtctcgaactccagacctcaggtgatccattcacctctgcctcctaaagtgctgggactacagatgtgagcctggcccaatttcacattttctaggttctgtagaggttcatgtttgtggcatggtaattcttgttttttgcattttttttttcttaacccccctcctggcttttggagcactataaacttagcactggtggggccacatcttgacagcgagacccttacagcccccaaccccgcatcccagtggggcttcatgatctggccctgctgtgctggtggcatggccccctcggggcttaagtgattctgggtcattgacaagaatcttgcctgtgtgaattcaaatcaaaactttggagagcaaagattcagtgttttccttctgcctaacaatctcatggaaagcacagtggtacctagcatttagctcatgtgttcatttagcaggctctaagtcatcttgtcacatgtcatcctcatgtcagctctgtgtggtgttgtcgacccacgagcaaacgttgcaaggtcccctttagggtgacaaggctgattcaggatgtgtctcactgccccaggaaggatgcctctaacatgcggaacatggtgccagtggctgaggggattagttggggaagaagagtgaatagggaaaggaggttgttacatgatccacccctcactggccagagaggaaaaggaaggcatctcattaagagcattagctgtagcctctcatttaaacctcctcactaccccatgaagtaagcattattgcttttgttttacaggtggtgtgagacaaaagtgaaggaatgagactaattaataataagaatccatgccccaccatagctacgatgcagtggagcatggattctaaaccagctctaacatcacatgccctattttcgagcactagtggcttatttctgagctcttctcttcctctttcctgttgatgcttgagttttagttatatcatggcaaattgaaaaattcttcaaaaaacatacagaggaaataaagtggtgggatctgaaacaaaactcttattgattagccattctaatgaagatttgtggctgagatgggagttttgcaatcaccttgggatttcagaaccctgcttttaataattagaactaaagaagggagagtcctatagaagtgtgggtcataaaaccaaggatgtgaatgaggagtggcaagacaggtatcctggagactttatttcagtgagacttctggggcagagttgggactgatgggggacaagtcagctttggaatgatacagaatttttggctgtgacacctgtgtgattttagtgctttgcaccatatcaagagctgagcagagtgtggcaccaatattcaagggactcaaggggcaaatataggtgtcagtgagtgaaagcagatagcgagatttgcaatgcagtgtccaggagtgtccatctttctagacccatttctacttataagatcactgcataccctgtgaaacattatattcatgaagccacagagtttgagccactgtgtttacgctgcaagtggaaggagagtgggcatggagtcagaaagactcaagttcaaatccagcctccataatttatcgtctttaagaccctgggaaagttgacctaagcctctgttttctcagctttaaaacatgaataataatcctgcctcacaggactgctgcacatacggcagtcagcgcagtgccaggcacacacgagtgtcttattagttattattattatcaacaaagagcataggtgatccttcttatcatgattataaaaactgtggcttaccaatgaaagggtccttcataagccaacaaagagacatccctgaaattttcactatagcagaaatgcaaattattactgggtacatttctggcagacacatgagccatttacataatgaaacctctctaatattatttctattaatagcaatacttctgagtatcaatctgaccattttgtatttagaatcattctctctgtgaacagattccttttattgccatgtcgtcttaatatcttctgacaagtatcattatctctttgctgcatattctaatgtttatgattgcatgagttttaaagtgttcatttactacctgagaacctccattttaataatgcattgctttaatgttggtgtttgggaggtaaggttgttgcttattttctcagatgccgattcacagttgagcagatgatgacttgcaggaggctctcttgacctgtcatgctctgatatcatcaatgcattggagtggtcacttctgttagcttttcctccatgaatcccctgttgatcagcccactaagtgactcagcatatgtctgtgcacacctttggaccacattatcatccactcacttaggcccttgaatttttttatgggtatgtgggctatattgctaagtgataaggctggttctgtaaatggacctcgcaacttcagcataacaacggtatggctagtgtcctcctctaggagggactccccttgagggcagatacaggtttttcctgtttgcctcaagagagtcatacaatgcagaagtgcccaagtgaatgttgggtgaatcagtgagtgtaagagggcacccaagggaatgcccacagttggaaggaagttgcctgagaggaggagtcctcagacccattctagctttgtgattctgcccgtacagacatgatttatatgacaggaaaaacatggcaggcccttgggaagcattttcatcttaacctttataatatctaataaatgggcaagatgttaaaaaaaattgccctttccagaagaaggttatacagactctaagaaggcaacattaagaaatttttgaatttttttttttttgagatggagttttgcttttgttgcccaggctggagtgcagtggtgtgatctcggctcactgcaacctctgcctcctgggttcaagcgattctcctgcctcagcctcccaagtagctgggattacaggcgcacaccaccacgtccagctagttttttgtatttttagtagagacagggtttcatcatgttggccaggatggtctcgaactcctgacctcaggggatccacccacttcagcctcccaaagtgcagggattacaggcatgagccaccttgcctggccgaaatatatatatttttaaaaaggttattttcatcccagcactttgaaaggccaaggtgggcagatcacaaagtcaggagttagagaccagccttgcaaacatggtgaaaccccatctctactaaaaaatacaaaaacaattagctgggctggtggcgagtgcctgtaatcccagctacgcgggaggctgaggcaggagaattgcttgaacctgggaggcgaaggttgcagtgagccgagattgcaccactatgctccagcctgggtgacagagcatgactctgcctcagggggaggcggggagaaggttactttcaaccccatgaaaaagtgagcaaaggacatgaacagacacttttcaaaagaagacatatggccaataagaatatgaaaagcagctcaatatcgctggtcattagagcaacgcaaatcaaaagcacaatgagatactatctcataccagtcagaatggctgttgttaaaaagtcaaaaaataaccagttggatgctgatgaggttgcggagaaagggaacacttatacactgttggtgagtgtacaaattagttcagccattgtggaaggcagtgtggcaattctgcaaagagctaaaagcagaactaccattcgacccagcaatcccattactgggtatctacccagaggaatataaatcattctaccataaatttagacacatgcacgcaaatgttcattgcagcactattcacagtagcaaagacacagaatcaacctaaatgcccatcaatgacagattggacaaaaaaaatgtggtacatattaccatggaatactatgcagccataaaaaaggaatgagatcatgtcttttgcaggagtatggaaggagctggaggccattatccttagcaaactatcacaggaacaaaaaactaaatactgcatgttctcacttacaagtgggagctaaatgatgagaactcatggacacaaagaagggaacagcagacactgggtcctacttgagggtagagggtggaggaggaagaggagcagaaaaaacaattattgggtactaggcttagtatctgggtgacgaaaccatctgtacaacaaacccccatggcatgagtttatctatttaataaacctgcacatgtacccctgaacctaaaataaaagcttaagaaataggttattttaaagactatcctaatgcatttgtttgtgtgtgaaatatggttttgctaattagtattctttattgccagtaaaagtaactcactagagggagcttctaagaaacggggattttgatgagggcacgtggatatcccatggattttagggacgggcacggctgggccttggggaaacaaaacaaaacaaacaaataaaccaaaaatcaaaaccaaaaattcacattgaatttggagtttgggtcatattgtatgaacaggactgcttccacctgcattaataggcaaattccagaatactgggtgctgaatgaacagtccagtatggatctgtacggaggctgtaccaaggattggtgtctgtttatttttatttgtgctgctattgaagattttctaatcattagtgctaatattgcaggagaaaataattaatgaaggtgtctactgttctattgtagtaatttctgtttgcagggctcattaacatctttgatcagaatgagcagctcttttctggttggaatagatgaaaattatacaatgtatggagccattcttcaccttgtccttgtttcttcttcatgttgcttcgacttattgctcacaagttgacctcccccttagagctggggtggtccagcagggctgcgttgtgatgtgtattccttttgtgataggagacttgctgagagaggatcctgtttttttgtttgtttgtttgctttgagatggagtcttgctctgccacccaggctggagtgcagtggcatgatctcagctcactgcagcctctgcctcccaggttcaagcgattctcctgcctcagcctcccgagtagctagtatgacaggcgtgagccaccacacccggctaatgtttgtatttttagtagagatgggatttcaccatgttggccaggcaggtctcaaactcctgacctcgtgacccgcccacctcggcctcccaaagtgctgggattacaagtgtgagccaccgcgcctggccgaggaccctgtctttaatgggatgttgggtgatatgtatgaaatggttcaagaagcagatgggaagtgtttgggaggcctactgccagtggctcagtgtagccagggaaaaacagacacacctctgtgccatctctcacatcttagaaggtaacattgagtttgctgcatagaaccatacagttctaggtcacctgaaactcagagctcatgtgatctaaacttctatatttaaaggaggaaagagactcagagaagtaaaaatggcttgaccaagaagtcagactggaaccagaagtggacatatggactcctcattcctgttccagtaccgttgctgccagttcacattgtctttctaaaatagccatttatagggccacagctccatctcaaacaagggcttagtatctgtcagtttgcgaggtctaccataacaaagtaacccagactgagtggcttaaacagcacaaacttattttcttatgattctagagacagtaagtttgaaatgaaagtgtcaggaaagttggttccttctgaagtccttctccttggcttgcagatggccatcttccccctgtgtcctctcgtgggcttccctccaagtctgtgtcccagtctcctgttacaaggacaccagtcatagtggaatagggccctttcatatgaccttattttgttttaattacctctcaaaaggtccaatttccaaatacagttatattctgagaaactggaagttagggcttcaacacatgaattttgagtggttgtggggggaaaaaattcagccagtaacagtatccataagttaacttgattcattagttgattaagtatgattaaaccagctgggcgcagtggctcatgcctgtaatctcagtactttgggaggccgaggtgggtgggcacatcatctgaggtcaggagttcgtgaacagcctggccaacatggtgaaaccccgtctctactaaaaaaacaaaaattagctgggcatggtggtgcgtgcctgtaatcccagctgcttgggaggctgaggcaggagaatcacttgaacctgggaggcagagaggttgcagtgagctaagatcacatgcaccactgcactccagcctgggcaacagaggaagaccctgactcaaaaacaagaaataaagtaaataaataaatattattaaactagattatattggttaccaagtctttacatgaccattttaatagccttttcagatgttaactttgcaataatatgcagccagctaattgaaaattctagtgccataaatgtttttaattgcttactatgtgtcaggcgttgtactaggcactggggaaaactgtaaataaaagagacccagttccttcctttttttcaggttgcagtctatcaggaaaggcagacatttaaaaagggtcttgtgaggactgttatgaaacaggaagtacgagtgccatttctataccttagtacaatcactcgttttaattcacatcttccatggtggcaagtttgcctcagtgtcagccggtcaattgccactcaaggggatcagaacatttatgtatctggaatgcttggtacctagagttctgaagatcactattctcattccaaatatgttttttcattgccagaatgctcactcagtgactggattagttatgtgtactctgcatttttcgaagaggggaaagctgctatttttatcatctagtagcattctgatgactccttgataacatggttactatacggaaccccatctgtttctctgctgggaccacatcttagtcatatttttgtccctaatgtctggcatcgtgcctggcatttagtaggtcttcagtaaatatttgctgaataaatgtatgctgattgaaaaattgcctgctattatcagctctctgtgcatgataaatgccttgcctctccaaagcgattgtaagcttctgagcaggaacaccatggtcacacatggtctgtctaactcagcgccttgtaaataataggaatgccatccctaaatccctagccccctccaggatggcctgtcttccttgcatctgggactgttgaagattcttaatgatggaaaaatcatatacaggttattgcatagacatacattaaaaaatgtagttcgttcagtgtatccctagtgggcctatggccataaattaacttgctcccagggtaggtagtactctcttcttcacttctgctgtaatcacagctgccttcattatagaatcatagagaagtgaattaaggtgaactttgaaagaaggaagagatgcagctcacttgatcgatgtgggagtgggagtgggaagatttttctaggcataaggatggcatcaaagaggcttggctgtttttccattcccagtaatcgttgacagttttttatttaacatttaaaaaagtgtcctccgaaccttaggctgttcaaaaacaagtatttcatggtagagattacgtcaaatgataagcgatgcattctgcgatcagtggcagaaacaaaggttgaagctgcagtttgatgagaatttaaacatacagaagtcaaaaaattcaggagttgaagttaaactgcaagtgtgactcagtcccctcgggcatatggtagtagcattttctgaattgtggcatattcagttaaatttaagcccttgtttttgcagagtcgttgtgtcaaggttgcaatgtgagcagtaactttagactttcacaattttttatattctcacccacagtatgtgctgttatagcatttgtgcactgaaatttggtatagcttataaaaataaaaaaatggtgcaatgctcaatctatggtgcagaatgtatatgattatgaaggaataacccttctgtttgcttgaacccgacctaatactgaaacaaaacaccgccacttttgcttttaagtaaataaataaaccatacattgtggcaaaaggcatacactataaaattgaccgtcttcaccatcaagtgtacattcagtggtattaactgaattcacattgttgtacaactgtcaccaccatccatctccagaactcttttttttttttttttttcttgagacaaagtctcgctctcatcccccaggctggagtgtgatggtgtgatctcagttcactgcaacctctgcttcctgggttcaagtgatcctcctgccccagcctcccaagtagctgggattacaggaacctgccacgacgcctggctaatttctgtatttttagtagagacagggtttcaccatgttggccaggttggtctcaaactcctgacctcaggtgatctgcccacctcggcctcccaaagtgctgggattacaggtgcgagccaccacgcccaacccagaactctttttattttgcaaaattgaaattctacccattaaatagcaactcttcttttcccttctcccccaagcccttggcaactgcttttccatttctatgacaatgtctactctagatacctcatagagggtgaatcatacagtatttgtccttttatgactggcttatttcacttagctgctatattattaataccagctttctggggatataattcacaaactgcagaattgaatggtttttagtctattcacatcggatatgtttttgaagagacagtaaaaccaatccttttttccttagttctcagacacacacatgcttcttatctggcaagtcccgttataaaaatgccatgaactaaatgggaacagaagattgggggaaatatctagattattcttagtttggttcagattaattgagatagccagaatatttttgtaagcatgtttgctttaatttaaatgtcttcattttgcttcctggagccagcaatatgtgattacttattgttgttcttatggggtattgtttgcttgcgtagttgattgtgatgagttggctagaaatttaacagaatggaaatttcttcaagtctggatttgttcaaagaacagtttgaaattgaccaaagcgatagatggaactgacacttgacttatttgagatctggagttcccagtaatgaatattttggtccaagtttgaaaaatggcatttcatgtttatgtactgctgataggaatattcattggtacaaccatttagaaagacagttaggtattatccagttaacaaaaacaaatgtgtataccctgtgactcagcaattttccttctaggtgtttcctagagacttctgtactgtataccacgagacatggaggctctccagcacagctttatttgtgttaataatggtttaaaaaaataaacccaaactacttgaatgtttattaaagtgaaataaacaaattatgatatgatcaaatgacagaacacaatacaacaatgaaagtgaatgatctaaaactatataggagcaatatagatacatttcagtaacctgatatgaagccaaaaaagttacgttgcagaaaaattcaaaatatgaatgattatttttgtaaaatttcaaaagtatgcatcattaaacaagtaaagtggaatttcaccctgagacagttaaaaaaaaaaggctagaagcttagaaagacatggattagaactcgtttttctctgttctgagagtacatgtggaaatgaaagctaccagctatttctgccattttaaatgctcatatgaaatttctaagtaccctgcatagtaagtctttaaaatatcacatacacactactggcaggctaaaaaccaacagaaagatggctgggtaaaaagaaatcatgcatgcagaacactcttacttttaaaaatttacattcctgaaatagaatttttggagagaagcttttcttgaatgatgttagattgaaggatataactaaaaatagaactgcagtctttaataaatgaaaattagtcaagattctaattagtacttcctgtgttcgatactaattttgtcagttcatttctttacttaatgtgggctgtacctattcgcacatcccttgtactctttgcttgtttggttatcgttatgagaccaccaccaaccaccaccaccaccaccatggtcatcatcatcatcaccatctcctagagcacatggttttatgagccctgagctaagctccttaccgtttaatgcaaacatgttcctccctcagggtctttgcattactctaaaataacaccctcatcagtttttatccccttcaccggtttaatttttccttattgcacttacacatacttgtttgtctttctcatttcactaaaatttgagagtgatgttaagtctgtggaagcagagcccatgcttacatctgtcacttgtgtatttccagtgtttaaaactgggcctgtcacacctagaagctcactgatcataatcagtgatcatcaagtgaatgaatgcctgaattagcccaacaactctttgaggtagttattgctgttactattctacagatttttaaaaatggtggcactcagatagattaaactactcgcccacatttacccagcttgtgggtggtggaggctagaattcaaagccagtgtgcctgacaccaaagcctgttgtcttaactactccacttttctgcctatcatctgctgctagttctcagtgactttttatttatttatttttgcatagagcatcttttcttcttttcgggctatcaactcatcatttgtttaattctttgttttttgtttttgagatggaatctcgctctgtctcccaggctggagtgcagtggcacgatcttggctcactgcaacctccattgcctcccgggttcaagcctcagcctccctagtagctgggattacaggtgtgcaccaccacacccagctaatttttgtatttttagtagagacggcattctccatgttggccagggtggtcttgaactcctgacctcaggtgatccacctgccttggcctcccaaagtgttgggattacaggcatgagccgccgggcctggccttgtttaattctctgtatgcacctttttgataaatagttgtgtctccttttagggctatttctgttttgcatatacaaagactttactcatatttcaggttcagccaatttcagcctcttgcagctaacgcccttgccgtgtttagtgctattgtctgggctctgagactgaagcaggtctgtgagagcagccgacaaggtgtcaagaaggaaggatgcaataacccactgagctgcgttatctcctaaatgcatgtgtctttatgccattgctaatggcatctaatgaccttgggctccgaacaggtgctgccttgtaatctgcgctcatttgtctctttctacactgctagatttactgaaataacatgaacagggaaagcaaatgctttcatggatgccaggaatgctttatttatcttttaattttctttcatttgtttcgggatgtagaagcccactttggagttgaaataaaacaactaatgttcagagctgaggttgtcaccctttttagtaggacctcagatctagaaagggccccagagagttctcctttgcttatagaggagagtgtagtcctgtgggaccacatgtggtgctggccagcggagtaggtgggggtcctagaacttatgcagcctgactccctttctggggctccttctgaaacccagtggcatcctccttggcactttgcacacccagctgtaaatacacctgtgccatggagggctaaagccttttgggggggcatatatgggccaactgatgatcaacaacctctgttttcttagatcatctagcttctttatataacgtacctcttcgacttgggttgaccaaactcagatgatctccttaaagatgcatattaaagattgccccaatttcttaggatcctaggatatgagaatcttcatctctctctctctgtctgtgtgtgtatgtgtgtgtgagagagagagagacagagaaatttgtcctaaggaaacaaccagagatgttgaaaaaagatatatatgttcaagaagtccagcacagcatcactaaacgatagcacaatatctggagaattgaatgctagataaatagattatggttggaaattatagttatgttaaatattcacatattctgtgtgtgtgtgtgtgtgtgtgtgtgtgtgtgtgtgtgtttgagagacagagagagagagagagaatatgtatgtgaatatttaacattttgtgtttacagcctttgaagactactgcttttcctctagcatagaaataagatcaaggtttctcctactgtaaaagtttggttgaggggggttattgttttaaaatcaaaataatactaatatataatgagctcttattatggtccagatgctgtactaagtgctttacatacatgtaaaattcaattgccacagcagcccaacagcatagtgttattagccccatttgacagaacaggaagttgaggctcagagaggataagcaacttgcccaaggtggcagatcttaaagtgatagagctatgttttttttttttctttttttttttcccttagagacggagtctcattatgttgctcaggctggcctccaactcctgggctcaagcgatccttgcccctcagcctcctgtgtagctgggactatagtgcatgttgccacgcatggctatagagctatgatttgaatccaagcagtctgactccagggcatgccccagaaattgtttattgtttccctgatcacagaagggatgtatatattcatttagaaaaactggaaatacagaaaagaatgcagagcagatcacgcatacgataaatatgaacatttttagtgtctctagtcatatagattttttaactgggatcatgctgatttactgtttgtgagctagctgcctgatatttaccaggggtctgtatattgtaaacatgctgctgtgtgattttcaagcccacacagtgtgatcttagggcctatcgtaagttttacatcactcatagatactgtaatttccatccataatctatttatctagcatttaattttccagatattgtgctatcgtttagtgatgctgtgctggacttcttgaacatatatatcttttttcaacatctctggttgtttccttaggataaatttccagaactagagctggtggctcaaatagtaaggccctttataaggcttttgatatgtgttattaaattactcttcttgagcacttgccaaccatgacaaagaacgttcatgtgtctgcactctggacaacactaagtactgtaattaaaaaaaaaagaaacaaacaaaaactctgccaatttgataagttaaaaattatatcttgttttaatttgctttttttagtgtagtttcaagtgagggtggatattttccttatgtttctctgttttttacatttcttttttaaattggccattcgtgttcattgcttatttttgtcttagaaagtttttccttttactcacaattacatgtatttattttgtattaaggatattaactctttgtttaatggtattggaaatatttttcccactttgatattttcctttgaattttacttacgttgatttttatttacaaaatcaaaatatctgtgtagtcaagcatattaataattttcaaaaagtgttttgctttttttttttcccacagttgaatcctttttttttttttttttgagacggagtctcgctctgccacccaggctgcagtgcagtggcacgatcttggctcactgcaacctccgcctcccgggttcaagcgattctcctgcttcagcctccagactacaggtgtgtaccaccacgtccagctaatttcttgtatttttagtagagatggggtttcgccatgttggccaggctggtcacgaactcgtgacctcaggtgatccatctgcctcggcctcccaaagtgctgggattacaggcatgagccaccacaccctgcctgaattcttttgttttgtttgttttactttaagttctgggatacacgtgcagaacttgcaggtttgttacataggtatacatgtgccatagtggtttgctgtacctatcaacctgtcatctaggttttaagccctgcatgcattcggtatttgtcttaacactcttcctccccttgtccctccctccgacaggccccggtgtgtgatgttcccctctctgtgtccatgtgttctcaatgttaaactcccacttatgagtgagaacatgcggtgtttggttttctgttcctgggttagtttgctgagaatgatggtttccagcttcatccatgtccctgtaaaggacatgatctcattcttttttatggctgcaatttttttttaatttttttttttgcttttatacctagaaaagccttccattcactagggtcagataactatttacccacaatttattgtagttctttattatctcatagtttatatttatcgtttattttgatgtgcgatcttagacatgaggattcaatgaacttttgtcaaatattagatcagttgttctcacattatgtatttattagtcttttgccccactgagaggagacatcatctttattaagtactaataaaaactaaatgtttttagaaacatgagtatatttcttttttttttttttttgagacagagtttctctctattgcccaggcaggagtgcagcggcgtgatctcggctcactgcaagctccgcctcacgggttcaggccattctcctgcctcagcctcccgagtagctgggactgcaggcgcccgccaccacgcccggctaatttttgtgtgtgtttttagtagagacggggtttcactgtgttagccaggatggtctcgatctcctgacctcgtgatccgcatttctaagccttatattctgttatcttgatatttgttttttttctattttgcttttgattctatgagtttagaagattttaatataattagattctttcatatattttttttcagcatttattagctatttttagtctatttattctttcatgtgtacatagactaatttagtcagattttaaaacatcttttcaaaataaaatttaatttaatagattagatatcaattcagagagaatggaagtctttactgaactcttgtaatttttgatccatgcacaatgtttttcctttagttttttagtaatgcattttctgtttttatagaatctgagcagttcttgttttctttagagattttacagtgttggttataattgtgcacttaatctttattttccttatacagtagtccccccgatcaactgggggcatgttccatacccctggtggattcctgaaactgccagttagtaccaaaccctatatagattgtgttttttcctgtacgtacacaccatgataaaattcaatgtataaattagagattaacaacaataactaataatcaaataaaatacttatataaaaatatactataataaaagttatgtggatgtgatctctctcagtctccaaatatcttcttgtactgtactcgcctattttcagacagcaaattgaccaataaataaaaccatggaaagcaaaaccgtggctatggggagactactgtataagggaaattttcacctgattatcattgcgttttaggaaaactattagtatgtctatgtaagtgtgtgtggaggggtatatgtatatcttctagtaactgaccattatatataattattaatatataatatatataattttatattatacattatataatatattttatataaatatataaaatattttatatatagtatataatatattataaaatatattatatactatatataaaatatattatatatattttttgagacacagtctccttctgtcacccaggctggagtgcagtggcatgatctcagctccctgcagcctctgcctcccaggttcaagtgattcttctgtctcagcctcccaagtatctgggattacaggtgtgtaccaccacacctggctaatttttgtatttttagtagagacagggtttcaccatgttagccaggctggtctcaaacccctgacctcaggtgagccacccaccttggcctcccaaaatgctgggattacagatatgagccactgtgcctggtcaactgaccataatattgatctcagttctagagtctttcagctaattcccttagatattctaagtagacaataacatttccaataatgataattttgtctcctgtattttaatatttttaacttttatttcttctacagcatcctgatggtatgccaaataataatggaagagcagatacaaatacacttgactttattcctgaatttaatttttttttttcttgagacagagtcttgctctgtcacccaggctggagtgcagtggcgcacgatcttggctcattgcaacctctgcctcccaggctcaagtgattctccggccacagactcccaaatatctgggattacaggcatgcaacaccatgcctggctaatttttgtatttttagtagagacggagtttcaccatgttcaccaggctggtctcaaactcctgacctcaagtgatccacccgctcagcctcccaaagtgctggggttacaggcatgagccaccgcatgcagcctgaatttaatcattgactcttgtttttaacttttaatataatattggctactggtttgtggtaggtatcttttactgtggcaaatacatagtattctattctaattttcaaccctctttcccacagaatatttaagagaaaacctttttggccgctttgataatgataatttttgtctattgaatggtgatgctgtgattttcaggatgtatgtatcatggaaactggtagagaaagaaagaactgagatcatgctgaagtatactggggcccaccaagaggtagagctgagtgcaccaattgtcaccaaaatggcaacccgtaaaagagaaccattcttaagaaagagtcatgtaccatcaagcggggatttccagaagcctctgatagtaacagttctcccttccattcctttcctctctactttcaagatgcgatgatgacaaaaagactgacttgtcaaaaaaaccatgaaattccatacaaatgggcaagctgacatatagcagcttcggaaatttccacaatcgctcctctgagttgcctcaaggagaagaaaagtgagagaaaggaagggtacctttgcccccattaaggcacatgtagcatcctggaagctttgaaattacctgtccccaaagttattagaattatgtcattttttggttgttatattatgaaagcctccccacccctaaaagtttgtctataataatttttttgatcaggatttttacttcttaaattaatattaaagcattttaatgtttctagaaaatttgtcatttgtatttatattattttattttatttcattttattttatcaagacagggtcttgctctgttgcccaggctggagtgcagtggcacacgatcttggctcattgcaacctctgcctcccaggctcaagtgattctccggcctcagactcccaagtatctgggattacaggcatgcaacaccacgcctggctaatttttgtatttttagtagagacggagtttcaccatgttcgccaggctggtctcaaactcctgacctcaagtgatccacccgcttcagcctcccaaagtgctggggttacaggcatgagccaccgcatgtggcctgaatttaatcattgactcttgtttttaacttttaatataatattggctactggtttgtggtagatatcttttactgtggcaaatacatagtattctattctaattttcaaccctctttcccacagaatatttaagagaaaacctttttggccgctttgataatgataatttttgtctattgaatggtgatgctgtgattttcaggatgtatgtatcatggaaactggtagagaaagaaagaactgagatcatgctgaagtacactggggcccaccaagaggtagagctgagtgcaccaattgtcaccaaaatggcaacccataaaagagaaccattcttaagaaagagtcatgtaccatcaagcggggatttccagaagcctctgatagtaacagttctcccttccattcccttcctctctactctcaagatgcgatgatgacaaaaagactgacttgtcaaaaaaaccatgaaattccatacaaatgggcaagctgacatatagcagcttcggaaatttccacaatcgctcctctgagttgcctcaaggagaagaaaagtgagagaaaggaagggtacctttgcccccattaaggcacatgtagcatcctggaagctttgaaattacctgtccccaaagttattagaattatgtcattttttggttgttatattatgaaagcctccccacccctaaaagtttgtctataataatttttttgatcaggatttttacttcttaaattaatattaaagcattttaatgtttctagaaaatttgtcatttctatttatattattttattttatcaagacagggtcttgctctgttgcccaggctggagtgcagtggtgcagtcatagctcactgcaaccttgaacccctgggctcaagcaatcctcccgcctcagcctcccaagtagctgggactgcaggtgcatgccactatgcctggctctttttcttttttaacttttttgtagagatggggtctcactatattgctcaggctggtctcaaactcctgccttgagcaatcctgcctcagcctcccaaagcatggggattacaggtgtgagccaccggacctgaccatttctatattcaaaattttgttaacacagtcaaatattacatattttaaaaatttaaaacattctcaatatttgtgaatttattccacttcttatttttaatttggtttgttctctgaaacttaagattagctagcagtaagtcaatcttatttttgtatatattttaaaacattttgtatatattttaaaatatatgcaaaaataagatagacttactgctagctaattaatagccttttaaaataattttttttttttttttttttttttgagacggagtctcgctctgtcgcccaggccggactgcggactgcagtggcacaatctcggctcactgcaagctccgcttcccgggttcacgccattctcctgcctcagcctcccgagtggctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaaataatttttatctcacatttggatagttttatgtgcttttcctttatattgcttttcttaggtttatttccctttctttttttttttttttaagacagagtctctctctgtcaccaggctggagtgcagtggtgcactctcggctcactgcaacctccaccttacgggttcaagtgattctcctgcctcagcctcccaagtagctgggactacaggtgcgtgccaccatgcccagctaatttttgtatttttagtacagatggagttttgccatgttggccaggatggtctcaatctcttgacctcgtgatctgcctgcccgacctcccaaagtgctgggattacaaaggtgtgagccaccgtgtcccacccccttttctaatttattgagttgatcttttatttttaatttttcttaatgataaaaatactaaagatatttgcctctgactgtaagctgcctacactttgatacataattttctcattatctttattgtctcagtctgtgattccataatttattatcttttatactctacacctatttagaagaattctttttgaatgtacaagttaatttgaattgtttacacttctgtctattaatgagttttgttgcattgtggtcacagaatattgaaaggtagtaaaatttattttatgttccaatacaggattcatttttgttaatgttccatgagcccctgtatagaagatgcatgctctaattaaatctaatcaggcttatcttgtcatcagatctgccatatttatgattttatcctacttctctatatctttattaaattttcatctgctggccgggcgcggtggctcacacctgtaatcccagcactttgggaggctgaggcaggcgcatcatgaggtcaggagatcgagaccgtcctgactaacatggtgaaaccccgtctctactaaaaatacaaaaaattagccgggtgtggtggcgggcacctgtagtcccagctactcgaaaggctgaggcaggagaatggcatgaacccaggaggcggagcttgcagtgagccgagatggagccactgcactccagaatgggcaacagagtgagactctgtctcaaaaaaaaaaaaaaaaaaaaaaaaaaaatttcatctgcttatttttccaaggactgaatgcagtggggtagactttaacattattgcatgtctctcaatctctgttttattttctttatatatttccatgctctactatcttgacacatacaattttgacttaattctttggaatgtatctcttgtcagtaaaaatttcacccctgttgaatgctttagatatgtaatactgattttgtattaacagttgtaaaactgtcacttctaaatgtgcagtttcctggtattcctttgccccaatcttcttgtaacttttatgggtttcttgcagatagtctaagggcattcttaatttatgacaccatctgagattcttttgcttttcaaaacgaattaatacctgtcttcaatgttgatacgcttattctaatttttgtcatctttttattcttttggttttatgattccttgatatttccctcattttccattttgtgtgatatgatttactgtctgtaatactcataccttatatttaatcttctagttgtcttcttaaatttgactaaatatgacctatatttctgtatgagcaaagtgaggaagctggctgaccatacctcctccctgtataagataagattaacacattttattctcctttggaattctccttttcttttttaaagttagatatagacatatagatgttttgatccagtttatgattacttttaaatattatgtaacttttcttaataaggattatctatatctgtgttcctttttataacgatattcagttgtttgttatatgctctccttatatgtgtatatatttttctctagagacagggtcttgctctgtggtgcagcctggagtgcactggtgggatcataactcgctgcagccttgacctcctggctctaaaggatcccccacctcagcctcctaagtagctgggactacaggcacacagccccacgcctggctaactttattttttttttttttttttatagatgacgtctcgatgtgttgtcccgggtggttttaaactcttggcctcaagcaatcctcccacctcggcctcccaaagttctgggattacagggatgagcccctgtgctgggcctgaatccatattgtgaactgttttaaagcacaactaccccttttctttattgtttaaaattaaatttttgattgattagggagcttcttcaaatatattctatgaaatacattgtgtttttgttgctccttgggatccaagaatgccttttttattttttaactctcataccttagtaggaaagttggttagtttggaatttttgtatcagaaccctttgccattagagctgtgtagttgttttatttcttctattgtcagaaatctgattttttttccaccttggtgacctggttacctgtatttcttttcctcctcactgaatgcttatgagttgttttgacctcaaaagttgcaccagaaggtaaataaatagatggaagttttctttaatttattaatttatattaatatttatatcagttttcatttttttcttcttgtatagagtgagtttttggttggttggttggttggttggttggtttactctgtatttcttcagtttagaaaaattttctttcattatttctttaataattgcttctgtggtatttactttgactatgcatcaatcatgctatctctatgttggcttcctactttgtctcctgtatccattagcatctatctgatttgtttatacttttcatcttttttccagtgccttttgggagactttttcaggtttgttcttcacttgctggtttgatgctccaaaggctgtttttccttttcattgcatcgaatgtagttttaaataatactttggaaaatcagtcattgaaaaaaaatcctaatttttttttgtaagttggtgtttctttttgttttcatttacttgtcattcacgcctaagtctgggtctcctccccttctttttcctcctccttcttcaaaggtgcaaatcacatcttgtctgaaacttgtttctatttccagtagtaaatattttttgaaatcgtcttcttcctttatttcttggatgtttcttgttttgttaaccaagtccttataagcccaatgttgccagttttgggtctgctcatcattgaatgatgggagggctagcccgccctggaaattgttctcaaataatctctgtaccattagggaaaggttggactcctttcctcggtcttaagctgaaggctttgttcttaaaaatgtactagaccaggtgtgtttttcagcagctgcacaaatttgtagggagctggagccacagggcaatctctattggggttcttccttgcatggttgctgcttggcaatgggtgaagccatcgtgcaagagacagtggttctcattctgaacttctccctgaccctagcttcactccaagccccctttgtagcagaggatgcatttttctggcatcagagtcctgctatgtagagagacatctcacatcccaccagatggccatgggcatggaggacttatgcttggttctcttcttagtgccttccgaatgtgaatgccctggacaccagacactatctggtttgctagcctgctctcacctccagcgttcagtccattttaggaagatttctaaccagtgctctgtcagaatctcttcttgtttcttctcacagtgctgtgccaccttttcaagaaagagaatcccaacacacatttctgattcagccttttatgtgatgctttctctggtctatctaacaaaatgtcttaatgttaaaaatgctgggtgccctccttttttttcagcactggtgtagacttccccccatctttatatttgtgggaaatggatgttcagattgatgacgtgctctaaagacagagaggggaaatttacaaaacacaaatggagaggaatgtgaattttacaaaagtatttatggagttctctaaataatgaactccctcaggacacttagcacaccaagtaatgtaaaaagttaggcttacacgtagattgtcagacacacagcttttgtatattgtaagctacacctgtatccctgtaatggtccccaggagtatcacgctgcatggtccaattaggtacagaagaactctcaagtagcagccagtcactttgcctgtaataatgtttatgattcagagtggtgcccaattcaccctttgcacttttcccagtggcatttggcagctggggcctggttattcagcagattattgcttctccccagaagcttttgtgatccttgcaggcgctctcctactagggagagaagaatgccaacatattttaaggaaacaaagaataatagtgtcacacgtctttgaataagagtgaaaaaatagttctccccacatccaaacacagtgtagtcaaaattaagaagatagaaatcaagtgtgcatgggcagagggtaggtcataggcttaatgaacccagaagagctttatttattgacttctattttatcccttctcactggtccagctgcaatgattgtcaacaaaggtgacttagaaaaagagagaccttggagagagacagaaagagagagagctggataggcagacagatgtagagcaggtttgtttgcttggcagaacatccaagtcgcagatggttctagaacagaggtaatattgccagggttgcgtggaacagatctggactaaagctgaggcttgcaggtaaagccagtggctcccactccaatgtcattcagcacatagcaatttcagctggagatctgtttatagcataaaacagacactgcagacttttttctccatgagactttaatgtttcatttactaacaagattatatatgggaagtggatgtcataagaagactgtagaatcctattgtctcaccaccgattgaggggcctttgtctatagaccaagcacgtctttttcctcggatgccttgggcatttcagaccatgcccaaaaagatatgttgtgacctgcagacctgtggttgaccatattaggatctgtgatcaatttcttagagattttgggcataaaaaatgagcaaagagccatctttaggaatttggggatatgcttgacccaaggtatttttgttttctactaacacattttgatgtaaagcaagaagtggttttcaacagttgaccatggttgcctagagagatgggtacatattcatgtattttgacctatcagatggaaacaggcttcactcttagaacttccctttggatttcccacccaccccagacactgacattccattttgaagttacacatgaatataacactgacacattgggacatgctttccaagctcaattaccatgcagcgcaatatcaattaagtggatcatgaaacatgtgtctgattgtctcacttgcataatttacattttttgacaacacttaattctcccttatatgtccaggtttcctattttgtgatgcacataattgcagaacttgggagctagaatggaccttggagaggtcccttacgccaaccctttcacttcacagatgtagaaactgaggcttagagagggtataactttcccaaggccacaaaggactagtttacagcagagctgggcttatataacagggctgcctggccggacgcggtggctcatgcctgtaatcccaacactttgggaggccaaggcgggtggatcacctgaggtcaggagttttaaactggtgaaaccccatctctactaaaaatacaaaacattagctgggcatgttggcgcatgcctgtaatcccagctacttgggaggctgaggcaggagaatcgcttgaacccgggaggcagaggttgcagtgagccaagatcgcaccattgtactccagcctgcgcaataagagcaaaagtccgtctcaaaaacaaacaaacaacacacacacacacacacacaactcatggaactgtatactttcccccaaaattcaatttagggccgggcgtgatggctcatgcttgtaatcccagcacttcgggaggctgaggcgggcggatcacgaggtcaggagatcaagaccgtcctggctaacacggcgaaaccccatctctactaaaaatacaaaaaattagccaggtttggtggcaggcgcctgtagtcccagctacttgggaggctgaggcaggagaatcacttgaacccaggagtcggaggtcacagtgagccgagatcgcaccaccggactccagcctgggcgacagagcaagactgtgtctcaaaaaataaaaataaaaaaaaaaacccacaaacaaaaaaaccacaaacaaacgaacaaacaaacaaaacagggctgcccattatcccctgcatggctccagagctattcttaagatcctctgcactttggatcttaagataacattagatttcatagtatccatgaaataacttagacctggtcttggaaatacgtttcaccatccaggtacccatcacatgtgttcgcaggtgaggctttcttagcagcactatgtaaggagacatagtaaagaaatatttattgaatactgaatattgattgagcctatgtcctgtgctaggtgttctaaatatagaaccttatctcatcccataactctttgagttaattgtcattctttttgtttgtttgtttttgagacagggtctcgctctgtctccagagtgacacactgtactccaggctggagtgcagtggcgtgattgtacctcacagcagccttgaactcctgggttcaagcgatccccccacctcatcctcctgagtatctggactatatgtacgtgccaccacacctggctaattttttaaacattatttgtaaagttagggtctcacatgtttcccaggctggtcttgaactcctgggctcaagtgatcctcccatctcagcctcccaaagtgctgggattataggcatgagacactacacctggtcagtatcgttatcttggccattttacggttaagggaatatagacccggcaagtttctatagcttgttccagaccacatagctagtaagctttgaggctcatcctagggtcactgcttgaataacctgcatttttctactgtaccatatgtattctcctgctaatcttcttactgagagagatggtagttcttctaagtatcatatgatccaaaagttgcttaaccaagagctccagcatctgaatccctgagcatacctcttcccccatgcatcatacctgtttcccattctctttgaataattttgaattgtgagcaaatgttcttacaaaataaagaagagagtgtgtccctgcagcattgtctaagtgcagaggatcttaagaatagctctggagccttgcagggctcatgggcagccctgttatataagcccagctctgctgtaaactagtcctcttgtggccttgggaaagtcataccctctttaagcctcggtgtctacatctgtgaagtgaaagcgttggcgtaagggatctcctcaaggtccattctagctcccaagttctgcaattacacgcatcacaaaatagggagcctgaacatataaaggagaatttagtgttgtcataaaatgtaacttatacaagtgagtcaatcggatacgtagttcatgatccactaaattgatactgtgctgcatagtaattgggcattagtggaagcagttcacgtaaaagactataatttgtattacttttacaccattgcaacactttttattgttcctcagtccttgatttgttttctaatgtctctagtgtgtttaacactttctcttgttatgatatgcaccatacatgtgcatgtaatataattcacatatataacatgaaaacatctgattcccacatctaacagtcagacttccgttttcctcttttccaaaatccaggtggtcagctgggtgcagtggcttgagtgtgtatttccagcactttgtgaagccaaagtgggaggattgcttagggcaggagtttgagactagcctgggcaacatagtgaggcctcatctctacattttttttttttaatcagccaggcatggtgatgtgtgcctgtggtcccggctactcagaaggctgaagtgggaggatcacctggttccaggaggctgaggctgcagtgagctctgattgtaccactgcactctagcctgggcaacaaagcaagcctgtctaaaaaaaaaaaaaaaaaagaagagaaacaaaatccagttgtctgaagaggaacaacttcttcctgagacattttctttatttcttttaattttgttttcttttttttagatacagggtctctctccatcacccaggctggagagcagtgatacaattgtggttcattgcagcctcgaactcctgggctcaagcaatggtcctaccacctcagtcagttgagtagctggaactatagatgtgcaccacgtgccacgataatttttgtttttttttttttttttgagacagagttttgctgtgttgcccaggctggtcttgaattcctgggctcaagtggtcttccctccttggccttccaaagtgctgaggttacaggtgtgtgccatgtgcctggcctgttcctctttatctctttgtattgagaggttcttgagaagcatttccatctgctttccatcgttttctcccatgtgcagacttggttaaaagaccttgaggaatcccccctttacgaagccttatccatgagaggacaagataaggagacccttggtttgtggattcagcttccatggtcattcccatcagttcccaccacttctaggagagatagtatcactcgatgctgacctggaaaatcctggtagagacccaggaactcataggactcggtccccacaccctcatgccagtacctgtgtgacggagaggcgcccctttgcatggggtgctgcacaatgccttcgtcaatcttctgccactgtcctcatccccaccccagcctgctcacctcttcccctgtaccccacagccaccaggccagtttcacctggtggaacacttcccccacttcacctgctgtgcctcacctacttcctcctgcctgttctggtgaagcctcccgcgtcttttcttgtggtaatgctcttttctgcctctctaaacttctgccagtgtttttgtatttgatttttgaaattcaactcagacctccaaatgaggcctaagtcaagcctagcttttggcgagctcaccccatttatggtgggggcctgcctggtcacctgctcgtcttaaaacctgcctttccttatggaactgtgttttcaatgaggttctggccgctaagcactcaaggctgtgtacactcaactgttgggctgttggaggtctccccatgagaactttattacagaatggagtatggagcctggaaagggaaggtggcccagtgaggaatggtactgcattctcagtctctgggtgagttgaggcaggggaccagaaggagaggagggaggagtgggaaaggcttaaagcctcttggaaggagaaaagccaggggaaaggagaatggtaactgggaaatgggctaacctcagacctgcctttagcggacgcctggctcgagggcccaagacctcaagctctcagaaactggtaagaatcatgctgtcccaggtcccagtgaggtgactctaggtaggaggcccttagcagaggtggctgggtcaatcccagtcggctgcttttatcttttattttatcggcacttagaaagaaagtatggtgctccttctgagagggctctttaacattgcaatgggccaatcactttatatcattatctcataattattatattacattacattatattatgataattcctgttttgtaaatgagtagccgaagctcagttacatagcctgtccatggtcacagtggaacatgaacccagtttgtgatgtcaaagcatttctatctttatggcaagccttcataggaagcaaaagaagcttgcaaaagtaggagacgttaccttatcctctttccccgttcagaatttgggctgcggccaggctcagtggctcacgcctgtaatctcagcactttgggaggccgaagcgggtggttcatgaggtcaagagatcaagaccattctggccaacacggtgaaaccccatctgtactaaaaatacaaaaattagcagggcatggtggcctgcgcctgtagtcccagctacttgggaggctgaggcaagagacttgcttgaacccaggaggcgaaggttgcagtgagccaagatcatgccactgcactccagcctgggtcacagagcgagactccatctaaaaaaaaaaaaaaagaattttggctgctcactgatgttagaatttaaaagaaagtaaagtgatgcttcaattaaaaaaattaaaagcttaaaaaaattaaaagctttaaagtatggattttttttggtgggcggagcaaaaacagtgactgaagtgtattcatattgaaacactgtggtgtttcactggtgttcaagttgacagggcaggggtgggaaagaattacggagtagaaacccctggggcccaatggggaggcacctagagggcctaaggggaaggatcctacagatgaacttgaccttctttatgattttgcggaagacaactctgcttatctttcctctgggaccagtaaaatagctgttgggggcagatgctttgctgatgcttagtatacaaaagacagcttatatgggggcaatattaattttcttaagtcccttggcatggattctgaaaactttaagatttatgatttgagaaccctgactctaaaatacgtgagaattttctgcttgcaaaatagattacgcttgcacaaaatacgcttgcacaaaatcttctacttgtatttctactctggattgttgaaacaaattgattttttcttttttgagacaaagtctcactctgtcatccaggctggaatgcagtggtgcaatcttggctcactgcaagctccgcctcctgggttcacgccattttcctgcctcagcctcccgagtagctgggactacaggtgcccgccaccacacccaactaatattttttgtattttttagtagagatggggtttcaccgtgttagccaggatggtctcgatctcctgacctcatggtccgcccgcctcggcctcactaagtgctgggattacaggcgtgagccactgcgcacagctgaaataaatagattttaagtggctggctggctctcagattgcatcctgttagaaagtcagaatagaaaatagatgcattttagcagtgttggaagaataaactcaaagtcccctggaaatcctggaccccacccacctcttaccaagtatccagcaggaaccttcttccttactattgttataatacattctagccccagtaatttgttccacgtatctcattagagtgaagatagcaacatacttaaataagaatttcatttttcagttttagcttttgatgtaggctaaatgctctgtgtcacataacttagactacctacatgcctcatacactgataccctattttgaaattacacatgaatttaacactgccacgttgggacgtgctttctaaagttacctatgaaataacttagatccggtcttggaaacaccttttaccagctaggtacccatcacatagcttagtaggtgatggtggggtccttcgtttttttgactacccgtataatttcaggagcaagcctaattgttatgcctcctttgttattacctcccctagcctagataacatgccttccaaattgtattgagagtacacaggaagacaactgcagcaggcaaccagctctaacaactgcgtcattttctaagaatcaaaggaattacttgagtttctagttctggctttggcttgccagacatataccttaccccagcgaggtaaatgattcaatcatttgggaatgattgaagttgctgcctaattcataacttataggtgattaaacttgtaaagtattttgaggctgtttctttcattcatttattccaaacaaacatttgttgttgaatgggtagtgactttgattttaaaacactatacagacataaaatagtggcagcttgtagatagcaattttttaatttgctgtccttaaggaatttcgttaccaaatcctcacgaatcttgaaccttagaagaataatcctttcctttgttggagttttaaatttagaataatcagacaatagtgaagcattctgttcaaagcattccttttaggctacccatttattatacgctgctcttaagaggagatgaatttgattagcattgaacattcagtcagtgtttttgcatagctaatatcacggagaaattttcaaaaaaagttatgcctgctatttaacattattatacagtcaacttttaattatctgtattaatggaatgtaatcagtgatgtgttgctccaaaatcatttcctttggctttgagaagcaccggatgatgcttttattggtttgtggttttgcttagatagtattaaaattgtgccacatgtgtgcacatagctcatcttagggaggaagtagcccaaaagtatactgggggctagggaaaggtcaactggaatttttaaacctaccacagatacatatacaatggatgaccccaagattattcatcttaattattaaataaaaaacaatggccaagaattatataatggcagctgtgtaagaaaaaagacgcaatgaaccacatgtgagatttccatgtaggacacacattgtttcccacctttcccttttgaaatttcctgaaagtgaaacactctcataacactacagcagtgaacactgttagatttagtgatcctccaaatgcattttgctggtgctccaaataggcctcttgggggaacagaaggaacagaagggctgatgtcttgacatgttaatgtttctagataatgtcacctttaggtgtgatagctgttactgtttattattttttaaataaccctcttgttcccattcattcaagttaagctttttttttttttttgagacggagtttcactctgtcaccaggctggagtgcagtggcgcgatctctgctcactgcaacctctgactccctggttcaagctgttctcctgtctcaccctcctgagtagctgggattacaggcacgtgccaccatacccagctaatttttgtatttttagtagagacaaggtttcagcatgttggccaggatggtttcgatcttctgacctcatgatccgctcgcctcagcctcccaaaatgctgggattacaggtgtgagccaccatgcccggcctaagcttgttttttttttaatgaataacaatgatagaaggaaatctttggagggtttatcttcttagtagcggcctttcaaatttcaaaagtcttctcagtgcacaaatctgtttttgcatgaggctgctatagggccagcacttttagtcctctgtggcctgttcacctgagtgagtggtgacatttcttggttcataccttggaaggcaatgatggctggccctttagagtgaggtgaaggaagactgatccctgggtgtggaggtactgatgcataggaaaagaaaacatctttggtgacaccattgggtgtcagatcagtttttggcaagttggcaggaaagtctccaaatcagtggggtctggctgggcaccagcaagttggaagctgcattagttccttctgctggcatgtccccctgtcatctggccatagcctcatctgctcctactaccttgcaggtgcccttggggtaaagctgtccagatgcacatgaacccctcctcttttcagctggacaccaagccaggaaaaggagaggtgtgactttttgacggaggccagtttctatgtcagcagccttgccagtgaacactgcaaaatggtgtcagcctgcagcctttttgtgcactggagcagagctcccctcaccacatttgtgaaacaggttctgtcatggggcccaggtgtccttttctcctgccacccccactccagcttgctggccgccttatcattccacaccaggaagccagcatccttgagttgtccttacttcttatgacctgctgtgtagaaagagaggggaaaaccagtgtccgagtggctgctgtgggtgtggtctgggccgcgtagttttatatacgtaacaaccttctgagacaagcgttagtgactccttttacagcggatgaacttgagggtcaagccagtaaataatttcctcaaagtgacagagctggaaagtggtaaagttaggatcaatactcggctttgattttaaaatatgcatatgcatatattttggagatctggatataccacttccaaagtagcatattatactgaaatttcaaaagagaaaacatctttaaacaaaaggaaataactcttaattatggagtttcaggtatcaatgtgttgctggagggctgtgatcttaaaagcatgtcacattggcaacccgttccggcaggttgtgacaagctatgtagcatgcatgaaagcatcattcattttttaaaaaatgtcttcaccatttatttctttaattttttgttttaactttttatatttataggcaataattatgtatatttatggggtacagtgtgatgtttttataatgcatacattataacaagattcaatcaagctagttaatatattcatcacctcaccagtttatcattttgtgtgtgtgtaagaacattaaaaatctgtgttagcaatttacttcattcttaatggcagactcagcttctttttttttttaaatcctagactgttggcttctccttccagcagtgttgtaggactcagctgcctttctttgctgtccctggccagagatgtgtgcactcctggtctcctaataaaactttagcctatgctgggagccatggatttggcagcactgcctttagcatttaggaatatgtttctccttacatcaagaatagttttaggccaggcatggtggctcacgcctgcaaatcccagcaccttgggaggccgaggcgggtggatcacctgaggtcgggagtttgagatcagcctaaccaacatggtgaaaccccgtctcgactgaaaatacaaaaaaatagccaagtgtggtggcatgtgcctggaagcccagctactggggaggcagaggcaggagaatcgctagaatctgagaggtagaggctgcagtgagccaagattgcgccactgcactccagcctgggtgacagagcaagactctgtctcaaaaaaaaaaaaaaaatagatttatgctgcttgttgaggaccagcagtattctcaaccatgtgaggcattcttcgaacatgtgaagcagcattttcctggatgggcatttctgccataattgtgggcagaaaaaggtgtggtccacatatgcccaacagggccaaggggcaagggtgagcatgtacctatgtcttataccccggagattcttgcggctgacgaggttcccttacaaagcccaaaggaattctcctccttccaccggaggtgtttataacctctaatttgctcaccatgcttctagtggaaggagtaggagctcaatcccctgggaggctgcggcagagccagagcaggctggtgacccagagcagtggcactcccctctgagtgcatgatgcagatggagcaggagggggatgcaggtgggacaccctgcgccctgcaggtgagtgcacagccagcgagacacccaatcagggagcaggaaggctgtccctgtggcagcaggtaaaagagagagtcgctgagatgaaattcgtgggtgtgtgcttcagcttgtttgaacagctcctgtgcaagatcttatagtaaatgctgagcttctttgtgctctgtgcctgtcggtggaaggcatagcccttgatgaagatttctccttctacccatcttgcctttggaaagggctcccctttgacaaatgctgctgtagtatttgatgcagcctccatgaggtgctttgggtgggaagtggattctgacctcatttcccagaggaatttgaagtggaggggaaggactaattggtccctcattaaggacttacaatgaagtacagtatttctcctgaaaggataatctaagtcactggataaaatgcccaacacacttttaacgtgacataggaatccaaagtcatttttaaatcaaagatttttgtagttgtggagaatggctgtgttttaatgggatctttacatatcagcattacaaagggctccttcaaatgtgatgattttaatgtttttgctggggtttcacctgaggttccaaatacatatttccctatcatatttgcaggcatccagcacccgattttagatatgcaaatcagctcactttgtttaccaggctttggataggggagaaaaggaggtctgaggctgggcacggtggccacacctgttatccagcactttgggaggccaagatgagaggattgcttgaggccaggagttcaagatcagctttggcaagatagagacctcgtctttacaaaaaataagtaaaaattagccaagcatggaggcgtgcatctgtagtcccagctcctctggaggctgaggcaggaggattgcttgagcccaggagttagaggctgcagtgagctatgatcgtgccattgcacagcctgggtgacagagctagattcagtctctgaaaaataaaaaaacaaaataacggggctgcaaaagcttccttgacgaagaaggaaagtctctcgctcctgtttaacactgcctggctgggttccagctcactagcttaaaacgagaaggcaccaccactgtgattaaaataaggccctacttaattaaaacagtgtgagaatttaataagaggcataagacttcactgatagtcaccaaaaaatctcaaaaaggtgacttaacaggcattaatagcatatgttgcttgtttactctctgtcaacattccgttttccagagacatccttcgtacaggtgaaagtctctcattcctccctctcccctcactgcctgcctttcagccatttccttgctttttgtagttaaccagtaagaaagagaccataatggagaaagaacacactgactgtgtttcacagactgttgccctcatctccacttgtgttaaagaaggtaaattagttcccctccagattaacttcagcgtcagctgtggtgctttcctgacacttcttaacatttgaacagtaccacattctgtccgttttatcgttgtctcttctcataccctgtatttgccaattctgtactcatgcccagacagatctataggtatatgtaggaggatgatgaagaacgggccgattcgtagctcaccctttgagccaggaccaaaggtttgggagtcttaggctctgaccttattcttttggagaggaaagaatcattttcctttaagcctaagtctggcaaaatctaattacaaagtttttcgattttgctattttaaaataaaagctaagccttccccccatctaatcagccctctcttcctctgcttctaatagtgaaggaaataaagaagtctctcaatttcacaagcttgaggtacttatatttgtacatgatttcctgttctaagtgggtggttttggcccctggcacttcatgtacgctagggcatttttggacacttttggtatccaccttgcttaagaattgaatgactaggaaagaaggtcatggggagtcttcaaattattaaccctcagtccaatctaagtcattagttaatgccatgtttgaaggtggtaaagtaaccgtcatcttacgaagtaactctcgtttgttatgcttagtgctgaacaaagtataaactcaccaatgtgagagacagggacaggatgcttatttctttatggatatttagaatttgagcctgtaggctgggcacggtggctcacgcctgtaatcccagcactttgggaggccgaggcaggcggatcacgaggtcaagagatccagaccgtcctggccaacatagtgaaacctcgtctcttctaaaaatacaaaaattaggtgggggtggtggtgcgcacctgtagtcccagatactcgggaggctgaggcaggagaatcacttgaacccaggaggtggaggctgtagtgagccgagatcgtgccactgcactccagcctggcgacagaatgagactccgtctcaaaaaataaataaataaaaaaaaaaaaaggaaaaaaaggaatttgagcctgtaacaccaacttcagcacaaatagatctctttcttgattctgaaatgatttatcagttttaaaaaatggtggggtgcactgctggtgggagtgtaggttgatatagtcatttgggaaagcaatttggcactattgtttaacagtgaatattcatagacccattcctaggcaataacccagggaaacttatgctgatgggtattgttcctaatggacacagcattgtttctaatagaaaaaaaaacgaagctgaaaaaattttaaaggtcgtcaacagacatatatatatatattagtctaatatatgacaattagactaatatatatattaattagactaatatatattagcttctatccctgtagactaatatatattagtctaatatataataattgaactaatatgtataatttgactaatatgtatattagcttctatctctatagacatatattagtctaatatataataattagactaatatgtataataattggactaatatatgtattagcttctatctctccagactaatatatatatatattagtctattgagaacctttatatatatatatatatatatatgcacacacacatatacacgtacatacatacatatatataattttttgcttcacagaatggaatattatacagcagtgaatatgaaggaactatagtagctacctgtaacaacatggctaaatcttagaaacaatattgtgtgaaaaaaactagtcacaaaagactatatacagtatgatagtattataaagtttaaaatcaagcacaattaaactatgtattttagagagtgatagatagaaaatttaagatagtggttacccctggagagaaggcaggaggatggcttagggaaatagcaaataggtagatggatcaaaatacccctaaatgtctagttctcaaatagggtggtcggtgtatgcctgttcattttattcttatgcttcacaggttacgtacatgttagtgcattcttttgtgggttacaaacattgcatgatagaaatatttttaaagtgatagcatgtcagaattatggcttgttttttccatctctatttcctaacattctctttccatagtccccagggagggggcttgagatcacacaggagtaattagaaggtctgcttctgacagtgtcgctccttgagtggtggaggttttagggggaggctgacagtaactactgagtggaattgagaggtgaagccagctggacttcctgggtcgagtggggacttggagaacttttctgtcttccaagggtattataaaatgcagcagtcagtgctctgtagctagcaagaggtttgtaaaatgcaccaatcagtgctctgtaaaaatgcaccagtcagtgctctgtagctagcaagagatttgtaaaatgcaccaatcagtactttgtaaaatggaccaatcagcagggttctaaaagtaaccaatcatggggaggattgagaaaagggcgttctgataggacagaaacaggacatggacgggaaaaataatggaataaaagctgccccccccaaccccccacccccacccgcaccagccaccagtgcaacctgctcagattcttttccagctgtggaagctttgttctttcactctttatgataaatcttgctgctgttcagtcttttgggtctgtgccatctttaagagctgtaacagtcaccgcaaaggttagcggctccattcttgaagtcagcgagaccacgaacccaccagaaggaaccaactccagacacagaatcagctaggagacgtgggtgctttctgtatagtgcttcctaccaaaagcctagaaaatcttggggcgtggagaaaagaaaatccatcaagtaaaggcttgatcacctcttggaaaacccatattcattgtcccaacagtgactaatacgtctaactgtgggcctgggtaggatattatgagaaacctgttcttttggtgcccacctttcttttctgagcaacacgtggtcttctgagtgaggcaggagtccggcatatgcgtgatgatgtaatatgttaggcagccaggccctcaccttttcaaaggttcgatcttgaaaaatcaaaggtggatatgtgagaaataagcccatataggaataagaatgacaatggaagtggaaaatgtaagttgggactgatgttctgctgctttgagtactgaaattctctgctgctcggattcatcatcactgaagtgctggccagtactgggaggggggcagagctctcccgggagtcgtcgcttattctgaaacagctgagcagaataatgagtgacaggctggtggtggggaggttgagtcttactccggatttccattaaatgagtgcatggaatcaatagctaactgaacatttgtctttagaacacccaggggcccctggggaatttggtattttcagtctaattctcagacaggaaaatgcgcagcatgactattttttaaaatagtttcaacatcttttatgtaatgctgatgcatctggaagtgaaaacgctaagagtttcatttcactaaaaaatggattttttttggctttaacctttaagttgaaatcacaattagtggccttttcaccatagtcataagagtatcaaagtgtgtgtattcacccacacatcaaaccagtgtttactgagagtatattctgtgcaaagaattgtgcagtttgttatgaaaaatacagagacctcgctggggcccctaaggagctcatagtctagaaagggagacagatcattacacggcagggaaaatacaatatgtatgggagcatgtcacaaaggaagtgacatcgagctgaatcttaaaggaagagcaatgcttgaatgaatgaggacatccctgattgaaggaccagcataatgaacaaagaattttgccttatattactaagattccatcagatgttatgacgcaaacataagcatcatggtaatgaaattaatagtaaatttaaataaaaatgatcaaattaagacttttttggttttgtctattctaccttctcattttaattatgttgcaaagaaccatatacttagggtaaactggtcaatagctgtggccatggaatagaattataattcaatttaaaaggagtttaatagtctcatggtaaatgaataggttacagctgggcactgtggctcacacctgtagtcccagttctttgggaggcctaggtgggaagattgctggagaccagtagtttgagtccagcctgggcgacatagcaagaccctgtctctactaaaaaattaaaaaaatagttgggcgcagtggctcacgcctgtaatcacagcactttgggagaccacatgctggtcgagaccatcctggccaacatggagaaaccccatctctactaaaaatacaaaattagctggacgtggtggtgcatgcctgtaatcccagctactcaggaggctgaggcaggataattgcttgaacctggaaggcggaggttatggtgagtggagattgcgccattgcactccagcctgggcaacaggagtgaaactatgtttcaaaaaaaaaaaaaaattaaaaaattagccaggcatggtggcgtgtgcctgtagtcccagctacccaggaggctgaggtgagaggaccacctgagcccgagaggttgaggctgaagtgagctgtcatcacaccactgcactccaacctgggaaacagagtgagaacttgtctcaaagaaaaaaaaaaaagaatgttatgaatttagtatttttatacttcccctacaactctagtatctctgaggaaaagcctcaatcagaaaaatgatttgctttggggttttatcttttatcagtgataaatgtgaattgagaatagaaatctcaaaatgcaataatgatagtactttatatttcagtaggacttaatatataaaactctaatatgcattatttaaatttggccaatatgcaagagaaaagcaacatagggcagaattatgagtttgcttcgtaaaataactattaccagttcattctgttcaactatgtactggtagcatttgtaaacaattcattcttattttttttccaaagtgcattgcaaaatagtcttgcctgtattttcctgtttgcagtctatttcattaaatttctgcaattctaaattagaatagcatctaatagaccacatatgaaatgtgcttgctattaattcagacattttatggcatattcattagtcaaatccttagtatttatttatgaagtcacattactctgtccagtaattaacagaagtggatgaatatgcatctctaattttttttttagcaaaagaaatagcttacagtaagtatttataattacgtcagctcaatgtttacagcacttgaatggcgatatgtgtagtttctgtcatttagacttcatagataatttttgtacagaaatgctttgttgttgatgctttgcttccttcacacatatatcacagattaccgaaacaatcattagtccttcagttgcaacggataagactcttctttatccttaattttctgagctcctttctaggcattttatgttcttacacagatgctaatgctaattaatgctttaatatgaaagatactggcaaataaaactgttacattttacccataagttgtaaattcagcttagttgccctaacaatactgatagtgataatggctgtacaattaatatttatggagtgcttccagtatactgagctctgtgctaaacattttacttatgtagcttagttaactctcgtaacaaccctgtgaggtaggtgttattagcccgtttcacagatgaatttgtaatcattatgccttaccacatttaataataacattctctattaatcgtatatttcagatgcccagctctggaactttgcagtatgaaacgtgtgtgtatgtgtgtgatgtatatataatatataagtatgtatatataatatataaatgtagattatataatatatatgtgtgcgtgtatatacacacatttcttttttttgttgttgttaatttatgtgccacgctgctgtacgaaactctggggtactatgatgaggggatacctctttcttgcctttaagggacttaggttgtggtgggagagatggacttggttaaggaacaagtacaggaaaatatgataattgctttaatagggataggtacaggggttgtagaaaaatgagagaaaagggcccccacttcccagaaggtgtcagggagtttttcacagagaagcgtccccagccctgagacttgaagactgagtgagtttgaaaagatgatgtgtggggggaacagaagagagaagggtgtggagatgagggaaacaagatggggtcagggagctacagggagggacttggaggtgctgagggtcaagtgcagcaggaggagagacccggctggctggggtcagagctcaaggagccttgcatgttacccaaaggaatgtagatgtcatactctgtgtgctggaaaacgatttacagatgaatccaatcaacactaattaaatcagtatgattaagggatgaccttcctttcttcctaccttcctccctcccttcctccttccctccttctttggctcatttattcactcagaagattttattgagtgcccataatgtgcaaagctttccattgaatcccaaagatgaaaggaggggtgagagtggacacagttctccctttctggagtttattgattcgtgggggaaaacaagcattaatcaatgaatcaaccaaaaaatgtaaaagttacaaaatgactactataaccagggagggtcattctatacaagtgtgtcctaggaggtggtgacctggctgaggaagtctcccttgagaagaggactgagctgagagctgaaggagaaaagaatacaaggtcatttgatagaaggggtgggtgatttgaggagaagtcttagcaaggaggaagtcatgtgcaaaggctttaaggcctgggaaagcaaggtccttttaaggaattgaaagtaagccagccatgctgtagtgcaagttggaagagaatgcaggttttgggggccatgtttagaaatggaaagccactgcaatgccttaggcaggagccaaggaaggtagtagggtggcagggtggacgcggggagacgtgttagggggccagggaaagagtccagatgagccagggtggtgccggagaggagcggagggagttgaggagtatggctgcatggttgaatatggggcataatttgggagaggaagacgtcagagtgatgttgatgccatcactgagctaggaaacgtaggtgaggcagaatctattctgcttagatttccagaaaacattaggggatagatgaggatgacatcacaatggaatttaagctatttaagctcaaggttggccttgaaaaatgagtaggaattttctttttttttttttttagacagagttccgctgttgatgcccaggctgtagtgcaatggcacgatctcagcttactgcaacctctgcctcccaggttcaagcgattctcctgcctcagcctcccgggtcactgggattacaggcgcccaccaccatgcctggctagtttttttttttagtatagatggggtttcaccatgttggccaggctggtctcgaactcctgacctcaggtgatcctcccgccttggccccccaaagtgctggatttacaggcatgagccactgtgtccagctgaaaaatgagtaggaattttctaaatggcaaggagaggcaaagcatgttaatcaaagggagtgtcatatgcaaaggcagaggcataacaaaaatagtgcaaataaatgcctacacatatacaaaaggagagttattgtgggacccatacataattttgttgatttcttgatatgctcatatccattttgtgttgcagtgattctaagatctgtattagtatgtagactttgtgaacaggtaaacatgtttaagaattttttaagacatggctgtattagatatcgaaattcctctcttcattttcatatctttactttggaattcatatatgccttttgatgttatcatctgacttgtttctaatgaaatttagccgcttaggcaggacgtggattttaggtttctgcttagtgttttggcatctggatttgggattacttagcatttttaatttactaaaataaccaccaacttacactcagttgaaatatgaacatgtcggtttcacttgagcttgggaattaaaatcaaagtacagtcaaatccaaaacaaataatagtaattttaagactaggtgacataaccctctgggaaaaatgaggtgatagtgatttgatactttttttttttttgagacagagtcttgctttgtcaccaggctggagtgcagtggcatgatctcagctcactgcaaactctgccttccggttcaagtgattctcctgcctcagcttcctgagtagctgggattacgggcacgcaccaccatgcgtggctaatttttgtatttttagtagagatggggttacaccatgttggccaggatggtctcgatctcctgacctcatgatccgcccacctcagcctcccaaagtgctgggattacaggcatgagccaccatgccccagccccgatatgttttaatactaactacagaagtgttggtagaaagatcagccttgaagagatggtatagtactagaatcctaagcatgacctctgtgaactgttggcttaagtactggctttaacatccgttggctgtatttactgtcagttttcttgtcaataatgcagaggtaaacatgattcctggccacctcacagactgcagtggagtggggcaatgtgtgtaaagcccttagcacatggcccagaacatagtaaatgtttaatcaatgttcgtgatgaccttggccatcactgacatcatgtcttaactgagttattaacaaagaggcatgtgtagtttcaaaagtgaaagtgaggccggaatggtaaatacatgcactgaatttgcataattttgtggctagaaggagtcttagagaaagagagcatcaaattcagcaatgtttctgacattttctatgaagaactgactgcttgttatttcttagaaatcttagaatcattgagcagggaaggaggggcaggaacgggattattttgatagtggtgtcctcaaggggaggagatggggtgggaagcaacccctggccagaacccactcatccctggggatagggacctgctgtgtctctgcctgctgagtttttgacattctgatttaaaaaccttgtgtgtgtgtgtgtgtgtgtgtgcgcatgcttgcgtgtgtgcatgtgtgtgtgagagattatgcaatatgatgtttcccgtttctgtgacttcagcgaatgtgaatgaagaccacagaagcagcctaactcagtgagaatattgtttttataattacaggtctaggcgttttacactgagattctccactgccaccctttctactcaagcaaaatcttcgtgaaaagatctgctgcaaggaactgatagcttatggttctccattgtgatgaaagcacatggtacaggtaaacatctccaaaagctttaaaggaaaataattatcattgagttgtaaagtccccaagatagtggtgggggtgtatacatatctggtcacacaaacatacacacacaacatacacatgtctattcatgtagactccattttttcctactgtctcttttataaaaatggaacccttgcttttttatgggaaaggaaataacttctacttattttgaggtcactagttaggatagatgacaaggcattgctgataattctgaaggcatttataaatttatagatttataaattcacttagagagacaaacatcaaatggtagtagagattgtagaagtagtagagattattaagagtattgttcctcttaacaatataattctgaacatctttcatagcaacagatatttttctaccgtatagttattaatgattagtataccattgagtaaacattctaaaatttatttaatttatatcccttctaactggacagttagccgtttctaatttttttgcctttttattttcttgagatagggtctcactctgtcacccaggctggagtgcagtggcatgattttggctcattgcagcttccacctccaaggctcaagtgatcctcccacctcagcctcccaagtattaatagctgggactacaggtgcacatcaccatgcctggctaacttttgtattttttttttttatatagtgatgaggttttgccatgttgcccaggctggtctcaaactcgtgacctcaagcagtcttcccacctcagcctcccaaagtgttgggattacaggcgtgatccaccacacccagacattttattgctttcatgatgccaaaaatattcttatagctctgtattagttcccattacaaattatttccttaggctaatttcttagcagcatactggtaaatgtaagagttttcaagttttacggcttttggtaacttgttgccaaattactttcagtaaagtcataccagtttgtatttccagaggcagtttatgagagcgtctacttaatacagttttccaatgctgagaattttgaaaacaaaaagagttttttgctgactgattatgcaaaatggtgtttccatgtattttgggttttgggggtggggggggtcatttgtaagtcaagtaaattgtactgttttgtagaaccttcctccattagacagcagcatccttgaaacttaccagatttcgacatttcagaaataatattaaatccagaaggagtagaagggtcctagggaattttaagttcttcctttctggccaagtatttttagacaactatgaaatcactagatacaatcatttttcagtggaaagcataatttttcatttcttaaaaagagcaaaaaggtatttaataaaaaaattttattagatatgtatctgaagttatactgctcattagtttaaaaatatgtatgtgcctatatatgtatgtgtgtgtgtatatatatatatgtgtatatgtgtgtgtgtgtgtgtgtgtgtgtgtgtatatatatatatatatatatgtccaatatcgggaacatgattaaatataactatgttagtgccatatgatggaaaagctgtagataagattgcaagcttcaggctgcctgggctcaaattccagctctgctgttttcttgaagtgtgacattgggcaagttactttgcatgtaaaattcggataataatagtacccttctcccttgggtgttgctgcaaataatatatatgaaatgtttaaaatcgttaaaactcctatttcaggagtatttaatcatttgagaaaatgatcaatatagaagtaaacaaatgtagggtattggcatgaaccatagtataatcctaatcttccaaaattactttgcctctctttcctccctcttttcatcctcctctagtatctacaaaaagggtttagcatacttctgaatggatttaatttgtattagtggagtaatcccagtcctggagagacttcctgattcaagttttcaagtcagagacccatttttcacagagctttgaaaccatggctgtctggatcacctggctgggggcacccttggagcagccgttgggtgagagcagagcttccttcccagccagggctgcctagctcctgtggtacagcaagtgccttgggcacagagtccctcaccgtctggcaccatatgtgagctgccctagttggctcatctcttcccgtcattactaaataagcttcatttcactaaataaatgaaagagaaggtagatgaagagacccccccgccacacccagctcttaggaaacgcatgctttatcctacagatgcatgaaggggaaggctgtaggtttgtgaatctcttgaccctttggctccatcgtaacgttgaaaagtgaaaggaaaagtggtcaaagaatcatttggcatgaaggagacaaacacagaacgacgtgtacggcttcagcctctgcctttcactggttaccctgctatgagcttgtgtatgtagacgctgcattcgttttggccctaatttctggtctaatttgaacagctctgtatttctcagcagaagaggaatatctgaattcctaattaagacatgttagcttaagaatacctccttaatgtgtcataaatcattcccctgtgactatgaggatgaataagaaaacaaaacttggatttatacacacatgtatattatttcaacaaaattaataagttcatagagggagagaggacaacaaatgtgttagcaaatataggtcaggaaaagagttcataatgttctgccagattctgatgaggcacctcatgagtgtaggtagaaggcctcaagtaacggtagtgggaatggtaataacactaccatatggaacatttggtatttgaatagcacttagcttcctcccaaactacaaaatcaataaagactcagagaggaagaaaggattctcttgctgtggatcactggctggtgtgcagaaatgcagacgtgttggttgtcaagggcttaccagaataaatttctctagggagacaggagagtgggaaatacttaaccatattaattgtgctgtgacctcagatctgtggtcagcagtttttggttgtttccatatactgcacatggttgcccacaccatttttgcattcatgtacaagacctatctgcaagaccaggcagaatcattgttgaaatcttagttcgcaaagtcccatggggactttggggtgtcttaggattttgccagcacaaagttaaagcacaacttttgaattgtgagaaactgagacaaggtctttaattttaatcccattcagtcattcctcactcatttattaatttagcaaaggcctttttaggggcagctatgtcccagtatagggctgggcattgaagataatggaggaaaacaagattgacaaaagactggccctaatggagtttacagttctcagggagatacagtcaacaccatcataactggtttgggggaacaggggagatgaactggaccattctaaaaggaggcaagaggtgcatctgaaattggaaactggagaaaccaggggagacagacctgttgatctggaaggcatagaacagaaagaaccagagaatagtcagggactgacaatgaggttgtgattgttgacagccggaccaggccaggaaatgaagaaggtaaggagagaagcgtactgtctaacacccctcgaatgcacagttgctagggccagtaaagatcatcgggctactcatctctcaatttaggtaatgtaaatgatgcatcttattgacaatccatatccttaagaaattgtgaaatgagtcttttactttttataactctacaaacatgttagaaagatggatgtcaccgtgtctttatcacagtatggtgatttttcttaaccacccaaaggaagaatcgaggtgcaccagaacacgtgtaccttgttctcttattaaccatatcctttttcttactttacccactataattcacctcagagagtgagattaattatataattaatcctaccttttgtgcacatgcataattaactttatttagttcactttaaacagattttaggttccagatctaaataatagcccctccatttgtcacatcttgacctctttactatttggtacccttccactcagcattgtttgtgggattgtggttcttcttaccttcctccctccattcctgggtgcttttagtggtctcttaaataacaggctctgctcagagatttcttttatctccttaggccttgacctgcatttggtaaaggctgcatttttagcttcggatttactgtctttgacgaacctttttctctattgtatccctccctggtcagctgctctcttcgggccctcaaacatccaccacgtactctacccagatgttttcttctttctttaacatgtccagttgagttgcccatatcatcccctactccccatccacacacccacccagcacacacacacacacacacacgcgcgcacacacacacacacacacacacacacacagtgcattctcgaacatggggtcttttccccttcaggcaccgtatgtaacccaccccgcccctcagctcttaggaaatgtttcctttatcctacagaaacacaaaaagaaaaactgtagggttgtgagtccctctcaacccttcgactacatctatatcataaggttgaaaatgaaatgaaaaaggttgaaatgtacatttctaaggttaagaaaatcctactgatattaagtatttaaaacacagacttccccaaaatttatctttcagcataaatatgcccttcccttttctcccacccttccttcaatctgtagatagcctccataattcatagccagtttgggtaaaggcattattttgagacatttaatgatttttttaggaaaagcgaaaaaatgtagggtcaaagattcaagagtatattgtgttttatatgtaggcgtagcttttaaactattttggatactttaaagttttaaaataacttaccaggcttctttatgaagcattttattctttgaaagttttataaataatatgatttctggtgtcagtatggaaacattcacatagttgtaataactctcatgaaataaggtagactattccatcatctgtgtttactcttaaaacacattagaaaatggttgatatcaaagcttacaattttgtctttcttattgctaccctaaagcagactgctgcacagaccttcccctgctacactaatgctgctttcaatgttggcaaaccatactactcaaagtgcgggcaaaactcgaggtagaaatccaactttcatacagctttatcaaaatgacagtattctatggtacttttcaaatcactatttttttctcttagaggttatcaaatgaaatgaagcatttaaatatgttttctaaattcaggaatgtgagataggagagcttttgacattataggattcagcggtggaagagaaaatgaacatccagttccctttctccctaactcaagatctgtgctccctgaatatcattagtgcttctcatttcatcagtgttcaaatagtgaatcattcattcactgattgttgaaacaactgttataagatttggaaataatatacagaacatcttggaagtactttttttttattagcaagaagcagctatatgccaaaagtattaagaaggatcatctcttcagaataagtgagaagtatatcactggtaattttttagatttttgctgaatgttttagtaaaatttgggaaggtagtttttttttgagttggcaattatatgctgtccctcttgttttctcttccaaaataatcattcttctctctctctctctctctaaaatgggagccacagagccactgtcagaattgtatacatataaacctgagaacattgcctggcctggcacatagtcaatgctcaataaacatttcttgctactgtatctactgtgttctgttccccctctgttcaacaccctgtattttttcctggtggagattttcctgagtacctaaacaaataaacatagccaaacaaaacaagaattcagtgctgatgccgtgtgctttagaagctgggtctgtgcttgacttgactgacggagatgtgatactctgagtgtgtctgcagataaagccaaattcaaaattcaagtgaaacgcccttggacttgggaatgaatcggcgggtggggggggggggctttgaccaaggtactcagtgaccctgtgcttccaagttctccatctgtaacatgagtggtttgctctcagaggtttcttccacctctaaaaattaccatcattttgcaaccttgatgctttaagactttgaagtccctgtggaaaagaacctatgaaaagcggtcactgtttctgttttccccgtgcattttagtggctgcatagagtgttttttggtgtgtgtcttccatcttgctcaggtggagctaatgacctccttctccaggatagacaataaaacaaaccaaaacaaaaacactctgttcatgcacaaaggcaaccctcttccagatgcttaaccccttaaatgagtatttcgatgacacagagggatcatcacttcacttgccactgaaatacagccatctctggagtgaaatttggcagctgggaagtagtcaagctgcagtacttatatgacagtttggggaaaaggagtgagacagaaatagcagattccaaaataatcccattaaaacagcagggaaagtggaattgggcaataagatgggaggatggtttgccccaaagtctgactgtcctgtttagacaatgcggacttcagccccagaagctctaacttgtgtcactgctggaatatagtgaccacagtcaagaatcccctacacacaccccaaaaaggggggcttatctaatgtcccattgatctatcgtcttgtgatttttttttttttctctttttcctgctactctagttatcaggctgtgctggcacataaatggatctgtctttttaaagctacctcttccttttgccccctgcataagatagtgttgtaggtaagcatgttataacatcagaaagtactcagctgagaaggagtgatgttaaagcaccctttgggctggctctggaaggatgaactgactgaccagaaaggaaaactcttctgtttaattccaggatcttgggaataacagtgacagagaaagaagattcgagaagtagatgtggttgagtacaaatgtagaactcttcagattttctggaatggggtagccattgtgataaatattaggatatgagcgtggaagtcgtagtggataaatttgaaagctactcagcaatatgtgcagcaacagtttttaaaaagcaaaaggaagatttgtcaacatagttagaaatcctcagatcctcagataatggaacatcatatctctcaaaaggaagattccagggaataaagaaagcagatgataagggaacctgggcattttagtttaaccagaaaatagaacgttaccaaaaaatttagagattaaagagtcagtttcatttagaagcacataaaatgtttatgtaatgagcagaatttatagagtctactattataaaatagaaccaaaaatgaattcaagaaaaatgtaataaaattaatgtagtgggagaaaatgaaatacaatatcagaaattctagttttgaatctcagttctgcaacttatcagctttgtgaccttagggaaatcactcaaaatctgagggttttttccgcatctctataaaatagaaataattataatatctgtctcacaggggtattgtgatgatcaaatgagataatgcattgaaaatgttttgtaaattgtagagccctctacatatgctatttctataactctgcaatttcttatggcatggagtgagctctcagagacagtaatcacatgtggaaatagcttagagaagcagtcatatcagaggcaaaatctattgtataaaaatttaaaaattcatatgaattattttttctgcttctcatttttctggctcagaaattcttctatgtttacagaatttttccaaaaatattctggtaagccctgtaacagaattgtccactctctgttaagcggtaaaccacatgattttttttccttttttttttttttttttgagacagagtcttgctctgttgcccaagctggagtgcaatggcacgatctcggctcactgcaacctctgcctcccaggttcaagcaatccttttgcctcagcttcccaagtagctgggactacaggtgtgcgccactgcacctggctaatttttgtatttttagtagagatggggtttcactatgttggctaggctggtctcgaactcctggcctcaggtgatccaccctcctcggcctcccaaagggctgggattgcaggcatgagccaccgtgcccggccaaaccacaagattttatagtaaatattgcctgtgagtaaaccttgaataacaacattaaagcagaagactgctatcttgtgtcatttgataatcctaatttagggaggtctgggcagagaaaagcggggtgtgtctgtggtctggggacaagagtaatgtaagtagcatgccacatgatgaagactgaaacggagacagtgaagcacggtaaatctttactgagtgtgggctggtgtgctgaagttccctttatgcatcagcccatctgtctcattagcttctctcttaatcacaggctccatgaagtgtctacttgtctttttttagctttttatgtcaatctcctataaaagcaaaaggaagtcaactggcctttatgctgtttgtgtatactccatgcatgctcggggtggggccagctgtatttataaatgcatgctaacatgggggttactctgtgtgcataagagcttatttgtatgtgcattcatgaatatgtgtacatttgggcagatacacaaagacacaacacatatgtgcctctgctgtatgctctcttacatggaaaagacacattgacattaattagaaaaggtgatatgaaacagtgaaagtaaaattcctttcggcagtatttactattgtaattaaagtgcatgatgtaacattatatgtgcaggagaatttgcttattcatcctttagaacaatagtaggagttacatattaacaggtttaagtgtcaataagtgtctgaatacagattctctattgtgtgcagttcttgtaataaggcagtgtattttccttgtgtctttgcttgcttggaattgaaaatgctttggatgaagaatgttgcagagtgtaatttgtggcagaaaatatgcccccactgtttgtttattattcctgaggacatttgctgggctgaactatcatatgtagaaaagaacagctttgtttggaaaatactgtaagagcagtacaagaaaattgaattaagtaaagagacttagggagtccatctttctctgatgatattccttatttgctcttcattattccctgtgaaggaataaaaacgatgaaattggatttgaagactggattaagacaaatgacttttcagatttttttttttttaccttagctgtttccaattttcctagaaaagcacatagtcactatataaagagtctgagtttattgcattaaatcttcctaaatagtgtgcccttgaggtttgatgtggggaattagtttagaagattcaggggcttggagtacctgctaactgtgtgatggcgtgtgtctctagaaattttatatgcccattgatttttatagagcaagcagtacaatagaagggaagcaggatgctgcttggtcttaaggaagtctttcctgcctaccaattgccacacccctttttctccaggtagagttgactatgttttcttctgggccattgctgtacttgcctaatacttttaataaggacttgcaaatgtgcctgtaggtctcttctaactaggctgtaaaccactcggacagaggaattgttttatttcttgtaactctaacacctaacacaaggccctcaagataacctgtcaaatgaatgaacagatgagctgaatacccgctgtgtgcctgttcttgtcttaagacatgagggacaacctgtaacacaggacacaatgtggctgtgtctgctctgaaatggtagaatatctagctacagcttagaataactgggtaaggaaataaatgctggattataacccaaagaataaaatatccaacgagtccaatgaataaataaataagggaaaaggaatgactcttccctgcagcagaatttcagttaataaacaaacgaggaaggaagcagtatgaaaacatcattagaactcatagtaagaattgccacgagaaagtcccaccgatggatgcattagatgggcagatgtggattagatggattagaatgagcgggcaaaagtatatgcagaaacaggaaattcgtagaattttaaaatatccctaccccaaacatttagtaattacaaggagaaaaataaaagtttacggtgaagaatcctggcagacatcaccttaactgagtgatcaaggttaatgtcaccagtgatacatattgacatcgtgtgtcccactgagaagggcgtgtcatctctgatatcctccctgaaaaggcataatctcactctaatcaagaaaaaaatagcaaactcaaatggaaggacattcgaaaaaataactgacccctccccttaaaattgtcaaggtctttaaggataaggaaggattcaggaactgtcacagattagcagaaactaagaaatatgaccacataaaattctaagtatgatcctgaaacaggaaaaaaaaaaaaaaagcctgtttggtgcaaaaactggtgaaatcctaatacaccctacggtttgttgagtagtcgtgacccaggttaactttctagttttgatcgtggttctatggctttgtaagctgttaatatagggggaaactgggtggaaggtacaagggagctctgtactatttttgccgctttctgtaaatctaaaattatcttcaaaaaaacctagttgacacttaggtaggccgaggtgggcagatcacttgaggtcaggagatcgagaccagactggccaacatggtgaaaccccatctctactgaaaatacaaaaattaggccgggtgcggtggctcatgcctgtaatcccaacactttgggaggccgaggcgggcggatcacctgaggtcgggagttcgagaccaccctgagcaacatggagaaaccccgtttctactaaaaatacaaataaaattagctgggcatggtggcgcatgcctgtaatcccagctactcaagaggctgaggcaggagaagcacttgaaccccggaggcagaggttgcagtgagccgagatcgcgccactgcatgccagcctgggcgacagagcgagactccgtctcaaataaataaataaataaataatacaaaaattagctaggcatggtggtgtgtacctgtaatcccagctacttgggaggctgaggcaagagaattgcttgaacctggaaggcagaggttgcagtgagctgagatccggccactgcactccagcctgggtgacagagtgagactccatcaaaaaacaaaacaaaacaaaaaatctagttcagggcacaataccaatccacaggaagcaattatagagcaatccatgacaacagacaactgagaatttgtaatggggtgccagtgtcaggttcagaagaggaatgagaaatggctggggattggagtcttcaggaagagcttcctatgagaagcaaagcctgacagggaccttaacaggatgtgtagtgatgatgggtggaggaaactgaggggtcattgtaggcacagtggcagcagggacaaaagcatgaggaagggacacagatggcctgcatgggatatgttggaggggccagcggagttatatgtgcattgctggagattggtatgaaagagaatttgacagctgtggggataacagagctaaaggatcactaagacctggcggaggaatgtgaagttaatgcaggaggtgacacagagttcccagttcttgtttatggaaggggctcagtgagtttgtgtgtatatatctgaaaccggtgacaatgtatgtagggtggccagagttgggagaaacaggggacaggcgagtcaggaattaaagataggtaatgggagcctattcgtttgagggtgttgggaggatggcaggaaaggaaaagggggcaacatattcaaaggtatttgaagggataaaataatataacttagtaattgttggatttggagaatggagaggaaggagtcaaagatgatttctgggtcatatttactggacaggtactattggtgtccataactgaaataatccattcagcagatatttgcatgcctacatcgaggaataatgtattctaggtgaggaaggaggattaaaaagaatgtcaacacagcatctgcttacgctggaatgtgggccagaaagcctgtggcttaggctagactgaatgaatggccaggtcagcctacttaaggagtccctgccctccacataaaaagaagggaaagattgccctactctgttcctagcagtagccatgaacagtgttagaagatctttcaaactgacacttctgtcctcttgataaaaatgtcaggtctactgttggaccatactcataaaaactctgttaaatcaccattctacttaggaaaaggccattcatgccccacttaactctgccaagatagaggatgctgtgttcccaaggtaccaaaactgaaagttaaaatgccataaaagtatactgaactttatagaagaaaaaacagaaaaagtgtatgcatgcttaaacctcaaactcttgatcttcaggtaccatgtcttttcaacgtagataatatcacctagtgagcacaccctgaagtcatgctctggctggctttgctgtgttctttttgttttctcttgggcttgtgtctcactctgtgttgggtaggaaagggtttctgtagcctttatacccttgttttcatcacttatttcacgaatttccacttattactcaagaataaccatatttttttatctctatgacaagctgaaaacctccctgtcagcaattatagcctgttagccctcacagagtcagtcttggggaggtatggccttgcggttcaggggcagaaccgtaggtgtattcacctgtggaagacttagacatacacatttgattatgggtggcagtaatcagatttatgttttgaaggtcttcgaagatctccgtccctttctcagtcaacattatacatcattgtttcttaacagttgagtccttataccttttttggtatcagtcggtcattaggccaagtaaacattttattgacaataggcaactgaggagaaaattaaccctttttatagttaattgtaagtggaagttgcttgatattcttaaaaatatgaaattgtggaagttctggttctagtctgagaattgagcattgagcatcacctttacaacatgtagacttaaacttcaaatacctttatgatgctgagaactccccatggaataggaaccggccatggcatatctaaaacatgacttacatagcattgcacgatataatatgaatgcatgtttttttgtagaatttagaaagaggctgaacgtgatggctcacccctgcaatcccagcactttggggggctgaggtggaaggatcacttgaagccacgagtttgagaccagcctggacagcgtagtgagaccctatctctacaaaaaaaatttaaaacttagctgagcatggtggcatgagcctgtagtcctagctacttgggaggcttatgtaggaggatcacttgagtctaggagtttgaggctgcagtgagctgtgatcgcaccactacactccagcctgggtgacagaacaagtctttgtctctttaagttttttttttttaattagctgagtgtaatgttgtgagtctgtagtcctagctgctcaggaggctgaggtgggaggattgcttgagcccaggagttcaaggttacagtgagctatgattgcaccactgcacaccagtctgggtggcaaagtgagaccctgtctctagaaaaataaaataaaagaaaataatgtataaaagaatgacatcttttgtagagcggacattggaaatggcagaatactccatgaagtagcctctagattccctttatgggcttgctgtggaagcacatatgttcacattggcagaataaagactctttttatgtccttttaaactaatgtattgacttcagtattttttttatagggaacatatttcaaaattgtaatggtagtcaatggttctatgtaaaaatactttgtctttccacagacccatatataccagccaggtcaccttcattctcagagtgcctgatgagtagagtgcattcaatacaatagctgtcttgtttttttagcagcagaagtgggagtcacatgctgaactcgggaaccattttgaatttattctcatagcaattgcaaggtaaaggcaggcagaatccttgctgtgtaaccctcaacagagctccataaggattgggaaatcaggccatgctttgtcaaagagagggtgcacacaggcatcaaacaggtcacttctcttaattcttaggccaccacacaggaagcacataattatttaatccctggatctttctagagatgcaacaaagtgatgagggtggacagctccagaaaatcgctgtgcaaggagcaagggtagaaagctagggttttggattagacagactccatttcaaattacatcttaacttagtttttattgtaccctctaacaacttatgaataaaataaggggaatatatagagagttaggcgtggggaatggttacaacttatttctcttcttcactttcatctgtctttcttcagtctcttctcccctcttccattaaaggtaaactgaataaatgaatagtgaatgaatgaagtgagcaagctgttttcaacaaagttcacttggtgccacttccatggatttagttataaaagtgatatgatcctagttatcttaggcagaatacatatttctgtgaccctaatctacgtgggtcctacttgaaacctggaaatgataggaaaaaccttcttgggaaggagaaaaatgaccaataaaaaaattctgaattatacttatagatgaagccctggtgaacccagagccctgttgactcacaaggacactcaaagtaagattagtgattcaacacattcacttcttcagtttcccaaatagattagaaggaataagagggctttcttgggttaaacttactaaccacagtgaaggaaggagaaaacctataaaaacttgaagtattataaaatctcagcggtgtgaggccatttcgtttgaggacaaacaaacctagtggattgtccagggcaggtgaatgtaaaggacatttcctgagatgcaacaaagagatgatggtacaatgggcaaggatgttgcaataacaagcaaccccaactcttcagggtggaacacagtagaagttcctttttgatggtgttacggataacttggggtgttctgcagttggagagggcgtctgtatggtggtgattccctgacccagggtccttgtatcgcaaggctcagacattccctcagtgttgggagaccctaaggatcttctgcacctggcagaagagagaagtggggaagcgagagagtgagcagtctcctgggaggtttgttggtgaaattggcatataccacttccttccatgttcccttgaccagaatttagtcatgtggacatagtcaactgcaggtaaagtggagaattgtcagcctgtatgtcaaggagtacagggaaactgttttttcaacaactaaccagtttctgccacaactggataccttcctgacgtcatctttactcccatcccagccccacccgagatttggccatgagtaccctgtaatttgcagggcattatatctctgtctcaggaacagcaggagaccactgagtcaatcggaactgttttttttttttttttttctgagacggagtctcactctgtcgcccaggctggagtgcagtggtgtgagcttggctcactacagcctccacctcctgggttcaagcgattctcctgtcttagcctccccagtagctaggattacaaggctcacaccaccatgcccagctaaattttttattttttatttttagcagagacgaggtttcaccatgttggtcaggctggtctcgaactcctgacctcaggtgatccgcccaccttggcctcccaaagtgctgggattacaggcgtgagccaccaccacgccaggccaggactcttcatcttttaaaccacccgggtctgaactgacagtcccttatgttatcttcatgggaagaagagcaggcagtcatgtgtggctccccatgaaaaggcaaggaaccttctagatactgccgctagaaaccaggtgtgggatagaagccctgcctttgatctatacctgttggtcaggaacctgcttctactttacttcattcatctgcacttcttaggagctgggtcctgttcttgtttaccattactaaattacggggaaattcctgaaattatccagtcctcccagatggttcattctttgtgtgtatacccagagcttggtcatgtccccattcctctctctcaagattagatctgctgtcaaaacctagaaacaagtctttactgaactgaactctttattagcctttgattgccagataactggacttgggaaggggagtttgggaaaaagggttaactatattaaatttttttggtgctctcttatatgggctgggatgaagcatttagacagtgggagaagtataggagaggcagacagatgccagaaaaaaaaaactttggttgtttccaggtaccgaaaaagaaagttcatttgtaagtcacccacctcctcatgatttcttcacctcctgtcccctgctcatggtactagagtttgtctatattataagctctatagctctttttgccttcctgcaaaactaagcactatttataacactgtttctctgagaaaatgtgtttggagtttcaaataaatgacttacaaatgaactttctgtatacaactcattcatacattgagaactgcctgtaccgggcatgtaacctggagataacttttatctctgctttatcaatatgggcttgtcaggttgacttatgtgtacttctctctgccttcgttttgatgatagcctctctcttaaaatttaatactctctttatgtttggagaaacattccctttggcagcgtttcaaatattcttgcgaattggaatagtgattttattttatctcccaatgtatctttaataggattcatggctatgaaaatcttttgcacagtccgcctataaattgtagaaaaattgagaactatttaaaagaagggggcgcagaaataatccttttctagtattactctgggttgtcagatatctttgcaatataattactgtgttggtttttaaaggttaaaagagctctgacgtttataattctcttttgtgtgtgtgttctacacatataaggggaaaatctaacacatggaaggaaaatactttagttaacataaaggtcctgagcattttatggtttttcaatacagagacataattcatggattttatatttgcttttacagatatctggtgaatcagttatttgctctgtggaaccaatttgcagtttacacaccttgtttatttctaagctgtgtgcatgggtaatgtgtgcacaaaaatactcttgctgacattagattgtaaagtaaaaaggcggaacactggtcctggagatatgccttctcagggaacttactatccatatacaagtaaaaatttctcattgttagcagagcagctgacagaatatgatcacaaatgttgctgatgctgttctgttaggaggtagaaatagaatgcctaggactatgcaagcttgtcagagttagattgtcagggtgatgtgcttccatattaaaaagaatactttgttcccccctcacacatgcacccttgcagtggaaagaaacatttatttcagaataagcgcaagttattctgacttgcactcacaggctcagactttgatgccagtgtagttaaaatttagtgaataccagtcatgtttaatggtctttcccttctgtttaaaacagtactgcagcccatgcaagaaacatttccctttaattttatgcattttgtggtatcttttgatggtttttctctactgtcaaaactgtgagaataatttcaatggcatgttttttctgccatcttcagttggcagtcatatccccccagattgtcctcatagattccagatcacctttatgtttaatcttcattaattgacaagtacctttgaaagggttttgcaaaaattgaactgcaaagctgtgatttaatacaaggaaggctacatcagtgtgaaagaaagcactttatgaactgtagagtactatttaaaggtgaggcattataattaaatatgctcaggttgttactgagcattgaatgccaaagcatatgaaagacaacttacgatgccaggagtttgagactagcctaggcaacacagtgaggacccacctctacaaaatgtttttgttgttgttgttgttgttgttgtttttgagacggagtctcactctgttgcccaggctggagtgcagtggtgtgatctcggctcactgcaacctttgcctcccagattcaagcgattctcctgcctcagcctcccgagtagctgagattacaggaacccaccaccatgcccggctaatttttttttgtatttttagtagagacggggtttcacagtgttcgccaggatggtcttgatctcctgacctcgtgatccgcccgccgtggcctcccaaagtgctgggattacagtcgtgagccaccgcgcccagcctgtttgtttgtttgtttgtttgttttttaattggccaggcatggtgagatgtgcttatagtccagctactctggaggctgaggcgggaggatcgcttgagcccaggagtttgagattacagcaatgttatgagagtagctagaagttacaccaatgctgcaggagtttgggggaatccagagttgtaaaatgccaacaaaaattattaattaaggggatctcttagccgtctctttgaccctacaaaaaacatggtggtactgagttttttagcctcacccaagcaaaaacagaatagggcattgtatttcttatatctggatgcaaaaacatgaaatgttaattgtagattataagtcattaagtgtcacggatttatgttttatgacaagttggagtttacagatttctaggctatttttttcacatagagatacatgaaagctttattcttgttattcaacgtaaatcttttataatctgctctcaatttccagtatcctgaaaaatcctttttctctcttttttgagacccttccctccccctaccatccagagtcatgcagttaacagttctgatagtgcttggattcatttgtagattgtacataccaaatggagctggcacctcttcatggaaattggacccagtgggctattttacacttgccggatgtgctttcctcagtagaagtttatattttatagctgatactccattgaccatagtaacctgttataaaacatgatgttttatcatttgttctgtgtcttcagggctgaacattttatggagagactttattaacatttaaagagactttattaaccctagatattaacatggtttacctggaaattttttgagcaatgttttcatttgattcctggaatgttcaaatagcaaaggcagtttctgttggtgtgcatgtgtgtgtttgtggttaaaagccagcattacccagagaccttctggttcatgtggaaattattattattactatgattattgttatttttgcaaatgaataaattgtcattctgatttttttaacctcaacgttcctttaaaaacactgttgatttttatggagaaggttgatttcctggaagtaataatatgatgttagagattactttttaggcaatattttggcatgtttatcagataaatcaaacatcaaataaatagattatggggaatgatttttcagtaatctctttttgcagtttcttccctaaacaaaatgatgtggcctattaggtggattggtttggaggacaattgcttacagggaccctgtccttatggtgtggagaagcagaaaaaactcacagtactccagagtagcccccttattctttttcataaacttcaaactaggtatgaaagacctgtccactttaaagctttcgcctgtgaagataaagcagagattgatttttaaccactatgctcatatggggaaacagaatgcaggagctaagatttaaagaagcagatgggaagaagagaaataacctcctctggcatccacctggaaatgtctcctgagaaagaggatggacatcttctgatattcataagtcaaggaactgcttgaattctgtattccgtgtacagtattctacctatcaagaccctcacccagggaagaaagtcttgtttattcaggagatggggagcaggaggcattgaggactgcatagcttatttaaattaaaaaaaaaagtgcaatgaattgctttttagtgtatttacagagctgtgcagctatcaccacaataaattttagaacattttcatcacccctaaaggaaatcccatacccatcagcaatcacttcccattttcccccaatcctctaccctcagctcctggcaaccacgaagctgtttctctatatatagatttgcttgttctagacattccatataaatagaatcatgcaatatgcggacttctgtgactgacttctttcacttagcataatgctttcaaggatcatccacatttcagcatacatcagtcattcatttcttgttatgatggaataatgtaacattgtatggctataccttattttgtttattcatttatcagttgatggacatttgggttgtctccactctttcactattatgaacagtgctgctatgaacattcctttccaagtttttgtgtagacatagtttcatttctctgtgcagcctacttttaggtagttacaaattaagattgtaagtgatttttttttcattttacacatttgttcgcttcacgatggcctcctctctcttcttacctatctcactctcccaaaaatgatttttcttgagaacatagttgtagaagggtaagaatatcaaccaacttttgctaagtatgaatgcccaggcgctctgctaagcatcatgtatgtgttacaatgtttctcactttatagacgggggctgaggtttagagaggctgctaagcctggaggtcattcagctgaaaaggtagaagagctgggatttggacccacatcctgtttactcagcaaggtccatgctgtctgttgactccctcatgatatgatcccagatcatacacctgttgaaatcttagagaattctctttctattcgtgagcttctcccaattgtatcctaaaaagtaaggaatataaatcagatgctccgtcctaagcccttggacctggagcgggcatttgtgttccccgttgacaaaaagatgatgaaatacttcctctgtgtctgagtgcagcggcgtcatggaccggtgttaagtttaacctgacccttctctctgccctgcagttgcttcatctcctcaccttaagacttcacctttccttcatttcagcttcccagagatactgccacaccccggacctgtgtatcaacttgaaccctcacaccccccaacttggacctttctaaatcttaaaatctcagactctgtagttctctctgggcatagcctcctgacccccttgctttccctctcttcctcagaactcagttgtctccttattgtgagccctgactcatcccccactcttggtcactatagccactttcttcaggctccgtattcctgccccctaaccagcctagacctcatggcttgaaagtttaactgtgcatgcccaatagcttagtgccatgcattcctttccaggcaccaatcctgcatgatccccatcacctgcacagctgcttagaggcccccaaacccaactgatgggtcctgatgtaaattcttactgttaatctgaggagagtcatcattgcttttctagtgggctcatagtcacatttcttatgggatctattccaaacttttccagtctcttcaaaacttaccctcaccctcactttggtagaggaccatttattcatcttgcttttttaaaatcttgaagaatccaggcatgaatccttctactctctttttccctttaattctgtccgttgctcctgtctcacagttgcagacaagtgttgcatgctgtgctcacgcatcccagaggagcaagaagacctcccactccgcaaggctccaagacccctcgttttctggatccctctctaccctgacttctctgaggctttgtcacctaggttatctccctctcctgcttgatctttcattatcttcatcttaaccaaaaccttctcttcagtctatgaatgtgcctagtggtgtggcctgtcttttaaaaactaaaggagcccttattttgaccttgttctcctcaggcaatttccatttctctattctttctttaacctcaacatgttttgaaaacatagtctgtgttctattcatccagattattaccacccactgaagtcttagtcaccagttcttctctgtcatccaagcactggaaacttctcggcccaatgtcttcactggcctaagatggactcaaactagtaagcttttattcagtggttactcctagacctctgggctgtatttcctacggtggctgctgccagccatttcatttcttttcttttctttttcttttgtttcttttcttttctttttcctttcctttcctttcctttcctctcctctcctctcctctcctctcctctccttttctttcttttcttttcttctccttccccttccccattccccttctttcttctttcttcttcttctttttttttttttttgagacaagatctagctctgttgcccaggctggagtacagtggggtgatcttggctcactgcaacctctgcctcccgggctcaagtgatcttcccatctcagcctcccaaatagctgggactacaggtgcaggccaccacacctggctaatttttgtattttttgtagaggcagggttttgctgtgttgcccaggctggtctccaactctgagctcaagcaatccgcctgcctcggcctcccaaagtgctgggattacaggtgtgagccactgcatcagcctatttgtttctgaaaacactctttatctgcctttattttctcttaccctctactgctctgatcatttcttctttatgtcttccttcttttgtcccttttcgtacttattcttaaaagtagattctgcctaagtgtgtataaccacttttcttccttgtttacatcttccaggtcctgagggagtgttgtgacttggttacagcctaccttcctaaccttactcattgcagcccaggcttccccataattatatacatgttcctctcacacctcaagctcccttggttttctgcttctgttgcatctctggtttctttcacctaggatcatcctcctgcctcccctctctgcatttctatatattcttttccaggaccacatcaaattctgtgttctccttatgacataatctcaaatgaccccaggaagttatcttttttttggtccacatttttaatgggacctttcttacttttacttggttttcaaattatttgttgaaacacatttcttttaaactatgtactcatgagacagtatattgagaatttaacccctgtccttaaacacagtaaatattgtgtcaatgtttgctaaatgaaaggagtgaaaagtatggctctatgggaacttgttggtgaatgtcccatttttatttaccaatgaagaaaagcaaaacttagcaaaatgtatctgtggagaggtgggtgggagagggttgttgtatagtctgaaccaaaataattaactcctgtaattgcaaaaatattatcattgctcagtgcaccattttgcagttaatcagatagttttagggaaatattaaatgattctcaagcttggaaaatagcaatgagtgttatggcatcactatacagcccagaatgaactcatggatcctccaatctcttgtatcagatatactgcatactggatacccaaggcatcagggattcagagaaatttttccgaaggtcatctgggtaggaagcctgacttttatagaatatttcataaaattctttttattttatttttcaatagtttctctacattgtatacaaagcacactaattactcactcccattgtctccactaattacatcactcccattttgttctcctatgaacaaagaagaaaggaacaagaggttgttttttcattttgaagaggcaaggttgatatgtttgactaaaataaagttgggattacctgtgaatttcagccagctttgccctccggtccatcaggtggacagtggaaaattgactgtgatgctaaaaatggtcataattgggggaaagtaagctttaccacctcttttgtgatgctgaatgtgtcttcaagggaatcaaaaaagttgtgcttgacaggcaaggtgaaaaacccagggatttgctacaagaatctctgcaggagtggtagaatgagaagcttcattggagtctgggacattttagtgttgctggcccattaccctgaacactcttctaacctcctccaagacgggtgtctgagaggagctgggccctgcagaccaattctagtcttctctctccacccctgccccctttagaacaagcatattaaaggaatgtctgatgagctcactatagtctttgtcaggacattttattttttatttttttatttttatttttgaggtggagtttcgctcttgctatccaaactggagtgcaatggtgtgatctcggtgcactgcaacctccgcctccccgtttaaacgattctcctgcctcagcctcccgagtagctgggattacaagcacctgccaccatgcccagcaaatttttgtatttttagtagagacggggtttcaccatgttggccaggctggtctccagctcctgtcaggacatttttacagctgttttcgttctaaccctaactgatgaccattggaagacctaaaaattcagctacgcagaataagtaaaattggtctttttctttgcatcctgaggataaatctaaacaaacccctctcgttggcatatctccagctacaacagagggcaaatttgaatggattatgaagattgaattatccacttggtcttggaggtggtcccgtctcctgtgatggtggggtggggaggcggtgcagacatgtgtacaggaagcttagccaaatgcctctatttgggaaaagttgaaatcagtttcctgggcagtcaattttgagggtttaaaaaactttattttttttttattaaacatactaaaaataacaaagctatccaaaattagaccacgtactttgctccttttatatttcagtgtccttggtatgcttggtttcttttctttctttttgaagcattaatattgttttgaattgctagatatacagaaggtacgatagatgtacaaggaaaaataagcatctctcttatttctgtgtctaagtcacttgaattctcacctagaagcaagtaccattatcattttcttgtgagtccttttaaggatattttatgattatataagcaaaaatataggttttttaaaacaatgtttacaccccatacactattctgccctttacctcttttcacctaacagtgtgtcctggaaaacctttcttatcggaacatagaacagccttattcttttttagtatctaaatagtattcgattgtatgattttgccataaagtattcagtcccacattgatggactttttttttttttttggttgtttccagtcacttgctactatgaacaatgcttcagtgaacaactctctataaatagcatgttgtatgtcagcaaggatctctggaggagaaattactaaaggggaattgttggatcaaaaggaatatgcagttttaattttggtaaaccttgccaaattgccctccaatttggcattcgtcctattgtatgttcctgctagcactgtttgagtgtgcttttctccacagacgatgtttttaaacttcacgatctttgccaatctgagaggtgaaaactactatattctagtagctttaatatgggtttctgttattatagtggtggttgaatatactttcatatgtttaaaagccgttcctattttcttttctgggaaatgtatattcatcctcgttgcccatttttctactacgtttttggtttatcctgtgaattgacttttttttttaggagcatgtaacagctaaaaagattagtccttttgtcttatgctattttagtttaaatttttccgtttgtcttttgactttatgttttcttcatgcagggttttaaaaaattaaagtcatcttatttatcagatttttattttttggcttttaatttttttacatacttaggtctcttctacgcagtaattataatttttaaattgtctcgtattttttattagtattttaaaaataatagttttggccaggcacaatggttcatgcctgtaatcccagcactttgggaggccaaggcgagagcatcacttgaggccaggagttagagaccagtctggacaacacagggagaccctgtttttacataataataataataaatagccaaacatggtggcgcacgcctgtttgtactcgggaggctgaggtggaaggattgtttgagcccaggagtttgagactgcagtgagttatggtcgtgctactacactccagcctgggtgacagagtgagaccctgtctctaaaagaaaataaaaattaaaaaggttttattgagatatgattcatatatcgtaaaacttaccttttttttttcttttttttttttttttttgacacaggatctcgctctgtcacccaggctggagtgcagtggtgcagtcacagcttactgcaacctggaactcctgggctcaagcagcctcctgccttagccttctaaagtgctaggattacaggtgtgagccactgtgcccagccacaatgcagtcttttaataaatgggtttttaatctattcatagaattatacaatcatcatcaaaacctaattttacattttcattactccaaaaagaaaacctttacccattaagcacccactcccccatttcctctaccttctggcccctggtatccacttaatctatgttttatctctatggatttgcctgtcctagacatctcatataaatggaaccatataatgtgtggccttacacaactgacttttccacttagcgtaatgttttcaaggttctttctcatatttttatgctttcattttttacgttcaaatctttggtcaccttgggatttattttagtgcaggatgtgaattagggatctatatttttttaggtggccgtccaattattggaagtccttcctcccactaaagtgcagtgacacccatatcattcactgaagtccagtattcatttggatcgacctcttttctgttgaccttgctaagtattcctgtgcccatgcacactgttttactttctaaggctttataatatttttaatatcggtatggtattcttttcttatttctttttatatcattgttatggccattctttcctgtttatttttccataggaacttcagaattagctttctaatttgtatttttgacatcatataagtttatagataaatatagaaagaattattctcttgatattgactttctattcaagaagaagatagacctttgcagttgttcctatctcctcctctgtccctcagtagtatttaacattcttctttatgtagatttgttttttttttttttttttttgaaatggggtttcactctgtttcccaggctaaagtgcagtggcacaatcttggctcactgaaacctctggctcccaggttcaagcgattcttgtgccttagcctccccagtaactgggactacaggtgtctgccaccacacctggctaatttttttgtatttttagtagagacggcgttttaccatgtttggttaggctggtctcgaactcctgacctcaagtgatctgcccacctcgccctcccaaagtgctggaataataggcctgagccactgcacccagccctctttatgtagatcttgcatatagtcctccttcagtttatccctaggcattttatatttttgttgttatttaaatatgggatacctttttactggttgtcctttagaaaggttattgatttttgtatattcttttgtttcagttaccctacagaattctctaattaataagttgttcaattgacttgctcagatcatagcatttataaataataatttttctgcctgttataatttttatatcccttatttatttctcttatgcagttaaattggctaagtttaacagatcagtgttaaataacagagatgatggtagacatcctcatgttgttcctatttttaatgggatgcttctcatgttcccccattaacagtgagcctgcctttggggtggagcctgtttattgtccatttggcgtttgtagggcttttataatgagtagaaaacgttttggaaatgctgaatctgacggaattatttgcagaaaggtaaagtatgctgtgttagttctcccgcagtgataaaatagtagtctgatttttcttaccagcattgacaggagtttatgagtgggaagtctgtgctataaaggaagaaggcagcaattgtattttaatctcatgctatttttcttttgccaacgaagtaaaaagactaagaagctataggaatatgtagtaaaggcttttgctaagagagaaaaggaagaaaggtggaagaatgggatggaagaaacgagataaaagtatacctcattttcctcagcgtccccccagatcaagtcacctgataaaccaaatattactagggtagtttttttccccaaaatattattaccaaaaaatgacacaaaacactaattgtcaaccaaaatgataaagagtctccgaaaaggcttgcaagaaaatagtgaaatattttatcatttgtaagcaaaagataataatacagagttccaaatactgagaaaccacaagaggaaaaagaatgcctattgaaacatgtttatatgttgattctttttgatggtgccattaaagaaaaaagaatgttttgatctcttgcaaagaaagccaaactagagaggtattttatgagctaaccccaaacctgacattactctagtaataaataccaggacaggctgtcccttgcattagcagaactggaaaacaaaacaaaagacagtaacaattgaggctttgatgcttgttggaaacatctaacatacagagttagtgtgttgtggtcataaacaaaaggagtttaggctgactccataaattagggaaactgatgcgtcctgttgcttgggacacactacacaattatctgcatgacaggcaggaaagaaagcactggaaggcaaacagactgcagaacaatgtggccacccagttggttttagacacacacacccctggcctgcagaggtgtctatttgacagccggtctcatgtcaaaactttcttttatgtgattttccgattgtaggaaccactgggctctgggtgggtgtcttaggcgagtctgccttagtgttgagtttgacatatggtagcattgttaggtggtgtgtttaggagaagccaaccagggcctcagagccaaaagcatggagctcactggctgtgtgaacttgaccaagctactgaacttttctgagcctagtttgtcatctgcaagtaatgcctacagttcacggcttttgtatgtacttatgagatgttgtacatctagcacctcacatggggcttgtagagagcagttgctcaggcagtgtttgtaagtggagcacaggaagcaagggatggaaagagtatcacatcaggaccaaggatgaaggagtgtttgtaggaaagacctccgagatgatggttgagatggattatgtacaataaacaggaagcatgttcttgggaagtgcttctaagcatagaagggcagcattttcaaaggcatgggtgtggaggaatctttgaaacccagggaactgtagtagagcatggctcagtcccagggtatgagatggggagtttcactcattgagacaggacagatgagccagcgtgggattgagtggggactcgtgtatcctgttcagactatagtcacgatgatggagagtcgttaaaggctgtagacatggccaggcatagtggctcatgcttgtaatctcagcactttgggaggctgaggcgggtgcatcacctgaggtcaggagttcgagaccagcctagccaacatggtgaaaccctatctctactaaaaatacaaaaaaattagccgggcgtggtggcatgtgcctgtaatcccagcactttgggacgctgaggtgggtgcatcacctgaggtcaggagttcgagactagcctggccaacatggtgaaaccccatctctactaaaaatacaaaaaaattagccgggcgtggtggcgggcgcctgtaatctcagctactcaggaggctgaggcaggagaattgcttgaatctgggagctggaggttgcagtgagccaagaccgcaccattgcactccagcctgggcgacaagaaccaaactccatctcaaaaaataaaaaagctgtagacatgagggacagcatttcatttgcattttggaaatgtgacagtaatgtctctcgggtgggtttagagattggggaggaaatgagctctggcccagggtaatgatttcttccatattttccacaaatcttagcacagggctaaacgcatagtagatttttagggaaaacctcttgatggccttgaacaaaagttattgttttgccaggatcatcttttccatgaatcacttgttataccattagtagattattcttgtgtggagttgatcattttagcccccaaattatttttgtccctcgattacatcatcttaaacgattgtgtgttgtggcatagacatatcctaatctacttacaatttatggtgcaagtatctgtgtcataaaagatatcttcttctttaaaatatgctagcctagcactccatgaaaatggagactcacagtgctgccctgtccttcaaagatgtttatgtacaaagggataactgttcccacccctaaatgctttaggctttgcctatactgcctttcaaagctttccctattttaagattttttgaggccccttggatctctggaaggagaaagctataatagcttttggtttctgattgtctttaagcagagaaaactcacagtctcatttaggggcgtgacacattcctagtagggatggtcagtcccaggcaatagctgtggccatgggctgttgagggccatggtgagggcccatgcggtaacagacagtggtatgcatgctggactggggtgagtaaatagccattattcagaaccacggattctattttcaatcagtctgtcaactgatatttttgagagtctgccatgtaccaagcagagtgctaagttctgaagatactaaggtagacaagataaaaatggcccctacccacatggcactacattatagttattataggagagtggatagaacatatctagtcaattaccgtgcactgagaaaggtactgtgagacggaaatacaaagtatggtggaagcatcctggagtgacaactgaccctcacttggaaggccatgcaggacttccatgagggtcaagagtttcctgaacccggacaggagcaagatctaccttagagaggtttggggtgaaataacgccatgaaagggatagtctttaatctagaaggaaaaatggagtattacacatttgtaataagtgttcgagatagcctttgagtcatacagtatttggaatgtatgcttggctgtcagtgatcttataagacccaaaccacagttttctttatgctgtgtcctggcgctgccaatggccagctggaagggccatggcagggtagccacgtagagaggccacctcctagaggcgcatagcctgaacgaaagcggaatttgaacaacacctccgaaaagattggaaagtcatggtatctgtgcgattgcccacaaggaggtctcctgaagtcgaagccctttggttctctggcgttttaatgatttgctattctgtcatcggaaatacgtggagcagccacatccttagacagaagaggcccagccacgttgctctggagtagaatttagtatgagtgtgagtggaagttaaacagatgtggaagcgcagagtgcagctgaacatcattgacatggaccagcaggtaaacagacttcaaggtgatacacccccgtaaggcaatgttctggccagctccgccagtcaaggctgtacagcggatagtaattatttctgtcacagcgaagatagatgctggatgtgggcagatgggggtagacttgtgaaaagtgtgagtatctttgagtatcttttataaatttagtgagtggagtggcaacccacctacacttctaatttttgctgttggaagctatgtccagaaaagagaagagaaatttctctacctgataaattacaccttattcaaaacacactgtgtgaatgaaggtgctgcttcgtcttctctctgctaacgtaacgttgtgcacaatattttttcttttgaagcagcagaaggacattttaatagaaaaatacctttactcctgttaaaggagtatcttggagttcttcacctgtctttatgggggacactccccactacatggcttcataaggatttagggatgacttgctcattagacatagagtgagctggttagaaagacaagtgtgagttggggtacagtggcatagaatgtttaaaatattgagcaatttaggatccttattctggactttaattgtttctagagccagcctctccacgtgtgagtagcatctttgagtggcaagaaaaccattctgggttgtcattgagagcatgtgtccttggagagtgccttagcagtacctcctgtgtcctcccacgacacatatccacctatgcacacgtccaccatcctatacgcacacaggtgcatcttgcagtttcacagcccgagcacagccagagagaaatgactaacatagacttgatttttcgatttaaagacgctcctctttttgctcttcctcttgaatatgacttttcttttccttattttcagtgttttcaagggaaatgtcaaattttcagacccgtaacttctgctagaatcacagaccattagggactgtagagatctaacatgcccagctggaagcgccacagcaggatagctgtgtagagacgtgcagcaggcattcagaaaaacagatctgcatcttggaaagagaggtcagggctcgacttgtggatttcagagtcactcacttagaagcagtagacatagtacacatctaatgaaagcattcccctgctcggaaatcttcagaagtccctcagattttacagaatcaactcaaattactcagcaagacctttgacaccctccaccatgtaacctcttctttcctcctctcccacttctgtctccccacacacatacacctccaaccgcaatggtctcttgaacatattagcacacgtttcttcccactttttctcaagctgttttatttctttagcattagctcagattccacttccttctggaatctttctttcatgaattcagatcgtgaaagaccaaagggaatgttggggcctgtcatgaattagaaaatatattctctgttttcaccaatcacaagtcttgtatgacttgcctagaatagcttcctttatgtgttctaagggatatgggagcccgtctagactggcctccttcacagcgctgggatccgttctgcaaacccatcacagaaatacatgtggcttcttcctgcagtaaaatatgtaggaacttatccaagatttttctttttattcttcatttatgttattttatctccagtgttatgtctccaaggatgttaggttgaattatcccctctgaaaagccatactagtttttgaattaggatgcagtgattctaacttcaggtccactgtcaactcattagtttatttaggcaagttgcataacctctgccttaatttatcatctgtaaaatggggctaggagtaactcatgatttttataaggaaaaataagacctgaagttaaaacattttggaaaatgttttcaaatatggaatacaaacatgaggtgatattattgctaccatattgcttatagtcaagaaaaaaacttaatcctttttgataatctaatacagactgtgtcatactatatgttgcaaaaaatgtatagaacttgacattcgaagagatgagtattttggctctgtggtttattagctgtgtgtccatggctgacttacctaacctttttgagcttcagtttcttttctataaattgggaataattatgttactatttattagggttgttaagtaattatattctgcaactattatgcatgaaaggcacttttaaaactacagaagagcatagtcaacagtaaccatcatggtctcacttatggcctaataattatgcctactgtagaaatagatcaaaatgtatttggattcccttttctaggataccctctcagattgtcccaaatatacaagggatgaaagaagaaggaacaagtgtgggctgaatatgcagaagaggatggaaagttgacaggagcatgtggttggaagaggccatgttgacatgcagattgtgtgatagccacattgccagagctgagagggtgcaggagggaaggcaagagggaagccttggtatccatgtaaaaccagtgaccacttgctagggtgtgtccataagcattgcatgcctattctttttttttttttttttttgtattttatttatttattttactttaagttctggggtacatatgtagaacatgcaggtctgttgcataggtatacatgtgttctggtggtttgctgcacctattaacctgtcatctaggttccctcccctccccaccccagtccccaacagaccccggtgtgtgttgttccccttcctgtgtccatgtgttctcatttttcaactcccacttatgagtgagaatggcatgcctattcctttttttttttttttttttttgagacagagtttcgctcttgttgcccaggctggagtgcaatggtgcgatctcggctcaccacaatctttgctcctgagttcaagttattctactgcctgagcctcctgagtagctgggattacgggcatgcacctccatgccctgctaattttgcatttttagtagagacggggtttcaccatgttggtcaggctggtctcgaactcccagcctcaggtgatccgcccatctctgcctcccaaagtgctgggattacaggcgtaagccgctgcacctggccagcatgcctattcttgaatgtgccctttaagcagtagtggacaacctggggcatcggtggtatcctctgtgggacaacagacacctatatgggagctggttccgcttccctcacttatggctttttacagccatgtgccgcataacgacatttgggtcaacagtgggtcacatatatcatgatagtcccataagattataatgaagctgaagaatttttatcgcctagtaatgttgtagccattgtaatgtcctagtgcaactcattactcatatgtttgctgtgatgctgcaaccctactgtgctgccagtcatgtaagagtagagcacatgcaattcggtacagcacataatgcttgataatggtaataaacaactgttattggtttatgcacttactatactatacttttgatcattgttttagactgtatttcttctacttatttaaaaaaaaaaaagttaactgcaaaccaacttcaggcaggtccttccatagatgtgtaagaagaaggcactgttgtcataggagatgacaggtccatgtgtgttattgccctgaagacctctcagtgggacaagatgtggaggtagaggtgatatgaatgatcctgaccctgtataggcctagactaatgcgtgtttgtttcttagtattttattttgtttgctatttatgtatttatttatttattgagacagccttactttgtcgcccaggctggagtgcagtggtgcaatctctgctcactgcaacctctgcctcctgggttcaagccattctcctgcctcagcctcctgagtagctgggattacaggcatgcaccaccacgccggctaatttttgtatttttagcagagacggagttttactctgttggtcaggctggtctcaaactcctggcctcaagcaatccacccgcctcggcctcccaaagtgctgggattacaggtgtgcaccactgctcctgccttagtattgttttaaaaaaaaaagtttaaaattttttaaaaatgaaaatagaaaaatgtttattgaataaagatataaaagaagaaaatattttcgtacaactttaaagtggatgatgttttaagctaagtattattacaagagtcgaaaagttttaaataatgtgtttataaagtaaaaaagttacagtaagctaagtttaatttattattgaagaaagaaatttcaaaaataaatttggtgcagcctaagtgtatacagtgtttataaagtctgcagtagtgtacagtaatgtcctaggccttcacattcgctcaccacccactcactgactcacccagagcaacttccaatcctgcaagctccattcatgggaagtgccctatacaggtgtaccatattttatcttttctgcttcattttgactgtatcttttctatatttaggtatgtttgaatgcacaaatacttaccattgtaatacatttgcctgcagtattcagtacagtatcatgcagtgtaggtttgtagccgggaagcaatacattgtaccatgtagcctagatgtgtagtaggctgtcccatctaggtttgtgtgagtagactctacgatgttcacacaacagaatcacgtgaagatgcatttctcagagcatagcccaccgctacccaacacatgcctgtaggtgaggatgaggaggtatctgtgttaaactgtgtcccccaccaaaatgttgacaggctaaacctcccagtgtccatgaacaatggctttatttggaaggagattttgcatatgaccaagttcagatgaggttattagagtgggctctaatctgatatgactcatctccttgtaaaaaggggaaacttgggctcagagatagcctccctctgaggctattaccgtgtaaagactggagttatgctgcccaaagccaagaaacaccaaagatatccggaaagccaccagaagctgggagaggggcatggaacagattctcctttgcacctcctggaaggaaccagccctgcagacaccttgatctcggatttctagcctccaggactgtaagacaatgcatttctattgttgaagccccccagtctgtggtactgtgttattgcaaccccaggaaactaacacaggcaggtagaccatccacacacaccaccgcttctctctgacgcctggtgcacagcttgggtcttgtggtgagactccacatggtaggcatttgctggcggtggatgttaaaaatgacaagatttcctctggtttgacttttgaaagcaggtgcattgaaagccaaatctcagggtttggggttggtttagaatgggatttctgaaacattctaattgtctcattgccatcacctccccaaatactgtatctttatgtgcatttggaaggaaaaggagtgcaattgaacagtatatttccgtctgttaggcaaaaccttttatttgcttcttatttttccaggcttggacactttcgtgagaatatttgcagttctgttgtaagtccacttcggtcagggatttggcaagtccacaacaaagagagggaatgtttcttttcccttttcccactttccttgggcttgcctgttctttctctgaaagatgctagaacttccccaaggggagggcctgcctttttcctccttgggaaatgttgatttatattatatgaaacatttgtttttcatagaaacttccatttcagcatgttgaaatagttggttctaatttttatgtgaaaaataaataaacttgtcgtggcaatactctcagggtacagttacataataactatgtatgcctccccaccactcattaacataggagatctcacctcacggaagtcatctcatagtctaagctttatggcttctaacagcttttacgaaactccatgaaaataccttaaacataactgttacaagttgaaagtcaaccctttttataagtatgtcagaagtaattatatcttgtagtagcaatttcatatctctacttatagttgggacaattaaggctcagaaaaatggcaaagctgagattaaaattcaggattttctgatttctagccaatgtcatgctcattttctgtgttaattttatggctcagggtccagttaaaaacgtctgaagggagtggtaagtacaagagagatgggagttgggggtggggcttgaaggagagcacacctggccccaggtgacaagactgggctccagccctgcctcatcacagttggacatgatggccctgggtcatttgacttttgaggacctcaggaaaatgagggagcttaaaaaattctatggttcctaatgaaatacttagggatgaaattacagttctgggatttgcttgaagacacaatcagccatggtttgtcactgttgatgctgagtaatggatatttggtgttctattgtgagtctttggtacatgtttggaattttccatgaaaaaaccttctgcttctaaaatgcacaccttgattcttcccatcgccctcctactggctggtcctgtgcagctcactcatttctcaggaacagcagcagactcactactctgaaggaaagaaagccctttgctttggtctgttcctaatgtacatattattagagacttttccgacaccctccccattttttatttcttaacagctaatacgatagctgtgctttcataataaattcaaaagctgctctctatttctcaccagtttgaattgtagaaaagagtacaaaagattagagtactttaaaataaatctcagctaattatacatacaactgcattcactaaatgtgaatattttcaggctttctttgctaccaagtgccacctgctcatgatttaaatgggcacaaatttagttccattaaacaaaatgcagcaactcttctcctatagcgcaaactcctttaggtcctattttgaaactgagaagctaattccagtgttctcttgttagctctcggtccatgtcaaccaccccacaaggttgtttacttgaatagtttgcagccttgctttaaaagttctagtaggcaaataggtttgttgatgatgaagtggtttgtgttttataagagtccttatggtctagatggcatttgaacttgtggttccagtgattaccaggaccctgaattgaagaatacatgctgtggccttttcagctcaggaaactttttactttctattgccaaaaaaaaaaaagacaagaaatccttcctcaaaatgttatgtgttcttagcccatacaactgtctccccagaagtcactggactcaaacctccactttgctacttgaacatattaaggtcatttaaggagaattcattcatctcctattaatctggaacattcatgatcgctgtaagaccaaagaggacattttggggggtaataagaaagttaaagctgccttcaaatcaaacgtgaattatgaaactcttttccaagaagcttctattagtggcctcatcagctatgtttcaagaaaggaagttgaaaaaaaatcccacaacatggaatgcgtatttgccatgctcttagaaaaatggtttccttgcgaagactcctttgtctctacatacctggacctgaagaccttggtgttgttttataaccctggaagcctggctgtgatcatctattaaggaaggagaaggaagctgcttatctgtcctgaaagtcttatttctactcatcttctcgcctccttccacaccacctccccacctacacacacccttgccctaaattcctttccattttgtcctttcgaaaactcctccctcccttagaaaagctaaaaataatggtaatactttccagtgatcctcccttattaggatctcagatgcaagctgcaggcaaggaggaaagcctgcatggtcgctgctgctcacatctgcatggttacaaatcgtggctcactccagctctcatcttagatgttcatcctcacttgaatcccagtgccataacacgccaacgcgcctggaaaacacctgctgtctataggttgcaagcaccccacagcatcccagatgtagggtcatagactcagagaattgaatacacacccaaatcctctagctgtcattagggggagtttcacatgattgtagctacacccaggattttaagcccccaaaagttatttaggaaggattgcaggctcattcttgtgttcttaggagggtcccgacctgcggataaagacctagaggaagggggaggccttgaggcggagtcccccaagcagagccccaacttgtgtgtgatcctgcgccacaacttggccagccggcctggacagctggctctggttactgtgggaacaatgcaaggaaggccgttgtcacattcctctgaggtcaaaggcacaaccttcgtcacacactcagtccctgctggcaaagagaaagacgaggagcgtggaatcggagacctggagcatgcgagggacttgagaaattcaccaactcccttgttttactgattaggaaactgaggtgcagaggagagctatgacttgctcaggatggcacacccaggactggaattttctcttcatggtccaataccctgatgttcctctcatcatctccagtacttcagacttgatagtaaaaaaggattcttgataacattattatattttgttatgttttcccatgctgcaatcgagtctttaggttcgaagtgacaaccctgttacttttgttgcgagacccttgagtactcccaggacaaatctagccaacaaatagcatctttagtgaccctatgggaagtcattggcttctagccctaaacccagaggttagagttaatttttaagtgctcgcctttaactcaagcatgaagctctaaaagcatcaagtagtaatgcttgaaaacatctaaattcctctgagccctaggcatgcttaaactctctctctctctttttttttttttttttttttaggaaaatagctgaaatggtagtggttagaacacatgcaaacagaattactgaataaaattggtcacgtatcccctggtttaaggcatatttaggagttcaattcacatgtaattgatcattcttttttctcttggcatactttcctgtaagagtcttatgtgccctgcctttagcatatgtgcaagccgataaaggatgttcatttaaaatttttactattttaaaaatacacacagagggggaaaagacttgtcttatccccaaatgaaaagaattagaaataatacttttgcctgtaaacttctatcagttttcctgtcatgggaaagggaaccataaattactttttataaggaaagtggtggtgctagggccacatgtcccctcccgcacagaatgagaggtggtggtggctgcgggacggtgggaaggaatgagcgggacccaggccagagctcagctccctgggctttgcttgtctcgcattttgtaaactcaaatgtcccatcattcccaaaggccatttgtggacatgctgtgattttatgcatcaccttctggaaagaatgtgttccgttccctgtgaacttatccaggttgatacagtagttccccccaccccccatcttcggtgtcattttctgctgtttcaattacccacagtcaagcgtggtacaaaaacaggtgagtgccatgcaataagatattttgagagagagagagagacaccacattcacataacttttagtacagtataatgttatgattgttctattttattattagtttttgttgttaatctcttactgtgacttatttataaattaaactctatcatgggtgtatatgtataggaaaaaacatagtagatatacataaaggtactattcatggttttaggcgtccactggggtcttggaacagatcctccatggatgggaggacaactgtcttttgaatgtgtcagacacaattgtggcatttcttagtgtctttttcctactcgttagttgtatttggctgctgcaaacaccttgggctcccaagtagttgggaatgtggaaagctacatactttccctctagagagagccccagtgtgaaaaactaagatagccgtgtgtttgctgatccttgggacgagccagggaagggctccgggagcactgtgtgaattaaggctgtcaagaccaaagtaacataggagggagaagatgaaaatgcagcagcacgtctcttaatgtgatcgtttctctttccccttactgaagcatagtgctctctgctatttgaagagcgcaatttagatttatattaaggaatgaataaataggatgcggtgatgaaatctcatctggagtgaatgcagattgtggatgctaatgaccgtgtggctgtgcagagaacccattggaagcctgggcgcttctccctcctctgttcacccactaggcactcaagagcaactcaggcagtggggaaaaggttatctttttttaatgtctctcagtgttgcatcttgccttatagcgccttaaagcacttgacaagccttcaagtaattcttggtggtggcgttttcccccagaaggccttaagagatggttttaatagatacacctatcaatttattcccaacttgagcattttgctgtcttgcatcatttgacatcaccagaaagtcctttggttacttctgtagttcacattgtactttctgtcctttgagttttgggtgctcaggggcaagatgtcagaaatcctgagttttagttgtgccactgcgtagctttgaccaagtcactttacgttagcaggatacaatttccgtgttcattaaatgaggagactggactgaaagctcttagaggcctcctctagctcagacgttctgtaacactcagggctttctgcctcctctgatttggcggtgtcaggatacaggtccaagtgcggcactgtgccttgcaaaattgctctctctccctggccagcttttccaccactgtggaatgaagtctgccgcctggaagaatcccagatttctcaaaggcgtccagttctagggagcagcgtgcaaagcccttgagcacactttgacttcttctgccctggctggtgatgaaaaaccaggtcaccagaggttgccctgtttccagtgatcagccctcgggactgaaaaaggaacaaatacagaagagctccaaagaaagaaacagaaagagacgctcaagctgggaagctaagaacaggtccctctgctggggtggaaggagaaagaatcttaatcctctgccttcccccatgggtcagagtcgtaaatgggtgagacttgaaggtgtggttggtcaccctctctcaaagtttcagggctgggtcaggtgtcctagtagtgttgcgtggtgcagtagtgagtccccagcctgcattctgcaaagccccagaggctccccataaactttgaggctgtgggctgccctcagcctctattgaccggggcagcggggcagcttctccttcagctctgtgatattctgaggctatgtaaaatagttttcttagaaaggtcctgtggttaaaaaaaattttttttaaaccactggtttagttacgatgagctcatattcaaagcaatatgaccttagacaagtcatttgattttcccaaacctcattttccttatttcaaaacaagtttagtcatatattctcagcctgtctcccacagcaatttaaggattaattagagtcagttattcataccttcactctatgaacacggtattgaacacctttcagtagaaggctctgttgggagaggaactcataagtaaatacatgagacagccattccaagcagagggaaaaagcatgtgcaaatattttgtaaactgtaaaacacaacacaaacctaacattatgtaatattgctgttcttaaccaggcagtttaatatagtgactctagagcctaactccttggctttgaatcccaactgcagccatttatcagtgtgacttcaggcactttacctaccctcttgtgcctcagtactccaatctgtacaatgggaataataatagaactcatctcactgggctgttgggagagctgaatcagttccgggcgcagtggctcatgcctgtaatcccagcactctgggaggctgaggtgggtggatcacctgaggtcaggagttcgagaccatcctggccaacatggtgaaacccgtctctactaaaaatataaaaaattagccaggcgtggtggcacgcgcctgtagtcccagctacttgggaggctgaggcaggggaatcacttgaacccaggaggcggaggttgcattgagccgagatcatgctactgcactccagcctggtgacagaacaagattccgtctccaaaaataattataataataattaagagactgacacagagtaagcactctataatgtttattattggtgatttcaccaatgcactgtgaaattctgtttcttgattctcagcattgcagtcccctgtcattgcacttccagttttctcttccccagaagatgcatcccgtgttcgagcggaaaggcaagggaaacatcatgtcaagaaaagagttccgaacagtactctgtttctgtggcatggatcctctttcctctccttttctcctttttttgaggttggattggcactcctctcagacttaaacaaaggctttgctttgcagagaggatctttctgccttcggtgtgtcatctgcctctaagggtgtaatttgtttctgatgcatgcagggtgcccccttgagaaggctttgttgatgttgtgcagaggtgtcctgtattgatcggtgatagaactgttctatagtgggtgaatgaggtaattgtcatcaggttactctagtcggtgaccttgaggctgatccgatgactaagccacagaggtggatccctggttatagaatgtccttgtttaaaggtaaatcggtgtgagagtgactaatagttttaaagaaatgatggcaagcaaatggcatgccctttggtgagagacacagtctatatcaataagctctgaggccacccatatctgggtgagatattggggctgattttcaagggttcctttatctctctgctcctctcttatctcttttcattagattccaattctccataacttccatgaccgtgtataatacagtcactgccatgactgtgtataatatcgtcagtgtgaagttcagagcaaaatacataggcctctgagctagttggctgggtttcttttttcttttttaaaaaattcagcagtggggtgggacagagctgaagatgaaaagatgcttgatacaagagaagagagaaagcaagcgtcatgataaaatctgcatgcaaaaaaacccttgttataaaatgaaaagtggaatgaatcattagctatacatttaagctggatcaacacattagccctgtgattaagagtttctaaaacctacctgccagcatccctgctgttgctgaactggtcctttctgcatgggaatgggtagaagtctaaatgaacagacttagagtgggttggcaggtgaaggatagtgggggtaagtagtgaggagaggataggttagaatagttattttgggctgggcgcagtgactcatgcctgtaatcccagcactttgggaggccgaggcaggtggatcacctgaggtcaggagttcgagaccatcctggacaacatggtgaaaccctgtctctactgaaaaaacaagaattagccaggtgtggtggctcatgcctgtagtcccagctacttgggaggctgaggcgagaggattgcttgaacctgggaggcgtaggttgcagtgagccgagatagtgccattgcactccatcctgggtgacagagcgagactatctcaatcgcaaggacaaaaaaccaaacaccccatgttctcactcataggtgggaattgaacaatgagaacacatggacacaggaaggggaacatcacacaccggggcctgttgtggggtggggggaggggggaaggatagcattaggagatatacctaatgttaaatgacaagttaatgggtgcagcacgccaacctggcacatctatacatatgtaacaaacctgcatgttgtgcacatgtaccctaaaacttaaagtataattaaaaacaaaaaaaagattaaaaaaataaaaagaacaattattttggaatcattgaataacagtcagctctttgtatgttggtcaataaaagcaaacacctataatactgctctaagtgctttgtgctatattaaccctttaatcctcacaacttttgttatgtaaattttatatctgaaaacagtgaggttaagtgatttgcccaaggtcatttaaacccagatattggctctgccccggtgcccttaacacttatagcctctcactgtcctgggtggtgaaggtcttgagggcaaagagagaaaggaaattcctattttcagtggacatatttcttgtgccggtggaaggaatttaattattacaaggggtttcatcaagtgcactaatctgggaagttgccagcaagctgacctgggtttaagtgattctcctgctttgacctcccaagtagctgagattacaggcatctgccaccatgcctggctaatttttgtatttttagtagagatggggtatcaccatgatggccaggctggtctcaaactcctgacctcaggtgatccgcccaccttggcctcccaaagtgctggtattacaggtgtgagccaccgcacctggccaagacaccttttttagcttccaaatcgaagtctgtttttgcctgtatcatggttgtatttcagttagaacatcatttctttttttttttctttttttctttttttcttttttttgagacagagtttcactcttgttgcccagactggagtgcagtggtgcagtctcggctcactgcaacctctacctcctgggttcaagcgattctcctgccccagcctgccgactagcagggattacaggcacctgccaccacgtccagctaattttgcgtctttttagtagtgacagtgtttcactgtgctgaccaagcccatcttgaactcttgacctcaggtgatccatctgccccagcctcccaaagtgctgggattacatgcgtgagccaccgcgcccggccagaacatcccaatacataggcagccacttatgcactagagtccttctcggagggtgagcagagttggctctccctgtcggtggcatcacgttggcagaatacacacacttttatcctgtggcggttggcgaggccattgatttgctgcgtagaatagcaaggaaatactctagacaggtttaacatttgttattgctaatgaatttgtcaagcatcggaattcagggacggttgatgcacacttaaaatgctctgaaatagattttaccttttataaaagataataataatctcatgtttgaatcacaagaggtacgttttccttaaatcttttaattaactcctatttcaagaaaaacctcttatcaaaaaaaaaaaaaagattttacatttcctaaggccaagtaagagttgaaggtagaatgagtaaataaccaagtttatggaaattgtaaaataaatacatgtgttataaatgtgctatttaatgaaaatgtgtattgactagagcaataatgatgtatctttgaccatgataagtaccagtgctgaaatccatccaagccacaaaaatgattggagggtccatgtggaatataaagctctgcagagtctagagctcatatcctatatggctttttgctaattaataaacattggccttttgtctattatttaatagcctaattgcattgcacattgcagtagcacattgcaatagcacattggcaaaagtgctgcctttcactgctaaggggggcagttttctgtaaaagaggttaaaaggagaaatcagaagcctaatttttgttaaatgagatgtcccccaaaagtcagatacatgcatatttgggctaaataaatctttcctgggaaactcttctatgactgggcagagttgttcacgagagactttccccccaacattttattaggaaaaattgcaaacatacaagtaaattgtaagaattgtacagtgaacacccataaacttgccacctagattttgcaaataatattttgctatatttgctttgtcaggtatcaagccatctgtccatcctgcagtccatcatgttttagttgatgcccttcaagactagttattgtgtatcattactcaatcaaaataaaatattggctttagttcttgcttttaggtaaattttattttattttattattactattattattattattgttgagacagggtctcactctgtcgcccaggttggagtgcagtggtacgatctcagctcactgcagactggaccttcggggcttaagcaatcctcccatcttagccccctgagtagctgggactacaggcataggctaccacatccagctaatttggtttttggtttttggtttttttttggtagagtcagggttttgccaggctggtgtcaaacttctgggctcaagtgatccaccctctttggccccacaaagtgctgggattacaggcgtgagccaaccatgcctggccagaaaaacccaaattgagggacagtccacaaaatgattagtctgtactccttaaaattggcagattgtcacttttatcacatcatatgtgacctatcatgggctgttgatcttgatgacctcagccgaggttgtgtcagggtttgtcaactttaaagttactctttgtacacagacacactcacacacacccttttccatactgtactactcgttggaaggaagtcactgtgcacagcccacacttaaggggtgggcagttacgctctacctttacaagggcagaacatctgcatgaattatttagaactcctttgctcaagagatgcgtgttttcttcctcttttaaaatttatttatatcaatatgaactcatgggtgtttattttattctttaggttctaatccagtactatgttgtttattttgttgctctggttgttttagttctggccattggcagctctttgagaaatattaggaatattgtctcttgtcccccttttatatgcccccatcactgtggggtattgatttatctatttagcattttcccactttctgatactacaagatgctccatgctcatcttggatattccctgtcacagtactagaatcagccatttctccaaagacccctggtttgttttattggagaatggtgttaggaactaagttctgggtgctggggcttgcagaaattttatgcccaacacatattagctccccctcttccttttgtgggagtttggtgtgtgcagtagtgagtgccctgtgaaatcttcatgctacagattgactttagtccctcactgatcctagttcacttcaggaggagcctagctcactgtggcagactagacagaaggcagcccagccagtcaactcaacagatttcatttattcagctcaatccaagtcagacttggtgctgtgcttattcctgtgggcagatgccctgccctcacagacccctgccctctagaatcaaatgacaggacagtaacagagaagtgctgtagaaaatcagaatacagaagggctggtgcgacctagcctaagagcattcaaagaaagctgtttatacaagagcagacttaggaaggtttattccagatgaggaggctagaagcaaagacatggaagtgggaacagatagtctcttaaatatctatggataagaagaaagccgaaaataatgaaggactttgcttcttgggtttattttaggtaggaagtagggtttactgatcttggtgggatgaggaaatggaccagtggtgtagtggagccagcttgcacttttatgagccaagtgttaaatgttcagaaatttggggagcatgttgacatcatgttattaccttgaaattggccatggtgggagtgtttacactacagaagtctgcaaatgctacacatcaggggtcctctctcccctcccacttttattaaacatttctgcacacaccactggcttcagctgtctaaatatctagtatgtacccttaccctgaatttatttttttttcctctagtagtctttttcaggtacacatttttatttggtgctttgaattctctaacaaaactgtcaaaaaatggttacagtagagatgtgtgcccctgattgaaaactgcattttactgcatattggttaaaactcttaacggtcagaaaattttttggttaactgggttatttgggaccctctaatggccattctcaataactgagttggaaaagtgcatgattcaaatgtactaaaccattacccagccttctactttattttggcagcatggggaaacctgttgtcacctgaaggtagtcatcagtgtcatatatatgtggtcataggatttatggttgggctggcttggaggtatcttctgattcttaccaagaatataggaaaaaacgatatcattttctttcagctgagaaaccatgactcaacgttattctgcttgtagtaggcaatgcaaccctgtatcagtttgacttttgcaaggatgatacctgagtaatccagggaatagtgctatgcaaatagggacagtttccatgaagtcacctcttgtgcatggtatatggtgttaagtgttatgccgaattagactcagagcagcttacatttcaaacgagtcacctaaaagcagttatatgcgtgacgaaggagaatggttagggaaagaagaagacttctcttactcataactggagattgtgagttttcactgtgatcctgaaagataggttggctttgccttaattacagggatttcttttacctctttgccctttcctatgtccctccatcaggtatggtaaattttcctagcttttgttcctattagtgactttactcctgatccactgccaaattgggtctctgaggttgtaaaactcagaaaaggatattgcaagcattctggccatattacaaatctcatgtgagagctcactctgaatcaaaggagctctcacattcttttttagtccaagtgattcctagatgtggaagccgatttcctggaacactcaaacgaggtcacagttcatcagctgcctcccataaaccaaccctctcaagtttcaactctcatttgaaacttcttgggatatcttgatccaaacagatcacctgaaaagctcccttataaggtcaagtgatcacaggggtcttcttcttcttcttctttttattgtgataaaattcatcatttttcccatttttaagtgtacagttcagtggcattaagtacattcacattatattgcagtcatcaccacgatccatcttcagaacgttttcatcttcccaaagcaaaactgcatatccatgttgtagcatgtgtcagaatctccttcctctttagggctgaataatattgcacatatgtatcacattttgtatctattcatccattgatggacacttaggttgcttccactttaggttattgtgaattatgtggctatgaacactggtatacaaatatctgttcaagtgcctcctttcagtttttttgggtatatacctagaagtggaattggtgaatcatgtagtattttttaaattttttgaggaaccatcatggtatttttcacagcagctgtaccattttgcatttctatcagtaatgtacacagagttccaatttgtccacatccttgccaacatttgttattttcttgttttgggggttgttttttttgttgttaatcagagccatcttaatgtgagtgaaatggtatgtcattgtggttttgatttgcattttcctaatgattagtgatgttgagtgtcttttcgtgtgcttaatggtcatttgcatattttctttgaagaaatgtcaattcaagtcctttgcccattttttaatcaaggtatttgttttttgttgttgctcaagagtcttcttgcatgcctagatagtacactacttcaagaggctatttagcatttatctggggttccatggggcagcctgttccctttgcacatatgtaatgcagagatgaatatgtagagacttaccactggaaaactgcacctggaattctcagatttgcccatatctgcttatcatggacgaggttcagtggtggatgctgcagaatataccaccgactgcttttggctactgtgtgacattgtcatctaacttttcactaagaaaaataatctctttagaggaaaggaaggaagttgagagtccatcttataatttttcagtgtaataatattctagaccaggtattgacaaactggaccatgggccaaatatcaccccagcctgtttctgtaaattaagttttattggaacaccgacatgcctgtttgtatgagtatcttcaattgctgcttttgcacgacaatgacagattgagtagttgcaatggagatgtctggcccacacagcctaaagcatttgctccctggtcctttatagaaaaagtttgccaacctttggctgttctaggtgtttaagaaatactatttttagaaccgtatatataatgtagtgatgttgactgcaagctattcactttgaaaacaataaagcttatgtagtagatattactgttttaagtatttactgaataagatagacccctgttacattactgcttttaagtatttactgaattccaattttgtgtccagagctgtgttctttgcctttgttttttgattggggcaatggctttcatgtccttagcaccactggggctgttaccagatgtgaccaaaaggtttctaacatgggtagcactttttttttttttttttttgagacacagtttcgctcttgtttcccaggctggagtgcaatggcatgatctcggctcactgcaacctccacatcccaggttcaagcaattctcctgcctcagcctcctgagtagctgagattacaggtgtctgccaccacgcccagctcatttttgtatatttagtagagacagggtttcgccatgttggccaggctggtcttgaacttctgacctcaggtgatccactggcctcggcctcccaaagtgttaggattacaggtgtgagccactgcgtcctgcctgggttgcactttttaaagtcacagaatctgaattctgcctttcctctgtgatatttcctattcgtactaaactttggtgaagtagctctgatctttagctgtggtgagaggagttatggaagagggacctgccccgaaacgtagaccacaggcaacttgctgcctggcaccctaaagatggtttcctgcttctcttcccctctatctccaggtcagagatgcagctttgctaaggcagtgattgccaatttgggaattttgagatactgtggatgtgctgattgttttgtacaaattctcttcaataccttgaccatgtatacagtaaacttatgctagctgttagaggacttattaaggtgtatggacactgtctttgaagagtttatatggtatgttttggcagttgaagagtattaagcattgacttaaaaaattatgtataataagcattgagataatgggaaagaaatgctacacatacacacacacgcatacccacccgtgaacacagacacccaggaaatcataaaacctgattgacttctatgtgtggatgttttctttttttattcatttaacttatattttaagttcagatgtacgtgtgcaggttcgttatataggtaaacttgtgtcatgggggtttgttttacagattattttgtcaccaggtactaagcctagtaaccattagttatttttcccgatcttctttgtcctcccacctccaccctccagtagattccagtgtagatgttctcttaagtaaaacgatggggtagtcgttttgtacagtccaaataagattccgacaatggatgaatctgctaagaggttaccttttgctccagatacaatatttatctaaaaggaaaatgaacccttaacccttccatggaatcgtactgcttcactaactttttgagtgaagtgatgggcattgatacagtattgaaaactttcaggcccttttctttactttttgacaatttgaccttttttcacccctgaaatatagcaatcagtatttctcttctggatctggttctacaacctacgttgattttaattactttccttgaaaaccattctcaaaatactctctgccccttacattttaagctttaatgttgaaaatagagctttggtaagagtctccttgaaaatgattttcttcagccaatatcagaggagtatttccttatttttatatttatatgttttaattccttaagaacagatatctaccaaatttcatggtatagatttataatcatcttttcaattttagacaaattttggaattcagatgttgctctttgaaatgctggtgacttctccaacttggggacattcacggactcaataagcatgccttttatttatgattctctgaggattcattcatttctgcatattttgaatgtctgctacacagagataaatgatgtaaaatccaggctatcagagctgggtcacaatttagtggagaagatgagtacgacaaaaatttaccatggagtgtgaaaagtgctcctcatagagacatgtacatcatgccatagtaagtttagggaatttggaaactcacttaagtcctaactcaatttaaattgtgttagactgtggataaatttatccgacgagaaacacataataatatgtatctactctgaggtaataaatgaaaaaagttggataaaataaaatacatctgttataaccaatggcccccagcaaggccagtgctcttgagccattattattcctgcacattctttgtgtttgggttattaacattgcgcttaggtcagatgagcgggtgttcaatctgccacactttgataactaaagtaaaatgctgatggagatcatttaagactgtctctatgctgttgattgcatgcttgtggctcataatcagaatgatgcaaagtaattgttagactgacttgccaaggctacattttgtgtcgttgccactgtcagcactttggtcccgctgtgctgcctgaagaacgcttgcctggcacctgttgggcactaatacacaactttccactgaatgtcatgggtaacttttgttctcatatcctcgcttgctatcttcacaaaaaaaaaaaaaaaacaaaaaaccctgacaaagatttttttttttttgacagagtcttgatgtgttgtccaggctggagtgcagtggcacagtctcagcttactgcaacctccacctcccaggtttaagcaattctcctgcctcagcctcccaagtagctgggattacaggcacacaccgccatgcccagctaatttctgtatttttagtagagatggggtttcaccatgttgcccaggctggtctcgaactcctgacctcaggtgatccacctccctcggcttcccaaagtgctgagattacaggtgtgagccactgtgcccggctgcaagtgcttattttttgtttgtcagaatgcttatgtattgagactttaatctctcgtgcatgttgccagggagctcatcttttctctttgaccgtgaaacccagacaaacctagctttgtcacttactggtgaccttggttaggttacttttcttgagccttattttcctcatctgtacaatgaggccaataaaacctattttacagagattttgtcaggattaaagataatagataaaaatgtgtccatacaaattagccactcagcaaatggttgtggcaaatattaaggaatttaatacttactcaggatgatacaatacaacgacaagacaacatttccaaaagttagtccgaaaatataatgataacgtaactgtggaacatgtagtatcagcacggttttactgggcaagtcatgtttaccagagacacacaattggatttggatgttaaaatctaaaccgcatggttttatggctagatctggaatacatgatatgttatgggccctcccatgtataccttcagaggatatggagctacctttggaagcaatgtatgatttagtgtttttctttttttttttttttttgagagggagtctcactctgttgcccaggttggagtgcagtggtgcgatctcagctatctgcaacctccacctcccgggttaaagagattctgctgcctcagcctcccgagtagctgggattacaggcgtgcaccaggacacctggctaatttttgtatttttagtagagacggggttttgccatgttgcccaggcttgtcttgaactcctgacctcaagtgatcttcctgccttggcctccgaaagtgctgggattacaggcatgagccacagcacccagcagatttagtcttgatggtgtaaaaaagccattgtatagcacacaacacagcctgaccatctaatgctcactcatgtaaaagcggtgaccacgagagagttgggcaaagcaaaaactctgtccctataagaagtgcattgttagatctggaaacatctcaccaggtcctgaattgtactatgaaaagagatttgttaaaagtagctcagttcatattccatgatattgcaaatgcctagagtgaattgtcaaagaaatgctctctctgactccatccactgctgacatttaaggtctgtgttcttagttcccaacattgattctatttcacatggtcaaaatgtaatagacatgttttttctaagagcatgacccccaccacaaattaccactccccttaaaaattgcatcggctggaccagggatgaagcatttagggagcatttgttgtaagggactgtcacctgccattggttatggaccttggtttcacagatcagactctgtgttgctctactttgcatctccgcctttgatctcgctgggattttgcagccagtatctatctcctttggcatttctttgctgctgctatgtgttctttctccctctgctgctctctgccagccccatctcctgcctgattcatggagcagtgttggatacttagaaaaggttaactgcattcgtgtctccatggctggagacacgatttccacacactctgcccattgcggggatatgctcacttccccagcctcccctcaaaagtgagattttcctggaatgtcactagtcgcggggggaggtatggcacccttaattgagggcaaggatgtgtcatgtgacttcagcaaatcctatcacatatatttttaccaaaccaaccattctctttgagaaggaacttagattagaaatattaacactgaatgaatattttaatttttgataccttctaaagaaatatggtaagtcctgattttttttttttttttttaggttttcaccttcaaatagtgatttaatttctaggatcactcaagatcatacagttttttcagttaactttcctctgtatcattaagtaactctaccatgattgggctgaaacaaggacatttgcttgacttcagacttagcgatttaatacttgatctagccatccctattcacccattatcccgagtctttaaaattgagtcctttttcgatatgttgaacacccactgaatattcttttttttttttttttgagatgaagttttgctcttgttgcccaggctggagtgcagtggtgcattctcgactcactgcagcttccacctcccgggttcaagtgatcctcctgcctcagcctcccgagtagctgggattacaggcacctgccaccaagcccagctaatttttgtatttttagtagagacagggtttcaccattttggccaggctggtcttgacctcctgacctcaggtaatccacccgccttggcctcccaaagtgctgggattacaggcgtgagccaccgcgtccggccacctactgaatattctaatgtgtgattctattccctgtggtatatgtgttagtttgtgttcttctatgctacacccactcaaaccaaaacaactttttgctgttaaggctttttatatttattcagcctgcctttctcaatcttgaaaaatgtagaagaaaaagaaccacatgctaccacaatatgtagtcacttcttataaacttgggacactttggtagactctgtaaattcaacaaataaatatgtattggttcattccttcaatgtaatactctttcagtcctcaaatgttatgatgttgatacatctattgatgttaaaggaggttttcaatataattaataagtaaaaaaaatgagacagcaaaatactatgaatactatcatagtacattataaatagattgtatgtatgtatatatatatatatatatatatagatttatttctatatgtatgtgtacaatatactctgtatacttgggcataggagagagtctggggtcatataaccagactgttaatagtgattattagtgggacttctgtggatttgtattacttgggtttttctatttatctaattattatacagtgaacagttttattttgttctcatttgtctcatccactttttttgactgcatagtcctgtaatttttttttaatttttaatttttttgtgggtacataggtgtgtatatgtatggggtacatgagatgttttgatacagacatgtaaaataaacacatcatgaagaatggggtatccatccactcaagcatttatccattacaacaaacactccagttatactctttattttaaaatgtacagttattattgactatagtcactctgttgtgctatcaaatagtagatcttatttattctaactactttttttgtacccattaaccatccccacctcccctccagccccctactacccttcccagcctttggtagccatcctcctactctctgtgtccatgagttcagtaggtttgatttttgaatcccacagataagtgagaacatgctaagtttgtctttctgtgcctggcttttttcacttaacataatgatctctcgttccatccatgttgttgcaaatgactggatctcattcttttttatggctgaataatattccattgtgtgtatatactatactttctttatccattcatctgttggtagacatttagattgcttccaaatcttagctattgtaaacagtgctgtaacaaacagaggaagtgcagatttttcctcaatatactgatttcctttcttttgagtatatacccagtcgtgggatttctggatcatatggcaacttgtctcatttacttgtgaggggtgaggaaaaagggaatacagtacaggtactcacattctggtaatttttgttgttgttgttgttgtttttgttttgctcttgttgcccaggctggagtacagtggcatgatcttggctcactgcaacttctgcctcccgagttcaagcaattttcctgcctcagcttcccaaatagctgggattacaggtgcatgccaccatgcccggctaattttgtatttttagtagagatggggttttaccatggtggccaggctggtcttgaactcctgacttcaggtgatccacctggcttggcctcccaaagtgctgggattataggagtgagccaccacgcccagtcacattctggcaaattattaagtcaccaaagtctctcctgtgtctttcctccattgttacagatatatgaacatgttgtgtgccaaatggtgataatgcctttttgttttattcagtctcttctgtgtaccaagcgccacactaaaaactagaaacattctatgaagtcgatattgttattgccattatacaaatgaggaaagggttcagagagtttaagtaactggaaccacacagctcctctgtgactcagctgaggctcagactgaggtctgactttgaaatcagttttcgtggtctcaagaattcgtactgtagacgtctcgtctgttgttaggatgaaaaggtcaatgcgtgtgagtggattataaagtgttgctttaaaacgaagaagatactcagagattttgccagtatctaccatttttcaatgtttgcatggctttctggcagtttttttcaattggagcataacctttgtctttgcagccccacctagcctaggatagtctgactgcatagtaagtgtcatgttaaacacttgtgggctgctctgtgggacttggaggagtgcccttcagattctgaggaactgagtctgggaatcttcctgcaggctggtgggccatcctgaaaaagctctatcctgccctggtggccggccacatgccgtccacgtcctctgatgaaaagggcgggaaagctgtggccttccacagctcatagaatgaatcccaaagatgctggaatcctgggaaacttgcccacagaacatcaggagctggaatagctttgcctcacagcctctcttaaacctgcaaaggcgtctttaaaatagtctctggagattattgttgagttggatcttgaacttagttccttgtgtggtgtagattaaatagtctgttgccgtcgctcccttatctccctttctttcaggcttcctctgtccaacattcacatcatctctgttctttcccacactttgtttggcccgtcagtatctcagacactgtggcttcctcacgggattactcagtcagcctgatatgtggcctccagcgcccctctgccaagtccacattcccatatgagcctaattacatacagatcactgcagggagtgaagctgtgggtataccattttgggaaagagcaaagtgcaggaatggggtactttggttatttattaagacttcttcacagcctggcaatgtagcaaaactccatctccgcaaataaagaaaaaacacaacattttaatccaggtgtggtggcacatgcctgtagtcccagctacttggcggctaaggcaggagtttgagtctaggagttggaggctgcagtgagctatgatggcatccccatccacggtcactgaattcccccatgagagggactttggagggaggatcccagggtctgagctcagctctgccactcacagccatgtgcacgtgagcaagtggctcagtcccctgggcctcagggtttccagctataaaatgggcacggatctatgacaaacccgggtaacaaagcaagaccctatctcaaaaaaataaaacacggctgggtacgatggctcaaacctgtaatcccaacactttgggaggctgaggtggaaggagcgcttgaggccaggagttcaagaccagcctgggcaacatagtgagaccccatctctacagaaacattacttcaaaaaaatacaaaaaaagacttcttcaataagcatcatggtgggcatggaggacatgacattttaagaaaggcacctaaaaaattgatttcttgggcaccacaatatggactccttgtcacaaggaccatacatctcatgataaatgaatcatgcctgtgattgttctctacatattgattgttcaaagctctgcttttaaaattcatatagtcagccaaataatcacgcatctattgttcttcagacatttattgtgcacctaataaaggccaaagtgctaggggctggaatttcttatcacctctaggcctgctcatttggactgatttagagaatggagttattaatttttttaaaaaatctttttttctattccagttttccaaagaaattagaccattttcttcgtgagaaagaaatcgacgtgctgttttcatagggtgagtgatcctttgaatctttcatgtatttttacccacatcaaaatattatccaattactatgatgcaccaagaaaaagtgtgtgacagcatgcactctctagttttctcctgcttggaaccaaggtatttttcctattctttgactctcctcatcactgggtcctttggagaggatggtttcccttgtagatttttctgcgatttcttttttgccgttcacatgctttgcctcgtgcgaggtcatcattgttgctattaccttgtccagctcacagaaaggaagtttctttccctcagcaactggtgcacagagatacagctgtaggcaagggggaaccatccagtttcaagtgactgtgatgtcttttgaattccatgaccaagaataacaggatatgagcaccagatgagacctgagagcttgtctggcaaaggccctatgtacagatggggcatctgaggcccagaggctcacatcacctttatggggcttcatggagagtagcagagctaggattttgatactggtgtgtttggctcctagctgcatgatgtttgccctgcacaagtctggttttggaatctgcagattctttttgaggctgtagagttataggtagtttaacttaatgtggtcttggtaatctaataatgatcacccctaaggcaagggtcaagactgatactgatagactatttgactttctcataatcctagttggctactaagtaaaggggttggcagagtgagtgcacccagaacacttctgttatggatgtcatctgagaaagcttattttcttctgcgccctttccaaaccactgcatctgcaatgccacgttgtcatgtgctgagacttggtggtacatctgctttgcagctagaagtcatggtacacctgcaggtgtgtgcagtccagctgcagacccacacacccgactcgcggttgtctgcacctgcagaagaatggctaacagggttcctatattgaagtacaaatctgaccttcatagagacttttgagaaacatttattcttttattttatttgtttatttatttactttgagacggatctccctctgtcgcccaggctggagtgcagtggcacgatctcggctcactgcaagctccgcctcccgggttcacgccattctcctgcctcagcctcctgagtagctgggactacaggtgcctgccaccatgcctggctaattttttgtatttttagtagagatgggtttcactgtgttaccaaggatggtctccatctcctgacctcgtgatccgcctcggcctcccaaagtgctgggattacaggcgtgagccaccgcgcccggccccatttattcgttttttttaaagttatgttggtttttacataagagtgcagttgtgcaataagatggagagaagttaagaatatgattctcagttagaatcccagaaggtaaacttgactgtgtgtgtggtttgtttgtttgtttgtttgtttttttagacatcctaggttaaatctggcttcaaattgtgttcatttaggttggtgaactaagtgcacttatttccaaaacatttcatctcacctagggagtggtcaaagggtagtattaagagcttgtgtttattattttatccaacttgtcagcttaatcactttgtcttcttccctaactagagtcattattgcggaacttgatcatctccttatgtacatacagacgtaattggtgtctaccaacatactgaatggaatgtagaacatagattgctgatttgtgagggatcatctgctgagttaccctaacattgatcgctcctgtccacagagctgggtctacacgagttagcattcattagaactgtgaaggtttccattttcctgtcttatctgagaaaagcccaaaaagtttattctcagagcacaccacagtacaatgtgggtcactgacacctgttgctctctggggactgtaaaggtctctttagagtcaagagattaattagactaaaagaagggggcaattaagggccttgagaaagtgaagaaatgtccatttccatgcttacatcataggattctttgggtaaagaataaactggtagagaagggtctgaggcaagaaatggtgaaggaatgaaagaaggactgcctgaacccatgtagaccacttgtggctactttggtttccttctggggtcatgagcactttgatgttgacattcaagagggcatcaaattattatccaaaatattacaagccgtaatttttttattttaccaaatgagaaaaaactaaacacagatagaagccatgagtatttttctccctaaaaagaagctcagaagctggcccccacatgcatatataccttgtaaaacgtgagtccctgggctcagtttcatggtatgcaatggggctgggtcttgggaacaatgctgctgttgtttctaagctcaaacagcactcaccatcaatggtatctctttaagggaaatccagggaaatgctcttgccagcgctgtgattttatttgctagaggccaggtggcaatgacatgcattggttccatagcaacgtgactgtgctgccagaaaacatataatgactgtgacagccagtgtatcctgggcaggatgagggcagccctgataccctcttttatttcccaccttatcctctcttgcctttcccctcctggggcctgtgatatgcggagaatgtggttttcgtaatggttactatctactcttgctattaacacttgcctcctgtctcggtccatcttggaacttgatgagagacaaggcaatgcctgtaggagtgttctgcaggcctctgaatgggtcagcagggttggcagcacctgcctgtcttagcaattgaaaggaggtggagagtctgtgcttttcatcctccctgtgtgtggcacagcggctctgtcagaatgacctggtggggagggtacttcctgggcatcgtggtcagctgctcctggctgaaatgtgtgggtagtgacatggagcaatgtgaaatccagggaaacagagtgctcatttaatatgctgcagattgaggagacacctaccagtggagcctgcaatgccaggcccagtaggactgcacagagaaatgcaatacccatttctcatcttctgggagctcttaccagagaggcagtttctaattgcagtttctctactgatgtgtggttggggctttcacatttctctaatgtttcctcatctatataatccttgatgaaagaattgtaagaactcttagttccaacggatactttttttcccctctgaactcctgaagcatttttaaaaatctttaccatccatttgacattgctcttgtatttccttttttcatatatattgctttgggggcctgagtgttttctaggtcgaggctaagcccttcaaggatacgaaacatgtatcttcttcttcctcttaaaaaaatttctctaatgctcacaactgagttctgcagatagtaaccatgacattaatatttgttcacgacaacgttatattctcactccatctcccaaggaaattgtgaggcaagtgtgtaaatatattgaaaatgttgttcagttcttcaaagaaaagataaactcaagaaattattttcctaatgtggtttttttaatgcagatataaagtcacaaggtaagaatatctaaaggcttcatatttcctcatcttcctctttctggctactgaccatagcatatacccctgggttttatactggcaccaaaatcatcctttttcccacctcactcccaatattcactgtattgaatttgtctttgggatcagacttctcagtctagcgttttggactattaagtaagagatttgagggatttttccattaagatgacagatagattaggtttgatagattaggatagtgattcctaatttggttttgaggtctgtttaggggagggaaggtttttatcttatggaaacttttatcttacaagagttctcttcccgtcccaagttctgagcccactgagaaataagacaagagtattgaggcagacgggggccagaatgcaactatgtgactgagggcaatgagctaacttgacacctgcctgttccccagtctagcctggtcgcaggccacctgcaggaaagttttgagtctacaggcacctgtctgtgtgaagagggaaggagaaagaggcccaaatccctgctaaccctgctcaaaattatatagattcaccctatccaaggagggggcataggccacgttggctttagccccagccgggttactcattccacacccttggggaagaaaaggttggagcaagaggtcagagggcataagggaaatcctcccccatagaaagctggggtggggcgtggcgtttccttcctgctctggccatatttctgctccctgcaccccatcaggcctacccgcccccagctcactcaagccttcttacctgttgttttcttcgtggcgcttgggcttctgcatccgactgctggtttattgttagtctcctctattagaattagctcagtggaagcaaaagccttgtcggtctcatggactgcatgtatcccagtatttaaaactgtgccaagcacataggaggcatttgatcaatatttgttgaatgaataaacacatagatgttgtttgatgcctctgctcacactctttaattacctggacatccctggtgccctgtcttgtctggcaagtctgtaggagctagttcagcaatcgtggtctcttcttgctctgtatgtagctcatcagttggcagtagttggcatgtgtgcatgtgtgtgctctcatgtaggtgagtgtgcatgtgtgtatctttgtatgcatgtgtgtgcacctacatacctgtatccttttgtgcatatgtatttgtatgtacttgtgttctctctctctctggctctgtaatacttcacttatttgtttacatatcttttacccttactagattgcaaatgcttgaagaactggggaacctgttaatcattcttgttcctctaatatctgccatgtagtaggtgctcagtatatgataatattagcattctaagcacttacaacatgcccagtactgctttattttaaaatttaaaataacttttatgtatcttgcatatattaacttgtgtaattctcacaacaaccttacaagatacattttaaactcgttttgtgggaaaggaaactggggacatgaagaggtcaagtggctggcccacagtctcacagctagcctgactccatagctttttttctctgctacctctcagaaactgactactgtatttgtgtgaatgaacaaatgactgaatgagaattttagaagcccagaccaaaatcattaaatagacctaaagacattagggtcaacacaaataagtaaaaatgatgagccatggttgacacagaatcaaggccatggctaagataaattcacagatgaatagctaatgccttcttgtagccattgcacttaattcctgatgatccatgcctgcatggtggtattggttaatgcaaatgaataattgttattacgtattgggaattatttcctagtgggaaaatatcaagtcatcagttatgagttaagcagctactgcttgcgaggctcacaactaaattttggggaaaatgatgagaggaaggaaaatgtgagttggagggtgaaaaggtaagccctgaaagtacaagccaaggtcactgtcttcaagaggctcttgtctcattaagtggcaaggagtgagtaaaagtgacattaaggcaattaaaagatactgagggcagtaaatataaagcctagcacaaggcattgttagacatgattcattaccaaatggtaataatagagaaaataaaagctattgtattagtcaggataggataagcttttgttgcagaaaggtcaaccctaaactttcagtagcttagcaaaataaaagtttatttctcattcatacagtgaccgctgtggatgcagtatctctccaggacaactgtcctccatgcataactccatgatgcagtctgctttgatctttttatccagccatctaggggcctctttcatgatcactggaagagagaaaaattggaaaattgcaccagcaattcaatgcttcaaagctttggcctagaagggacacttgtcacctgctatgtcctaagcatggcttttagctttttgtataactcccaacgtcccagtcctctcacacagcacacagtaggtgctcgataacgtgtagggtaaaagaatgaatgaacttaagaatgcattgtgacttgctcctgatggtgttgtagcagtaatatacctggcagcccccaaagcccaggcttggaacagtcagatctggctcaaaaatatttactaaaattaaaagagcattaataaaaataacaacatagttaacattaattagctatggtgatgggacaatcataaggacacgggcaaattaaactcaatttagcaggtggctaaacttacgctaaagccccggcctgccagacattggccttgtcttagacacatcactgtctaacagtccagagctcaactcacagttcacaagtcatctggtcccatcttgtctttctgaccttgttcctcctgaatgagatggagatcattaggcttgttaaaaattaagaagctttattaaggcaaagttaacctgtctgggatgcttccatgattccatcccaggtgtatggaccaccctataccatccccctcctgcatccgcttctctcatgctttcatctttcatctggggtcctggtgaacagaccacaattcagctccagatcaacgaagaggggcttccagacaggggccacgcatatgctgaggaaaacacagcaatctaacatgtaaagtaagtgggaagctccgtgtaggactcaacacggagaatggacagctcatagagagaaagggggagactgccttggacagggagataggggtcacaccacatgtgtcagaccaaagaatggggacccctcaaccacattcgctacgtgtgtattatgtggtgaagagaaacctgcctgcgaggaggactgagtcccagccactgacagattcccaggacacggtgcttcttgttggtttgtggtttgggggtggtagtggtagggagggaggagtggtcactgtgtaaatgggcagtgctgtggggaggggtcctgaactgggggttggcagtcactggagatttttcaacaagttggggatgtgaagaaccatgttttagtgagatgagctttacagctgtgtccatatcccgtgagatggtggagaaaaaagagactggggtcccagagggaaggcagttgcaggcgtaaggagataaggttttgagaactactgtgggcgtgttacaaagggaccgatgtggaggacactacaaagaaagagttgaacaaactgagcaactgggtattagaaacaatgaaaggaatggagtcagagataacccaatttttgagcctaggtggctaccgaaggtgtcctgtgttgtactttatggatattattattattaattattattattattattattttgagacagagcctcgctctgtcgccaggctggagtgcagtggcgtgatctcggctcactgcaacctctgcctcccgggttcaagtgattcacctgcctcagcctcccaagtagctgggattacagcctcccaccaccacgcctggctaattttttgtatttttagtagagatggggtttcaccatgttggccaggctggtctcgatctcttgacctcgtgatctgcccaccttggcctcccaaagtgccgtggatattattttaataacagtgtcatcccatgagatagagagcctgtggcagaacccagggattgcctgggacccagatatgcccacgtgagtatctgagttgccttaaccccacctcccttccttcgagccctccctccccaaggtttaggatcaaatcttaaatcagcagcaaaactgccaggctgaaatttcatctccatcctggccctctagtggagataaaatggtttgaatgtgggcgagaaagtaaaacggaatgtgtggttgctgagtctagctgttgataagagagggttcaccatccacccatgagaactgtctctctcctgctggtgtgcctcgctctcagacgcagcctccctatggctctgggacatgaggggtaatgtcttgccggttggtaaaattcttgcaagctgacagtctttttttgtttttcttttttttaagctccacaaggctactgcacattgcgttcttgctctttgtgatccaacaagagggagtcagttttgatttgggagaaaggaggaagaaagctgtttgatgggcgagaggaggcatgtattgattgcattcccgttttgctttctggggctggctggtcatgtcactcttcatagctgcctggctctagtggtagaagagagtctaatgagagacgctacggctgtgtgcagcttgcacacagcaactcttcagctccaaggaatcagagtgagctcctgagctccctgggattcagaggtgcctcagccccaaatctttttcccctgcatttaggctagaacaggaaagatgctactgggagagaagagaattcctgacatcttgcctttcttgtctgctttctgcttgggtctgtggagcagccacctctgggcagaggtgcaggaagtgtgacagaacaggaaagctttaaagtcactgtctccctccctcccatgccctaggctacccttgctggtcagaacctcctgcttactctggtggacagacacctgagttgctgctcttgatgaagtttctcccacttcttcaaaccagcaaggcataggaccccacttggcttggaagacacgtgacgctcttgatcatttcagtcccttttacatccccataatatcaccgtggcctgttagattgatttgtgagtaagattccttgcaaatagcaagatgatcggaagcctctatcttttccgggggaggtgcatatttaaacagacagcctaagctatttatagattgtaatgtattgtgttacagggaaaaggtggaagtcaacagtaatgttctgttccccatttcctatagtttcaagcatattttcttgctagtcctagagactttaaacatttagaatctccagtgatatctatattcttttgatgtactttgtgtagaaactcaagcacgagcaggcttcagagtcagctaaccaaagaatcttggggcttttgatcactttccattagcacaaacagtgatctctgccctgttgtatattgtttgaaaggacatttgctgtttaatgaagataaacatgttgctgggtttttaatatgtcttctcaactcaggagctgaaaaatgcatacatgagattagttctgttggcgtagaagggattctgcgtgccccaaacattttcctagccgttggctgaacttttgaaatgtgctttgcactgcaagaacagatactgaacagatattttacttagaaagccttctgtttcaatggtgattcccaggggccactcaaccacatcttactaaataatatttggtcaaaagagaaacgtgagtgcaagaaggacacatgatcacagccactaacaaattcctagaaagtgctgcttgttgtcatttctggttaggaggtgatggtgatggcaggtagagggtctaagccattctcctgtctctcttttaaagtacattcttctgttgctgtagctcctggcattggctgtcaccctcacttgcaggagggagggaatgactgtttgttgctgttggtgtctgaaaatctgtgggcagaacttttagaaaaagcagaccacagagcctgctatatattttgttcagcccattctatttctcttcactttttaaccgattgcgacaaaaaaaggggcctgccttctaaacttgtctttatctttaaaagagaataccttttataaatgcttagaacttggagatgctgttgtttttatttagtatttgaaaagctaagtatgctgacactgtcctgggagtgcaggcccctcattgagagagaacagtaaacacagcaatgactttgcttttaatttgaaatgcgttactcttcttagagctgaggggtgatttgagatgttcctgttttcacattcagctatttcctggttctgtgatcataataaattccatagctccaaaacattagagcaaattgtgtcttctgtaggagttatttacggatactcaaacaaatggtgctttctgaggaagaagaactgtgtatgaaaactatgtggtaaagcctttcatatctgccgtggtggcagaacttctgaggagctggctttgagggtaatgatatctttatcaccctgacgctgaatggaggcggggaggcctttgtgtgttctgttgccaactaacacctggctgcctcagggcatcctgcctggtaattgaacccatgagtatgtacaaagattagagggaccgtttgaggagaaagatgggggctggagaggcaaggttagtcttgccattataagcttaggtgcagaaggaagccaagctacctggaaggccacctcgtggcaaagacacccactaaggcagggcggtggcctgggactgaccatcaatcacttcccgctcattctcctcagaactgaggactgttgtcttcagtcttccccagcctcgcttatcttcctcctgcttcctgaaggaaatatccttttgcaatgggtggactatcaacttgaatttttagcaagcaggctggagaagtttttggaagttttggagacatggctggtcttgaattcctgggctcaagcaatcctctcactttggcttcccaaagtgctaggattacaggtatgagaagtttttggaggtttcggacttgttgctaggttgattctgagggagaaaagacctctgttattcagaaggttgtggacttctgaagaatggaaatcgggcaccctgaaggaaacatatgtcaatcctagtcctggagctagcatggctcaagtttattcccttaaatgtctattgtgttaaaacataaaaagagtttagatatacttccacatctttgcagttgttagctctctggacatttataaagggaaaggaagagtgaagcagagccccattaattcccatgcatggtgtctgctgtttgaatcctggaaatcaggatgattttattcacatgttaatgccctctagtggctagtgaggtgccctctaagcaggactttccccagcttccaccccttcctctccctaactaaattaagcacccactttacagtagttgagtatgtgtcatatcaagtctgtattttcttactaagattcatctaccacgtgggaaaaaaaaaatcaaaagctttgttacagttcaaagaacgtagtgctgttgctacatcaagtgaggataaatcttccatctgtagcaatctgtattataagtctactggatgtgacagaaaactctttaaaactttgatgcacatattttcacagccaaccgatttcattaaagtgggagaagtgtactattggcaagcagtttttctgctgacttcccacccttaaatagacaagctttataaaaagacaaaatcttcccagatctatttggttggccaaggtgacatttgtcttcctccctcagaaggttggtaaaattaaccttctgctttctgtatacctttactgtatttttatttctatttatttatttatttatgagacagggcctcactctgtcacccaggctggagtgcagtggtgcactcacagctcattgcagcctcaacctcctggggttcaagcagtcctcccaccttagcctcccaagtagcttgggactacaggtgtgtgccaccatgcccagctaatttttgtatttttggtagagatggggtttcactgtgctcctctggttggtcttgaactcctggactcaagtgattctcccacctctgcctcccacagtgctaggtataagccactgtgcctggccctagttttatataggtaaagcattagtcactcacaatgatctttgaatgagttatgtaagttatgtttggtttctcctactttgttttcctagtcagttcaaccagtcaagtatgagatgagtggctgctgtgagcttgatcaagtgggtcggaatcccctgggaatattgttaaaatgcaggttctgatcctgtcggtctgagatagggcctgagatgctgctggtcccaggaagacactttgaggaacaagttgctaggtgatgcagaagacagaagccatatttgattttcaaaaatcctatgatctgaaaaggaactaggagaagtatacaaataagtatggcataagacagaaggtgataaactgtatataaaagtaaaaacacgcttcagagggttaaagatagaagtgatcacttctgattgggaagatcaggccaatttccacagagaaggtgatttgggaatgggattttagtttgcaacagggattgcggggaggcgtgcgagggccattgagaccagagacgcagattctggaaagtgaagagtacgttctggaacaaggggccacccgtatgcctgtgatggggaaaagtgggagataacagttgggaaggtaagtggaagccatattgtagactgtcagacagtctgggatggaaactctggacttaattcaggaagcgaagaggaaccagcaacaagagattttgaaacgagaaagaagattgaaactgcagtttagaaagattcatctggcatgtatatgtaggatagacgggagtggggagtgacagcccattccaagagaaggagtagtagataggacagatagcatgattactcttagcaatggggaaaatagagactagatgcgatacagagagagaaggatcagaaggtgtccaggggctgtcagagtttcagtcctgaatggctacagaattaccataaataggacagtcagaatgagctatcgaatgcttttgaatggaaaaatgacctgaatgagtgcacaaatgtcacctccaagaggccttccttgtccatcctatctaacatagtatgccggtcttcttaccctgctttgctattttcatgacactttttactgtgacattaaaaggatggcaagaaaaacagggaggccaggtaagaaacctgtagttgacaggatagaaaatgacagtggcttgggcttgaatggtggcagtggcatcagagagaggtagctgggttcaagatacagcctgatagtatccagtatattctcgttgtgcatccagtctcagctgtttgtgtcttgcaaaactctgtacccattagacaataaattcccccttcccccttccccctccctcctggtaatcaccattctactttctgcctctatgaatttgactgctctagggacctcctatgagtagaatcacacagggtttgtccttttgtgactttttgtttagcataatgtcctcaaggtcatccatgttgtaacatgtgtcagaatttctttttttaaggctgatgaatattccactcttgtatatatcacattttgtttattcattcatctgtccataaacacttgggttgtttccaccttttggttactgtgaataatgctgctatgaatgtgggtgtacaaatttgaggttctcctttcagttcttttgggtatatacctggaaatggaattgctggatcacgtggcaattctatttttaaattttttatgaactgctgtatcgttttccacagtggctgcaccactttgcatttctaccaacagtgcacaagggttccagtttctctatgtcctcaccaacagttgttattttctggttaaaaaaatgtatttgatagtagccatcctaataggttggaggtttgagacctttttttaggggatatttcagatagacagttgagtcttcaggcctgcagctcaagaagtctgggcctgcattataccatagaagttcatatttatgccatcctttatcctttcaatgaattttttggccagtttgtctataagcatttaaggatttagagatttctattaaaccatcagatttgtgcttaaattatttaatctcaaagacattttaaataatatatacattaatttagacatactgctttcttccactttcatattatatgaaataattttacttacaacttttatctactatatcagtatcttcctcacgttttgaactacatggcaggtcatgtagtatcgttttccaaagcacatcatcttgacgttcatctactctgtgtttgatgctattaccagaaatttcatcctaagccgcaagtgcccattcctatattcgttggttacatttgttgagaccccattggccaaaaaaagacatatagccaagcccacagttaatgtgagcatggctatagggaggcatcctacattggggaccattattgtcacaatatcctaaaccatattattaagagatgtttttcttcattcttcctgtgagtgtattttgatgaactctgcaacttaaccacttactgtgttgcttttaaaagtaatctttaaaatgcttttttatttatagtgacatccagtgcttgcaactaggaaagtcatacttccaagaataattactagtcaaatttgttttcttccattaaaaaacaaaaggaaaaacagttctgttaggtggctgttatataaacatgccaaactagcatttatcaaggtagttttaaggtaatatgtcttccataaagactactttatttaagagaccaatagatacaataaactttgtaagaactcaaaaattaagggtacttaggcttttctgagggctttctttggagaaaaattaccttatattatattaccttttattcaggcatacataataattgtaaatttggctttggagacttcagtcaaagaaagagcttctatacaggaaaagcccttaaacactaatatagtgattgagcccattgctcataaatgtttgctaagaaaaatacttgtctggcgtattcaaaggtcagtctttcctagaggcatgaggaacgtttcagagttccttcggacattgcagtgctgtggctggatgatgccacttacccatctatttatccatttatttattcattaacttcaaacaccttctatagtgcagagaatttctaaataccatatattagaaaatctttattttatgagtttggctgacaagggtaggaataacaacagatattaaaccaaaaagttttgcattactgaaaaaattggacaaattcatattaaaagttcctaaccaaaaatctcacagatatgatgcagtaattgaaatccatcatattctaaggcttaaagcatgatgatctgcttctacagtgataatttgggtaagaaggacagtgttctaaaaaagcagccttaatatataacacggaggagtatatgtattttggtcaccggccatttgtctgtccatccatccatctgtccattcatccatccagctgtacatacatccctacatcctttggtttatttcagtggtgtcaactcattacatggcgttgaatgatgttatcaataatcattggcatgccctttactcccttagggtagaagagaattaggtaaaaggtagtactgaaaaaatgttttcccctcttgctgcaaagttataagcttttgtttcctaatcaggcccactagaccacattttgccagtgagcctccactgaaacaaataatgataatgttcatttcacatctttgacctgggaattgcagagtgatttaccaacattaactcatcaattctcctaacacttctgaacaagacattataatatatcattgaattcatcatgtaaatggattctgtgttttccagagaatttcaatatcctggccaccaattacatagggagtgaggagaaaaattaaaacaaaaattacccttttctgaactactgtcttgtggcctgatctccatcagaatgtcttattttctggaaattttaaaagggggaggtcagaggagacatcagctttgcttatgtaaaactattaaataaaatcatactagagaaaaatcattagaaaatgaccatttcccttaaaccactttcttcatttgactcattgcttaataaaatgatgaacttgaaacgatgctgcctgctccatgtcacccaaatgatgagtcacatcatgtgaacaaatggaaataaatcaccagcgaaaaggccaaacttctgtgctaccctagaaatattttctatttttccagggcttccaatgatcttccattcctgtttaactcagcttatagtaagccctgatgccaagattttctgagttccctgccaaaaccatgatgctctcagcctgggcctctcttctaggagggaagacactgccctccagatgaagtgaaaaggagaatcacaaaaagaggattattccttatgggaggaaatgggacacgtgctgcttattgtaacatcattcgccattcgttgggtatatggaggcttttatgagaaagcagaggtttttataactcatttactctggcaagtgaagcaacactaaaattacttaagtgtttaaaagatagacgcatagtagtttatgttctcagtcatcttattactgagaccctaatttgctttcgttaaactgtcggttctccctgagagtgctattgttatcggagcctcataaccgtgtacacgggtcagtgatggtacaatatttccggaaatttaagtcctccataagtagtcaattgcaggttgttttaaggaacaaagactgcttttccagcaagcctggcttgtgttcctattaaggccccttcttttttattgcaaggggaaatttcaaaatctcattgctgtatttaactttctattttagtaggctgccagtgcacttaaccttccatataaagcttatatgcgtttatgcgttctttcccttattaactttttaaggtttgggatgtcagcctgacctaatgatagaatatgcaaaaatagtcctgataccagcaccctgagcccacctaataagggacctttttcatactgtttacttatttctgagtaacagaaagtctgatggtttggtgctggctggttaaattcaacacatggtaagcttgcctgttagtgaagaaggttgagatttgggctgccggtatgttttcttctttcaggcaaggactgagtggcttccccatgtgtgcctaggtgtccagctgaccacagctgagagggataagcagggattgtgtccagctgagtttgggcccctcactcagtggcctacgttcctcggagggtgtgtgtaattagctgctgagtagtagaaggcagtagccatgatcccagttggaaaatagaagtagagctaaagctaaaaaaaaaaaaaaaaaggaaacaggagagctgattgcaggaggaggaggaggtgggctcttgctattttctagagcctgaaccaaccatgcaaagtagaatagcaggtgttgcagctctttcccccaggaggactcctgagcctcgtaagaaggtcagagagctggttgaatgttggtgcaggaagcacgtcaggaacagcttaacactggtttaattttcatttcccctgtgttattttacacatgaggggagtctgaggctgagcgccgtggagaggtctttgtggggagcagttcacgtcagatccaggcctggtcacctcctggcctcatcccattcacctgagtgacttgtcacccttttcaagtccttttccttctttgctttttgcttctccaagtgtgagattggcaatgtgatcattatatgaaaaacatttaaaattaaaaacgattctgtgcaaatatgaaatagataccagttttctttgatttctgtagtgtcactgatgataatatgcactgtagattaaatgattagtttctgggggtgggggtgctaccactcttttatgtaccaatcatatataaaataagtcctgagttcagaaatgttaaaatgacaaaaatcacatggttgtcatatataagctatgtgtgttgtatacaggctgtttgacacacaggccctgttctttacaaggcatgctttctggaagcccaaaccagtcccaggagtgaaagctggctcctagcaatacatgcgagtaggagtcagtgagggcttaggaaaattatccaggaaattcattttgagcagcccaaactgctagctagtagctaagctagtaggcaggagtttcattgaccacatgtctcaaccacatttaccacatttcttgctaaagatgccctaagtggggctgaaaggcacaagatatatagcaggtgggggcaagggggaagtgaagaacctgggtaccccacaccctagatcattcaattacatttttaagaattttttaaatgtacgtatgttaaaaagtttcagttttgcaaaatgaagagtttggggggtggatggtggtaatggttgtgcatcattgtgaacgtacttaatgccactgactgtatagttaaaaatgtttaagatggtacattttatatttgtgtagtttaccacaatttttagaagtatatatgtaatatatatgtatatttacataaatatttttccctagtttgatgaaagtatattgtcatgtcatccactcacccatccatctttattcattcattcaacaaatatttatgaagccactgttaggtcaacatctgtgttccaagctggaatataactatgaatacattttctgtgcttgtgttactctgaggttagtttaagtgaaagccatatgaacaataattaccagccagcgtggtgagccaaaaatgaatgtgtatgtggagttaagactgtgtccagctgtgcagagttgtggggtgtcttggcatctgtcaaagagaagatggacataaagagatcacctgccaagggacagcatggacaaagcacagggaacaaacagcatggtgcagtgtgtgcagggaacagtcagtactccattggtggtaacttgtcatgaggccaggagcaaaccatagagggtctcataggccatgttaaggagtacagactcctcagctcggtggaggtcagaccacattctccagtagcctgaggatttctcagtctcccaacctctgccctgtgaacctctgtggggctgccttcagaagtacttggtggtgatggatgaggagtaggaggaaccgataaaactagatagtgtaagtagcctcaattttatttatcttgtgtattagatttctatataagattttgtttgaaggcagagttctggcttttaaaaaacacatttgaaaatcattgctgttggcaatgaggaatcataaaaaattattatagttggtgacgattagcttagtgttttaaaaatcaatattctgcattcaaagcaataaaccttctttctccatttctgaacctcacctcacagtactttgcacatactaagcattcaatgaaatgttcagtgggaattgttttagggctatgacttagggatattttcattatactactgtcataagggtccacttaaatagaatgttgcccagtaactcaaaaggaatttgtagaaatataaactatataacttgccttttattctcacttttctttgtgtgcgattggactgtaataattattttttctgagttttcttgtctatttctgagacatcaggttttataatttgatgctttggacctggttgacaattccgattctgtatgtaggattgaactttgtgggaaatagcagttaattgtattttttaatgcttaaaatgatattctgggcaagttttgtttctttacggtctatagccagaatcctactgtttttcaatttgtttaaatgcaacagcttatacagcatatgtacatgttcagttgaagataaaggatatcattatttttagcctattacaaagaaaaccacattttctcttaaatgtcttgatataaagtaatttgaacacaatttctgcacaaatcattttcaagagattggctgtcaagtgtatttttttaagtagcactttcataagaaccaatgaaactttgcaaatttagatagattctaagcctgaaatgtggttgaagatgtcagtttttaaacagcactttgagaagtagttaacttaaaagtatagcaattcagagcatactgagaatgattttgaagagtaaagtcttgatacactgaaaagaaagttgacagattcactacaattaggagacaaggaggtacaactcccacttgtgaaaacttttctcatctaaccaacttctaatacttgcctaagaaaatcttcagcaaatccttactcctttgcagctcctaaatctattgtatagaattcttccagtttcctaatagatgctggcgaggctgtggagaaataggaatgcttttatgctgttgggggactgtaaattagttcaaccattgtggaagacagtgtggcgattcctcaaggatctagaaccagaaataccatttgacccagcaatcccgttactggttatatacccaaaggattataaatcattctgttataaagacacatgcacacatatgtttactgcagcagtatttacaatagtaaagactggaaaccaacccaaatgcccatcaatgatagactggataaagaaaatgtggtaaatatacaccatggaatactatgcagccataaaaaagaatgagctcatgtcctttacagggacatggatgaagctggaagcctcattctcagcaaactaacacaggaacagaaaaccaaacaccgcatgttctcactcatagtaggagttgaataatgagaacacatggacacagggaggggaacatcacacaccagggcctatcggtgagtggggggcaaggggagggagagaattaggacaaatacctaatgcatgaggggcttaaaacctagatgatgggttgataggtgcagcaaaccaccatggcacatgtatacctatgtaacaaacctgcatgttctgcacatgtatcccagaacttaaagtaaaatttaaaaatattttaaaaataaagaattcttccagtttccttatggcataataatggaaacagaataataacatgacaaccctcctttccttgttttaaggaaaagtaagttgttaggcctgtgaacaatggcagaactgaaatggagtcttcactcaagccttgtgtgtgattgtgtgtatgcatgtgtgcatgcgtgcatatgtgcacactcacgcacatgcacaaacctacacatttgagtgcaccagtttaaaataagagaaaaaagtgacatgaaactcacttcccaatttctaccatcattaataatacattttaccaattctgatttgttctactattgtgtcaaggctagttaatgtgccccatgcattggcagacaagatgatattatgtggaaattgtgtcttgtctattataagaacctgaatatttaagtatgggagatttttgcctgatattcttcagtcttgtcactcactactgattaagctttgtaatctatatatgggcattagatgaatccataaatgaatgaattggtagtttcctcaatgttttttttttttttttttttttatcataatgaagatatttcatgaccttttaccagtcttatcacatcttggaaagaattactacatctctgaaaaccctacccaggtaccttcttgtagttgggccatatgtttctcaattcagatatacccttgaggtccactttccttaggtggacatacacttatgtacactcacacacccacatgcatacaatatagagaaagaaaggtaaatagtaaccgacagaggtagtgcctgctattctcttcagcgagttgttatcccctcgtcccattccacaagatgggtgccacattgaagatgcaaccaaattacatgcccacactcacagtggttggcccttttgaaattactgggagattataatgatacagactgtggggttgaaacaattgtattaaaatcaattttctgccacttccaagttctgtgatctagggctgtcgcttaattaatctctcagagtttgtttcctcgtgtgtcatatgggaacaataaacttactttcacacggttgttgagaagagtgaatgataactgatacaagaaattcaagttttgttagttttaatcggacatcataagacttttaaaatcatgtaaatgtacatccctaattgcttgcaagtggtgcaaggtgacaagaggagccacctttgtgggaggagtaggtggcaacctctgatgacttcaggacagtgactctccaccttggctgcatagtagaatcacttggggagctttccaaaattctattgcctgagccataccccagaccagttaagtaaggatctctgtgggtggaacccagacattagtactttctaaatctctctgggtggtcacaatgtgtagccaagttggagaactgatgctttagggggatttaaaagtcttcactccttgcattggctgaattgatgatagccagaattctacaacctacactgtattctttttgcttaagataaacagagtcttaggtatcatgccaaaagtctattatttctcttggttatacacgatttggcatgaattagtttattaagttttctccaaagagccaatcttaatgggtgggtgtcgggcttggaaagagaacagaggtctgtggatatctgaagacaggggctgttcactagaggggcacaaacacagaggcaaatgcaacccaaagtcagcaatttcaagctactgttgcttttgaaaattagttcttgcaaaagcaccacctcaagaggtggttggcttccctgaaagctcagcatcatggctctggtgggtcatcattcatgaaaacttgctgcatctttaaaatgtgggatgaggaaaaacatttaaatagtggctgaatacagtcatagtgtaaccaaaagccagaaaattaatttttaaaataatgtatatttttaaagttttgttttttcaagagaaaagactaaaatcacttcatactcaaaatctctcttacctcttttcaacaattggtgctgagacaatggaaaaagtcacctgggacacatgccagagaaagaagttgaacccttacctcacaccatatacaaaaatgaactaaaaatggatcaataccctaaatgtaggaactgaaactataaaacttttaaatgaaaacaggagtaaatcttcatgaccatggatttggcaatagattcttagatgtgacaccaaaagcacaaacaacaaaagaaaaaaatagatgcattggacttcatcagtatcaaagcctttgtgaaccaaagggcactgtcaagaaagtcaaaagacagcccacagaatgggagaaaatatttgcaagtcagtatctcataagggtctagtttctggaatatataaagaactcttacaattcaaagagaaaaagactaacaacccagtttaaagatggacaaaggcattggatagagatttctccaaagaagatatataaatagccaataagcttatgaaaagatgtccaacatcattagtgtttaggggaatgcaaatcaaaaccacaatgagataccactttattatggtcacccattatgatggccataatttttttaaaaaaggaaaataacaagtgttggcaagcttgtggaaaaaatggtaatcttcctacctggctggtgggaatgtagtatggtgcaatcactatagaaaacaatttggcaagtcctcaaatagctaaatacagaattaacatatgactcagtagttctgctcttaggtatacactgaagagatttgcaaacaggtattcaaacaaaaacatgtacatgaatgttcatagcagcatgattcatagtagcccaaatatggaatcatcccaaatgtccatcaactgacgaataaataacaaaatgtggtatagcctacaatagagtattattgaaccaaaacaagaatgaagtactggtacatgttacaatatgaatgagccttgaaaacattatgccaagagaaagcagccagacacaaaaggccacatattgtatgattcagtttatacacaacatccagaatagacaactccttagagtcagaaagtagattagtctttgccaggggctgagaggagtgggggacagggagtgactgtttcatggataagggggatgatgacaatcttctggaattagatagtgatgatggttgttcaacatgtggatggagtaaaagccactgacttacacactttaaaaacagttaaaatgctgaattttgttttatgtgaattttatcttcattaaaaaatacccctttgaccccatctcttctctaatcctgcacatatagccttaaaccagtcattttaccctttgtgattccattttcatcttattctgttttttcctctaatgttcaacttctgcaaagagacatctacactggtcttcatttcctttccagcccttccattcatcactccagattctacacctgacctggaaaggtctgtgttaactcaaacagaagcttgggcacctcttccttactagaagggcattccagtgattgacattagaaatcaagttcccagcatggccctgccaccaggctggactcgtccattgcactgtcaccaaggaatgttaagtcttggaaacagatggaggaacttgcacggcgtttcccagcaggcacaggcgattcctgcaaacttaggagagtgaaagtcacacgaacaagaatgtaaatttgtgtgagaagacgtgatgctgttactagcagagttaaagtgcttttaactttggataatggatagtctgctctgattgcctcgaaggtggatctccaagcccacagaacggtctaaaagtggaaggaagctgtattaatcatttatttaattttctttctttctctctttttctgctggggtcagcaggaatgggaatcttttttttttttctttttacatcagtcttattatgattatgattatactgaaagacctggatgggaggaatgctgcaatctgaattaaaaatagcattttctgtcctcccacacacaacacttgagtgctctgaatgccttttataaatgcagactttctgcctggctagataaaagaagctgtcacttcatttccataacgaagtcattcccgggagaattccattgttttagcaatagaatttttgtaaaaggcctcttattttgcctgaaaaaggtaacaaaaatgaacttttgagagcttattcgacaaaacaattaagcagtgaagagagattttctccttttttgatatattaggagttgtaagtgtgagaatcccctgagccatgatactaggataaacccctaaatctgcaagatgaaggaggaggggagaaatcctgttattctttctcctaatagaaatggggatatgctcttccccgagaatatgtgtcctagagccaagtgacacatagatgatgctaattctaaagagttttaaatatttagtcttaaagagaggtaggaaacttgtagaatgctcatggtgtaaagaaattccttggggtttttaatgaaacgcgatcatcaggtattttaactgagtttcaggactcttaagacaaaccacggctgcatcttgccagcgtcctttactcataaaatagtagttgatatttttctttatttgcattgaaattgcagcaagtggagtacagggtccttcatgatgcagtgtgacctgtagcgagctcagacaggcctgtggacatgtggtcacactcagcacccctctcctgtgtttccccatccctccacacgatggatctgtgctccaaatatggtatcaaatcttcagcgccacattcatagaaagaaagaataattgtatttcttgttacttacccggccctgcgtaacccacatcaaagtatacctgtctttggtgtttcaacaggtaatccctagatataatgccaagtggcatttctgctacatggtattcacagttaagaccattgaaatcccagttttaagctagaatgcttttatgaagcctcctccaaaaaaagagaagttttcaatagcacctttgtcttgcaatactttgttctgattgagtcagaaaattgtaatatttaaacaaggaggcagttactcggaatagtattaaaaaaggagtttaaagtatggagttgttgtatctgttggcttttaatttagtaaaacaagtagaccaaaaagaaaatgagtgctgttgacgtaatattattatggaaagttctgtgggggcaaacattatgcaaaagtagttaaatctggcactgattttgaatttcagaaaataattctgttgtttttgagctttgaatggcttttactaatataccaataataactttttttttttttttgagagagagagagagagtctcactctgtcacccaggctagagtgcagtggcatgatctcggctcactgcaacctccgcttcctgggttcaagtgattctcctgcctcagcctcgtgagtagctgggactacaggcgcctgccaccatacctggctcatttttgtatttttagtagagacagggtttcaccatgttggccaggctggtcttgaactcctgacctcaaatgatccacctgccttggcctcccaaagtacagggattataggcgtaagccaccacgcctagccccaatactaattttttaaagcatgatttgatgtcccagctgtagccatgcaattttgcatggtagtagttcataaaaagaaaaggaagttgtggctttgataggatgcttccaaggtcgtgtttttaatacttttggtaaattctgttacttgtgtctgttcaaaaggacagaggttgggagatgcatatgtggattctgtctcttcattttatcttcactccccgtttggtactttgtgaagtcaggccaaataaaatagttgaagatactatcatataactctcaatattatggcaaaaagagaatgagaggaaaatatttagctatttcttttttaggatttttactaattgtgttattaaaaaggagcaaatagagcaggaactgaaacagacttaaagtcagaggactggactgcacacattagcatcttgcagaccttagctgctcatgatttataaatgcttcagaaattatcaaagcatgaggcacaggctgtgtttcagccttccccattttcaccaagcacttctgcaacacctaaacactgaccttttcaagcaggcatgaataaaactctcctctgggcagaaggtgcgtgatgactcatggcaaccagaaaggggatgtgtaactcgggatgtggagtctctgggcttctagacccagacctccctgtcttctggcccactgttctttctgttgtgctacagcaatacctgaaggacctgcgtgttgaacaaataaggccaggaataagttgtcaataggagcacatgacatcttgtctttaaaatactaatttcctgagacgtcgttctacagctgctcagcacagattgggtatttatcatctatatgttcaacttacattttattttcattttattcttgatatgcagacatacttttctccaatgtataattatatttcatagcaaactttgcactacgtccataaggagatgtaacctgcatacaaatacacacagcagcagtctctgtatgaataaatccttacctttatgtgataagccatgctaatgataagaagcagtgacatggatcaacatgaaatataatttttttaaaaaacctttgaggatagacatttttccagcatatttatctctgataatgtgttctttaggccggtactaattttggattttattccttgaacacaaaccagttaatatacacagagaatattctgagtgcatgctaggtatccaaggactgccagtttgtaagaaattttacaatggataactcccataaatgatcaaatgttgactgaacagggaacgcatgatattgtgaataaatcatattcttcagaataccttgagttttggcctacctcccacgctgacctccctccaactcttcttgaggtctaactggactctcagtccagccctgcactggagatgcctctcagtccagccctgcactggagatgcctctcagtccagccctgcactggagatgcctctccatgggaaaggggtgtttttggcccagtttgcctgccacttaagctccttggtgggcagggtggagacagggctctgcaccctgctgggctgagtgtgctcattcagaggaagcatttctgaactctgcaattgccagcagccctggcagcttctctttattcctcagaaaggaaatacaaagagttacctttagttctgagttggaaaaagaggctgttgtggaacatttcattgagggactgcacagtttccttagagacttatgtgatgatttttctccaagtcacccaaaagggtgttcttccatttgaacacctgtcctcttccatggaggacagagactcaaagacatataacgtcttcaagtataatgtaatataataccatgttatcaatcagttaatcaacaaatattgatcaaagagttatcatttgcgaaagccccgtgaagcttacaaaaagaagacagacataaaccctacctttacggaagttaccacattccacttggggagatgacacctattgtaggataaggaataaaatggttagtaacataaggaaaatgaattttaaaaccataggcattcacatgcaaaaacaaaacaaccaaaaaaaaaaaaaaaaaaacttctgattgagaaagttgtagaataagaggataaaagagttgtagaaaaagtgggatttgagctggtcttgggaggtctggcttacattttgacacgtggagtagaaatgcgggctctcagagaggaagtgagaagctcactgtggctgcttcagtgtgcatgaggggagaagtagaaatgaagttggaaaagcatgctggggccagattgtgaagatcttcagcatcaaataaagaatttcgaagatgttcagtaagctgtaggaaccaatgaaggtatggatggcacggggaagttgtgttatatctactttaggaagttcgatccaacagggatgactcaaatggtttagagagagaaagcattgacaagaagaccaatgagcaggctgctgtgagaggaattcagtctgagctagcatggggcggtgaagatagaaagggtgcagaattggtaggacttggaaaccgatggaatgtgggagaaagagtagaagatgatgatgctgtcagcttccatcagaaattaaagaggaggagctgggtttggagcaagggactgggaaagtttgaaataaacataatttgtttccactgcatatatccaggagtttgtagggggagataccagggaccaggatacagatttaagaacgataaacagtagaaggaaatcattatagaaagtgaatagaactgagcagatagccttaggaaatctgtcccctagagttagaaagaacagagagagcaaaaaactgcagaggggccataaggagtaatataaggaacccaagaaagtaccatctcagagaaattaagaatatttgtttattttggttacaatagacaaattaaactcaaagtgattcaagcaaaaaaaaaaagaaatgtattgtattatatgtggattggttttctattgctgtatgacaaactacaaatatagtgacttaaacaacacctatttatttttttttgtgtgtgcatcttttctttttttattttttatgttattattattatactttaggttttagggtacatgtgcacaatgtgcaggttagttacatatgtatacatgtgccatgctggtgtgctgcacccattaactcgtcatctagcattaggtatatctcctaatgctatccctccccgctccccccaccccactacagtccccagagtgtgatgttccccttcctgtgtccatgtgttctcattgttcaattcccacctataacaatacctatttattatctcacagtttctggaggtgcgaagtccaggcatggcttagttgaattatctgttggaggtccgaagtccaggcatggcttagctgaattatctgttcagggtttcataagactgaaattgaggtgtcaacagggctgccttattatctggagctcatggtcctttttcaagctcacatggttttttgtatttagtttcttgtggtcgtaggaccaaggtcccgttccattgctggctgtgagctgggggccactctcaggtcctggcattcaccttcagttccttgccatatgacttgcctcctccatcaacatgtcctctctcactttgaatctcattcctggtaaagccccatcccttttagggttctcttaattagatcaggctcaccaagataatctctctattttaaggttggttgactttggacctcacttatatttgcaaaatcccttcacaacagcagaaccttgattactgtcccactgactaactgggaagaggtgtgtgtctggcaggggacatggcaatcttgtgggctacgttagaatttggtctatcataatataactaaaaattccagggatcaggccgggcgccatggctcacacctgtaatcccggcactttgggaggctgaggcaggtggatcacttgaggccaggagttcaagaccagcctgtcttgaacatggccaacatggtgaaaccctgtctctactaaaaataccaaaaattagccgggcgtagtggctggtgcctgcagtcccagctactcaggaggctgagacaggagaattgcttgaacctgggaggcagaggttgcagtgagctgagattgcgccattgcactccagcctgggcaacaagagcgaaaccttgtatcaaaaaaaaaaaaaaaaaaaaaaaataataataataataataattagccaggtgtggtggcatatgcctataatcccagctactcgggaggctgagtcaggagtattgcttgaactcggagtcagaggttgcagtgagtgagaccgtgccactgctctgtctgggtgatggagcaagacttcgtctcaaaaaaaaaaaaaaaaaaaaaaaaatccagggatccgtctaacttctggcatggctaaatccaagggactttactgtcatcaggactcagattttctgtctttcagcttttctctgtactgggaagcttccttctccagtgggctttctgtaagaggtggctaaagaaaccagctgttagtagcatcatgctcccgtggtctcactaggaaagagtgtgttgctcctcttagttccaggtagtctgagagaggcctttgattggcttgccttgggtacatgcctacccctaggccagtcactgtggctggagggttgttgtattacgattgcccagacctgggtcatatgtccatcttccaggccaatgtgtgaagtcatcccagcccagataacagccaaggggagagatcattccagaaaagatgctgttcaggcaaaaatgctagtctactaaataaaaggaaaagaaaatggaaggaactattactagtgaactgtatcagacattgttagagaagttaagaggaggactcagcaaaggtcactgcatttagaaggcaggaaaccattcttgacctttggaggagaaggaaggttactaacacagagaaaagtggtggaaatcaagctccagagttttaagatgtaggcggtgaaatactggcattgaatgtatagtacaactgtttgttggtaaacagaagagagaggacagccatttgggactgtattagggtatggataaattcttttaggaatagcagtgactgagtatgcttggagtgtgagaaatttccagtagagaggaaaaagactgaagggaagttgggagcagagttgaccccagcaggatctggaaccagtaggaggagaatggattcagactccaagtagagaggccacacacagtgtaataacctgggtaatatagtgtgtgaagttttttgttgtttggtttttggtttttttttttttttttggtcatttgtcgcttctttgaaatagacaggtatcattgctttcaatgtagctatcaaatggtgattaaatgtactcaaaagatcctcagcatctctctggccctgtaattgacagaaacatttaaccttagagaagtggttctcaaagtctggtccctggaccagcagtatcagcatcacctgggaacttgtcagaaatacaaattatctgaccccaccccaagcctactgaatcagaaattctacagatgggtcttagcattctctgatttaacaagaccctctagccatttctattcgtttctttcctttttttgagtcggagtcttgttctttcgcccaggctggggtacagtggcgtgatcatagtgcattgcagccttgaactcctgagctcaagccaccttcctgcctcagcctcccaaagtgctgggattacaggtgtgagccactgcacctggccttctccagccatttctgatgctgcttcaagtttgaatatcactgcctcagaggtctgcatctcccctccacatgccatgaaggtttccttaatagtggctttgagaagctatgagagctagtgatgtaagctgctggtgatgaggaaatgggggagtttgtaaatcttgaaaggagatgacaactgttcaaattccactaatgacttaagatgtaatggattggaagaacagaatagaaaggctaagttgtaatttaattttttttgagtttgtggagggctgacacatgatgatgataggcatcatcagactttcaagtccctggaagacagagaaaggtgaaatgggcttaaagcatagctgtagactggtgattcttttggagtaagggttaagtcctagaacaggttttggatatggatcatttaagttaaatccaggctcttccactagatgctgttaggaggttgcaaaagaagggcatggcaaggtttctttcatcagagagcttagaaactttttgagccttcaagacttaaataaatccagtggagtataaaaagacagtataacaaagtgctgaactgaaaaggaccttgggtcagaatgtgtggtagagactgtaagtgctgtgggcagtcaggggaaggagaaattggcattgtgtcattttctcctctaggcagaggatgaaactgacagcctggcgtaatttcccaggtccgatggcaagatattggacaccttggcttcaggaagtgctttttcttgttctctctctcctttctgagtgtgtcaaagttgccaggtcaaagtgaaggtttatactctgagactttgaatgtggaatattgttaatatttttgtttgtataagaagcttgtaggataaattacattttatcttggacattttaaatggaaagagactcaaatagaagtttggcatatttgtttcagacaggctttcagacttactccattcatggggagaacatgaatgagcctgttggatgatgctttaatgttgtaggatgaagaaagcaaactactgattttccttagtggaagaattaagttgagccagatgtgggatgatagggaagaagaaaacacttcagatgaacatgacatttccactgcttttaatttctttgcaccttgcttgcggctcatgtgggtaagtaaacagaccactgaaccaagaaccaagagagaaggttgacggaacactgttaacggtgggcataaaagctgtttaagtccaagagagaaatagtaaaaataccgtaatcatcaaggggaagccagaaatctggtacctgatccaaggtcctaaagatgtttttcagaagtctacaagtaatgtgatctgttttcagtcctttttgggggagggttttcttaacttcagctgtggcatgcaggtgtcaacaagagagcttccttttacttcactgtgataacggagtgacttggggtgcattagagagcagggtcattatttgctgtcacatcaagaataatacctgcatcaggggtgttcctctcaccgaaattaatcacagagaaggtgtgtgttgctctgatggcctagcagtcagaaagatgaatcatctcttatttcaaggtatggagaacagttgtgtcactcatttctttttcaaggagactcagttgaaatggcaaaataaaaaagagagaaataacagaacacagttgtacatcactagatcagttcgtataatacagactgtttcctctacctggaaacctgatgcctggctaacttctgctcatttttgactttcctgttcgaatgttagttttgtaagagaagccttcctgagaccctccttctaagtgaggtacccccatcatgactacaaatcacaatgttcatttttccttcatattgcctatccagttttcaaattttatgcatctcctaaaactcatataattatttaattctgtccctcttgaggcagtgagctccttgggtgcagggtcctgggctattttgtttaccatgtattccccagttgaacacagagcctggtggatttagcaagtaccaagtaaaattgtatcaagcgaatgatttaattaatgagaaagcacttggtaaactgtattcattatgaaagtgatggttaattatgtgagtagcagacacctcctttctctcttctgtcccaattttgtctctccattttttattagttctttattttgagatatacttgtcagtgtgttaccaattccaaatctaagatttgttattattcattcttgcctttttttagagataaaggaccactcttttttgttttttttcctcagaaatgctattaatgacacccacaatgctaatactacaactgttttttctgtgcatgctcatgatttgaaaggaaaaacatgactggcctttgtcgatgatgtatttgggaagcaacaagattctagtgtagcacttaaattctgtttcttgtcatcctcaaagctgctaatacaagttcctttgcctcaagtgtgcttctcaaaagtatacaaggcgaaataagttgatagtatcgttccaggagaagctgttcctgggtcagccttgaaagggggaaaaaaatcaagaaatccaggtgtggaaaatattaatgatcaggatatgaataagtcttttcattaaaagcaacagcaaataaacaaaaagttatccaatccttttccagcagggcctcgctgtgccactctggtgggtgtaagtgttgtcttcggtgggcggaaatggcagacagccaagtggaaaatttcacagtgtcgcaaacattcagtgcacgaaacgctgcaaaccagcaatctgagggagccgtgtaccaaataaccacgctcctgcatgtgccctactgcccaccttacactctttctcctagcttcctgcgtgatgccttcactttctttttcccggagattccagattcttcgtttctgttcctattctttcctgaaactcagcacagtagggcatgcagacgtttggatgctcccgggatagttgatgattggtgccttaccagtgctggcttttgtattctggctccagagctcaggaacaggcttatgaccaccaacaacgctttgcattaacatagtggatttcttctcgggaactgtgtgtgctttgcaagaatgatcttcttgatcttctccatgacccagtaagatatgacagtggcagaaggtgctagtccttgcctccttttgcagaagagtaaagccaagtggcctgttttgaggcttttgcaagtttgcatctcagctaagattgtgtctgaagtctcccagaaatggcttcaactttggggtgaggagaggctggctgtaccatgttgtgttctttttgggaaaagagcaagaacattgaacttcttttttaagaaaatggtctttggtgaactatcaattcgtctaattggtcgtgagactgtatttgttcagataacaagtgatttgatgatgtgtttacctttttctttttcttctgttctatttccatgctaggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttgtaagttaacaaccaagaacaatatgtgtagtggcttgccttgtaggattcatgaatcacttgatgtaaccgagccaggtgttgaaggggtattagcatgagctctaggtgatcgtccaattaatttctttttttaattggaagggaatttaattttttaagggaagaggtcctgtttgtatttgctggaacttgcctttctctcggcttctatggcatgctgcaaactatctacttcaggaataaaaggatggaatacagtgattctttcattgtaggaacaccttttctactggtacagtcaaatagtatcagatttagagcagcccctttaaactgggctgttgcagttcttttaggttggtgagtagggggtaaaattctccaggctaaggattagcaatcagagtttccatccagcaattattcttctgtatgtgcagttgatgaaaatgacatttttctctctggcttgtaaaatcttgaggtatgcaagttacaagcagttatgtttggtgcttcccttacttaaaatgagctgatttactggttttgatcagttactggcttgggattttgagattagtaaagtttgttcccacatgtcacctgatggccgccttgcatgagaagttttagtgtcaggtaatggaagagatgacatagtgtgacttcagggagcccttccactaggaaataatgcaaaggtgctcagccctcctactttctagagaatttaccttgttgctggactgtgtcacaaaacacagttaggagattttgaccaggaaagaaaatagctacatgaaacccaggatggcctatgaatacctctgaggacgagaagatattatcttcaaattttaggaaatgacaagccaatttcttctaggtttttgttgttgtttttgtgtatatataaatacatatatttctgtaatatatatgtatactcttgtttatgtatgtgtgtgcgtgtacacacacacacacacacacacacacacacacacacacacacacatatatatttaggtttccagcttcttaactcagccagaaaacttttttgaacatgtattacctattttttttgcagttgcctacaagatttgtaaagagcaaagtgtagcatatatcagggagaaaagtattgacaaggaaaaaaaatgttcctaatttttttggtttcatagatttctaaacatttgtattaaaatatgcatatgtatccatatcatctcctcagggttaaataatcagtaatattaatatgagcttattaaattcaaattttcccagtgcttcattgaaagcagacagtgggagacactgaagcttcattgtgtttccattctgtacacgttgggtctagtggaaatcagtcagcctggaatcagctgacctgaatcctattcctactgttgagatcaagtacactggcaaccttgggcaagtcgcgagcccccataaaacaatattttgcaagtctgtgtattgcttcatactaccttattttcatttttttctttttaattgaggtggtgccttactctgtcacccaggctggagtgcaatggcaagatctcgattcactgcaacctctgcctcccaagctcaagtgaccctcccacctcagccttcagagtagctgggaccacaggtgcacaccaccatgcctggctaattttttgtatttttggtagagacagagtttcaccatgttgctcaggctggtcttgaactactgagctcaagtgatcctcccgcctctgcttcccaaaatgttttgattacaggcatgagccaccatccccagcccatactacctttttattaagcaatcagcatcttggtttagggtcctcataaggggaagagcattgtgaaagcactattttacttatttttttaaaaaaaaccttattgtaaaagtttctgtcactatcaaggaataattgtgggccatgttagatttgggtactccagttacagtgtgttttactagaaatcattttcccaatcaggtaactgttagaatgcacttctggtggtattttttaaagcatttttatcctaggaaacaagtgtcttatgtaaaactgctttaggtttcaggctctatttaaataactcatgcagttaccataatcaagatagcttttgtttcaaatctagtgggggttttttgttgttgttttaaccgttgctttgaactgttcatgtgacaccctgtcagacctcaaagattgagtgaggttttcaaaggacttctgaagtgtacactttaagatgccacatggcagacttgaagtaattttaaaatccttctgtaaatggagtgtgttgagagagcaaggaaataccaaattctagtgaactctttgtgcatgctaagtactttcttttcaaaaccgcatttgcttggtaggggcagtggggggttcctagttttcttagtaaactgtgatgttggtaacctttcattatctgggcacatgtttacaacactggttttctgtcttcctgggtttagtgtcctgcatgccccaaagcctgtgccatggagaactgttgcagtagagaaggcaggcaattttcaaagaatgcatgtttgcacataaacagggtctaggagtgggtgtataaatgtgtgagtgataatcacagcagccattggaagtagtggttcccatgctcagcagtccttgcagatgttactcctggcattcattcctgtgcatgtcccattaactgcctctcaaatctgccaccacttgccagcagatggcctttgcccctgaagatgtttcagactggctgtaagggctggggggaggggggatcttgtacaagaagagaatgatgctgacactgaactcagagttagcagacctggattttatgcacaatgctgttgttagccatataaccttgggtcctctctaccatggggactcattttatgatggacaacttgagaaaattgagttaaatcacctccagtggtggtttttaccctaagtgtctcaagttgcataaagtatcagccttagatgaggccaattgaacgtttattttaccttcttgggttcctaaaaatcaatgatttggcactacctcatttacaactgtttttaaaacattgagcacagtcttagggttaaaagaaaaaaagagttattacatctttcactaccatgaaaccctttccacaagaccctcctgggcaccatatgacaattcaaaggtatttatttgagactgtccttagactatagctttagctgtttaaatttagggtccacactcattggtccttttgaaaataaacaggaacgatttttgaacttgagttttctaaaaccacctctgtgctcaaatattggttagagtctaagcaaggagaaagtgatccatatttcattcctaagcttctctgcttccttaagtaggaattcttgagttaccttatcaaagcagccttccctgatctacataaaatagcatccaccccatccctctcagtcctctagccttctgtgtttttcttttaagcaccttacatattatatatttatttgttaatcatcagtctcctcaactagtctgcaagctctgcaaaaggagggatggtattcttatccttattctcattcttattcttccctggtgaatgaatagtacctaaaatactgcttgttcccataatgggcagtcagtaaatattcattgagtgaatgcctaaatgacattcactaagtgaatgcctctcatgtgtgggcctgagccattaggaaaaggaacatacatgctgttctgatgagaatgcttgaatctgatagcagtttaagggtgtggggaagggatggagagtctagactattttccttagaagtggatacttgatgtgtataaagaaatgtgaggagggaacaatttgtgtaaaaaaaaaaaaattctagacctatcagtagagtttggggattttctaatactttttttaaaagtctgcactgtctgtatttcctctccttttccatttgagtggtttgctttgtcacttgtttgtgagcatcctgccctggctttctgtgaacggcggtggttttgtctcttatcatcacatcatttcatcactgcttacgttcatatttcttttcaaagtagggatgggcctgaagtgctgtatctccctagaaaggggctgactgaataacacttcattctagtgcacaccttagaatgaaaaaatggtgtgctggtacaaatgaaacccatttaatgtctctgtggtgtgtgatgggaagttcacaaaagctttcttagggaggcattgtgctagttagcttttgaggacagcaataataaaggtttctggaattttgtgtgtctatggactcccttttcagaataactgctctgagtgcaggcattactttattcctaggaagaaatggagagactaaaataaatacctctgtacctgtgtaaacagcattatgctgtctgtgtaagtcttaaaaaatgggagctgaatttctcttactctgaatctccagactaagagaattgcacacacacgcacactctaataagagcaatctgggaatttccctctgtgtctgtcagtttgtaccttttagatttgccatctgtgataccaaattctccagcgttacaaaaaaaaaatctgaagtagataagagggtcaggagagaaggggagattccaccacttttggacaagtgagggagaacaatctcctttttcttaaatccttgcttgtaatgctcctgcagattgacctacagattgtaaaggcagagaggttatgactgagctcattccatccaagtgcactggggatagcttcaagtcttctagagttttctctttcacccatttctctctcttcctcagacttccttgaatggcttctgattgacagcttcactagttcctggccattgcccctggtgtgttatttgggatgggcacctttggcagggtctttgcaggagtcactgcttctaagaagtggtgtcagagctacctcctgaggcaactgacaaagcgtagcccatcccaggcacaccctttcccctcagcaccttcttcctcaagtactcagctcctcctctcagcatcttggagaggaggaggaaaatgcaaagaacacccagacgttgtggaaggaaaaaagttcatggatcttttacaacatttgtgttctatggggtgaaacaacatcaacagcctggtcaggctgctttgtaactgaatagtgccaaggtaaaatgcttttgtgtcctctttaagtttagagttcactcaattacatgatatttattaaaagagtgttgtgtgccaggatgttcttgagtctatcagggatccagggctgagtaatctgtacttactgccctttgagactctaggaaggtgctatgggaaggatgtacttggtggcggagtcaggtgtaccgaaagggacgatgggtaagagttgtcagcgctggaatttcagggaagacatctaaattgagccttcaagcagaggtggaatttcaacccaatatatatgtgtatttagagaagacaaaggatgctttgagaagagactaggaatagtattttatgtactacttctgtgtctgggcatgtgagagctcagagccagagctttccttccatcagaaattgtttggtttgaacactgacaaaaacatagcatgaggatttgtagcacatggccaccaggccaccattttcttcaggatcattttagatatttttttttttttttttttttttgcagatgaagtctcttgctgtgttgcccaggctggagggcagtggcacgatcttaactcactgcaacctccaccttctgggttcaagcgattctcctgcctcagcctcccaagtagctgggattacaggtgtgcctcacaatgcccggctaatttttgtattttttgtagagacaaggtttcaccatgttggccaggctgatctcaaactcttgagctcaagtgatctgcccacctcggcttcccaaaatgctgggattataggcatcagccactacgcctggcacattttggatctttatatgtaaaagttgaagcaagaacttgggatgcctaaagaatgatgcctcccagcattagtaagggcagtgtttccaactgaactttgtacagaaaaacccaaacaaaactaaagatgtattttttaggtggtataaattcgaagtgctcaatgttcaagaatccacaataaagaagggcagggatgactgaatagtgataagaactagttgacattgtttagtcatagaacccaaacaaaatctattggttcttaacaacacataaattactccttaggactaatgtaaacagacaaatagaaaggtaacttcattttttaattatctaaatttttcacttttgtaaaagaatcatattataccataaaaatattaaccatgtctccaacttaaattcatgttaaatttccagtggtagctatgtaataaattattgctaagtagaattgtagactgaaagaattaatccatcttctataaatcctgaagattatgttaaccttttccagacacctaaacaagtatgttacatgattcagaaaaagtcatttttgacaagtataaaatgattttgaggtgtgatagcaaattagctgtttcaaacctatgttagagaaattaagttttcagagcaatttttttttgtatttgtgcttatattcctgaaacaacttgcttaaggagagtctccttaaatggaaacataaatggtatacaaatggctatcctctatcataatcttttatttccaaaactcagacaggtttttatcatcatgctctttggactcttaaccatcttcttctacttttaaattctacttctttctcaatacatttttaaacagcatcttgtgatcatttcccagtcttgagtgcctggcactgggaggtgacctgcccacattgctgtcagaattcgctgctggacccctgcacaggtcccaggctgttggttacgtgtttcaatctgcacatcagccatcctcaccagccttcctttgtgcatctggaaataaaaatgctcttgataaaatggttttctaaagtttccattaggttgctcttcatttcatttttcctttcttcttcccaagcctttgtggcttgcatagaattgaaaaaaaaaatgtaatttctccagggctaaaatccaagactttgataggcagtcttaatgcatggggctcctacgagttgctacccgttataagcattgtaaaactcaccctgcagaacaaagagaactgggcacaaagattattctcttcttcaaccatggcaagccctagttttccggtttcctttgccttttccttctttgatctctaaaagaaggtagaagagtagaacgctattgttcagaaaggagaaagctattgcttgtccaaacagattgttttttccttctgtttggcaacctcaatggctctacctgtttctggctgtcatacttcggcttgtgaacagccttcctccctaattttcaggaaactaacaaattaaaggtgcaaatgtcaggtggttactacatatctactggctcacataattcaaaacagagtcatgcagctcctatctaaagctagttccttgccccttctcagtcactaccacatcaagcacaaatgtagatgaaagggtagtgtgtcaaggtgagagctgcccactgggtagtgttactcggtcacttgctataggggacagattagctgccaatcagtatctcatcactgtcattggcgtttataatccaggttcctagccccactggtgatctatttctgtgcctccgcagtgacgccagttgtcctagcaacgtgctggctggcacttcgttaaaggcaagtaagggagtggtggtggaagagggtggcctcgagagggtcagaagggagttggcagtcaccttgctcaaagaggattttccatttccctcatctgggcaggcctccaggaggaaaacgtcacttactaagtgtatcatgggagtgtcacttactaaggatcatggaccacatggtctttctggtacagatagaatcccacggagaataacaaatgaattaatgggtagtccaggcagaatgtggggactgccgggccaagatgttaggcgatctcaaagcatctgatggtatcagtttttcttgtgaattaggttaatgttttgcttgtttatcagcactggcatgcagagttggagacatgagtagatgtttgggaggaatcagaggtcaagggaggcagaaggaagggaaacaccatgacagtccctcttggccccttttcctgttgacaggtctggcctgaaagccatccagtgtaacgagagccttcttactgagctctggtaatttatccatgcacccagccttgaagaggaatatggctcactttgtaatcttcttaattgctctcctctcattatgccacattgaattggcactaaatgactttttctgccattttccgatttggatccaaagaacatagaaatactgtggattgtatcttaaagtccctgtccaaagtggccttgcctagatgaaatctaaaatggacagtcaagtgacattggcagagctgggggcttccctccatggccacttctctgtggaagcccctaggcaatgggtttgggtgacattttctcctgagagtgcttcgtctgtgtggccctggagatgccaagacatttttcacgaagaaagagactcaaggtgggtctttgcaaggaaatggggaacaagggagactgatgaaagggtgtccccagagcattgaagacccacagatgacaggaagtatgacgtatgcattgttgcctttcccttcacgactaaaagagtttttgtagtctcaatgaccgttgtcatttgttccactgaatgaccacactcaagtcgagataattgcatgaaactgtgtgcttatgatgggaaagacatttagggtgtaactgaccatttctagcacgttttgtatactcaacagaaggtatattcactccttctaccatagctgaaataagggctggtagtgaagatctgggactggaattgaaagaaataatttttggaaaaagaaaaactccaagggtagctgttggcactttcagagcatcccatattttcaggatgttttgtatgagataaagtaaatcagttttgtttgacagggtgtagtgtgcccagccaggtcattattttaaattgacaaaatgatttaaatgatagaagacattgtatattcctgaaacaataaatacctattaagtacattttgatacagtggagaagtacagtttttgttttttgtttttttttttggattattatataactgttaattcaacacttagtgtttaaatactcatcattctttatagtgcacaggtcataaagatagttctctcatatgaataagaaatacaactaatgtgaatggcattaaagttagaagcttcaaattcttctctgggtttgatggttgcttttttagaagaaatttggtaaagtagatgatagaccagttaggtttcatgaacttcgtgcttcatattcttttcttttcacaacctagctagatacacagtaaataactggaagcatactagagtagaaagaacccttcttcctgaataagttgtcgttgatcacaggggtaggcgttaatcaaaatattaatgactaggccaggcacagtaattccagcactttgggaagccaaggcgggtggatcacctgaggtcaggagttcaagaccagcctggccaacatggtgaaaccttatctctactaaaaatatatataaaattagctgggcatggtggtgcatgcctgtagtcccagctactcgggaggctgaggcaggagaatcacttggacccgggaggtggaggttgcagtgagccaagatcatgccactgcactccagtctgggtaacagagtgagactccatctcaaaaaaaaaaaaaaaagtaatgactaaggagaagatagggacaccttgggctctgtccagtagcaggaacctcaggctaagaagggacacctgggttctcttcccatccctgcccttttagaccagtggcaagctactctctatctgggtgcctctatttccttatcttccaaaggaagatcattatcactgccacttaacagcatcagatttaaagtattagttcatataagagactctttgaatcacatttgggttcagatttcagacctgccacccagtagctgtgtgtcctttgggaaattgcccaacttctctgagccttatttacttcatctataaagaaggtctgaccacacctaccctgatgacctgttaagagagttaaatgcgataaagtctgttaagtttttagcccagtgattgctccctaataactgtggcagccatgatgctgttatgataaatttcacacaacaaaatctatcatgatgcgttgctgaagtgaacaggtgagcagttgcaacttgctcatctctttgttgtagagacatttctgctataataggagttgtcattaactgtcattgtcattacactgacagtgaattcggttatgtattgttaagaccttctgcttccttgacatgtatatagtagaataattatgacagtgaaggtgacacatttgtcagaattatccatgtgcatatgctgagggcccttggaattttaggtgaattttatagtattagtcaaactgaaaggcacagtgagtttggaaactataatagtctcatctataaaaggagtagggagattcccaaaggctgttgatatgagtagaactctgaaaaagtaaaacattaaaatacattttgatgtggttaccgtgtctaggtggtgataggtaaaaacagtctagtctaattctttgaaatttaggatagaagaaagcctgaagatggatatctacattcttgtatcttctttcagcaaatatttacagaaagagagagagagtgtgtgtgtgtgtgtgtgtgtgtgtgtgtatgcacacacatatgctacaggctaggcacctacagtagttaaaggagctttcagtcactggggaaagaaatgagaaaacaggcaattcctttacaccatgaccagctctctcctaatggtacccacaggttgccatggatgcagaccagcatggcatcttctgggatcagggaagctttcatcctcagacttgaatgaggagtagatgttaaccagaaaacaaagtggatgtatcagttagcatatactgtgtaacaagccatcccaacagttaagggccaagaccacaatcttatgattgtgggtcacctggactattttagtctgggccagcttggctgggactggttaatccagcatggtctcactcacatagctactagaaggctggtttgcctgagagatgggtgatcttcagctgggacagcttgtctctgcttcaggtggcctctcatcctccagtagactagtctgagcttcttcactttgcaggctaagggttcccaaaagcagcaagaaagggcaagccccagtgcatgagtgcttttcaagctctgcttcaagatgcttgctaatttccctttaaccaaagcaaattacttaatttgttcagttcaaaggatggggaaactccagctctagtcacatgaggacaacatgagcaaagctcaaaggtaagagagaacatggcatgttggaagacagcaagtagtttggagtggctggagtcaggcatatgtgaagtctcatgaagaaaaagccagatcataaagtgtcttttcagtaagttctgctgaggagtttagagtttatcttgaagacaggggagtggtcattgaaagagtttaagcaggatgttgacatgatcaatgagatgtgtagagacatggttaggtggtagaagcctaaaaacactcgttagcctagacaattcaggaagtttccaaagagatgacccagggatagcataggagaagatggaaggacttgactgagaggtggctcaaagctgacgtgtactttcagaacaatgtgaccagaaaagaggttggaggcccttcaaggtagagcagaaaagacagaggctcaggtcatcagcaatatccgtatgaatctggtgggagaactccaccagtgttcctcacctcgctcctttgtgggatcctgccagactccaatgtccttgggttctaaataaacacctaccaaggggctgagtcaaagagattccagtctctggaagtgtcttcttgtcattgtcatcacccagccaaagactcttttccttccaacatgtttttccctttgacctcaaaataaacaatgtgttctaaaggctctggggcactctcaaaatgcttctctgacctcggataggaccatgcttacccattaatttccagatctgaccttttcactacacctttaagcataactctttcaaaaggcaaaaatagaaatgactgtttcatttcaccaaattcaagtcgccaagagtgagaacgtgtggttttcaccggtacgtttggggaccagtttgttgtcactgaaactgcctgatatcgggtcggagtggctgggtatttttcagtccttggggttataactcaaatgttggaagtggtatcttttataggtaaaattgagggaggggagcatcaaaatgtgtgcgatgcagataataatttgccaagttttctaatttttttcattaaaaaagaacatacagaagagtctacaagtagggcaggcagccttcattcctatgctcttttccttgagggacaccttccctaaccaaataattgaaaataaatgggaattgtgggaacagaggaagacaagaaggaaaactaaaaacccaggacctaatcttccaggggcaggcaggccacttttgtagctcagattctgaccttttctccaatcaaagagttcgaacagactgactgattggagtgctctgtcagcattaaactcaatgcagggttctgctctggcacctttaggggtggtggtttagaccctctgcgtgccatgtcttatcaccagcactgctaactgaatgggatgcattttcaaagacaggagagggtttgaaaaaccccagggcatgctcggagcctgcaggcatttgtttgctgctgagaaccatggcaagcatttttgacatttttatcagagtcttagttaaacaattatgtggaggactgataaagaagtgtgtgataggagacttcataatttaaagtgcccaaatttggtgagctttatactcatgtgaaatggaaatgaaaacatggcatgttttggaattcctgattctgcttatttgctttaatagcagatcattgcataaacactgactcattgcattctatactgaaaggaagatatggtttgctgtgttcaatctggtctggcttccagaacacagtatagaacaagtgccagaagaagggatgagctcagctttataggtgactggagagatacccaattccatgttttgtgctgtacaaacacatgaccttacatgaagttttgcataaaatattgaaacaatacatttctctttataaatatgtatgtaatctgttctagagtgtatggagtagacagtaaaaaaaaatagaatcttcttatttttggaagtggggtgaagacgcaggtgtgcatatgctgccacctgcgtgttatttcactgagttttgtcaggttcttttcttactcatctgcactttgtatgttaccttaagcgctgtaaccattctaagctgccagggacatgggtatgcaatcaaagtcaacactgtgattaaaaccacctcctgttgtttacctttttagaaattttaataatacagtcaagtctgaaagagcagaacttttctcaaagctacacacttggttgcctcttcttgattaatgcatgggggtggtcactgtaacctaaggtctgacagatggtgcggagattgatgaagttaaggcctgttaggtattccgagtgtcttataaagaaaaataggctaccttaattcaaattgttgttgctcttccaaccttctcttatgtaaactccctgtatattacaatgacagactctctctctttctgtctcacacacacacacacacacacacgcatgcatgcacacatacgcacactcctgacatgctctactgaaagctgcccagctacagagaggtgcgaatctaatccagggcacatggctgctttgcatttcactggctgtctagtgtcactctatgatataggcataaggtcatgactgtgagctatcattgtcacttatcttaatattaaaacccctctgatccaatctgtctgccttatctattacatcattcacatatctagattcttcaaacttaactactcattgcagcaaactcaggaatgccgagctctaaggcatctccatttacttcgttcatctcaatctcaaattactaaccatagttcagtttcaggatgacactgaaaattcaaaattacttcctgtgattaacttacattgtgatggttgggaattatttcgcagaagacctgttcatcttctgatgaagcccttttcaagttttgaattgtgtgtgtgtgtgtgtgtgtgtgtgtgtgttttaattgccagaagtctttcagatagcagggagattattggaatgagaaagcaaagcttgtatgaaaacttgtggcaaaaggtcatctgtgctgtgggggaaatttcaaagtaggcgcagtttgtttccagtggttcctgcctgtcctttcagtggctggtcactctctgttccctttccagacgaatctttcccctcttccaaatgcctcacatcagtctaggtaccttggttggcctgtggagaaaaacagtcttgttgagacactcacattaagctgatagagaccttggctaggataattgcatttttcaaaggctaagggttggaaggatttaatttttctcttaattattttttatagagatgaagtctcactatgttgcccaggctggactcacactccctggcctcaagtgatcctcctgtcttgacctcccaaagtgctgaaattacaagcatggcctgaatttttttaatggtgatttcagctgatcccaggggagatcttttgggtgtcatttttcaaacagattaggaagcaagcagctgtctacctaatcagtctaaactacccattctgacttctgtccaataactttccatataaaatagctaacataataataatcagataactttgcatgtaagtttcaaagctatggtatagttcaccaacataattttccagttttttttattatagtaaagtacacataacataaaatttactgtcttagccatttttaagtgtatagttgtacattcatattgatgtgaagccatctccattgtcttgtcttcacacctctttttttctggcaaaactgaatctagacccataaaatactaatgctctaccctccaccctagcccccggcagccaccattctacttgctgtctattattttgactactgtaagtggctcatataagtggaatcatgtagtatttgtccttttgtgcctggctcatttcactgagcataatgtccttcaggtctgtctgtgctatagcatgtcagaatttccttcctttttagactgaataatattctgttgtatgtgtagaccacatttagcttatccttcatctatcagtgggcacttgggttgcttccacctttagtttattgttaataatgctgctatggatatgagtgtgcaaatatctctttgaaactctttgaaaccattcatcaactctctctttttcttttttttttttttgagacagagttttgctcttgttgcccaggctggagtgcagtggtgtgatctcggctcaaaacctctgcctcccaggttcaagcaattctgttgcctcagcctcccaagtagctgggattacaggtgcccgccaccacaccaggctaattttgtatttttagtagggtcagggttttgccatgttggtcaggctggtctcaaattcctgacctcaggtgatctgcctgcctcggcctcccaaagcactgggattacaggcatgagccaccgcacccagtcttcaccaactctctttcacgtctttattagatacaagtgtttgaagaagccttgcatctacccactttgaaccttttttcatgatagaactgtaggtagactttctgcctagtagtgttatttgaagcatcctttctgctgacctctttcctgaggcctgaaatgctactaatagtagttcagtcctcaagtatcaagcaaagccatcagctagttttctattaaaatgcaaatgatcctggggcagaggccacagataagatattagcaccttggtgtgaatttgtttaattagatcctatcttagaagctttctttaaccccttgcctagttcttcactaattgctccctgataaggtcttgcattattactgcaagtatcacactgtattaaacttatttatatttttgcttctcctgatagaatagaagcttcttaagggcaagactcttgtataattgctgttggtttttcaggccctaatagaatgtcacagacaactttcaataagctactcactcattctttcatgcattcattcattcatttcactcatttattcatcaagcatttattgggtgcccacggtgtaagtgcattttaaaactctgcctttctagaaggtttggacagccaagggccagctctgttgcacagttttggcagattttagaaaccttaaaatctaacttcctgtatttttaggtgcagggacttggtccagatgagtggatcaacctctgaaatagttttctatcacagtcctaccttttttttttttctgcttctattcagaagaagcatcgatctaagtaagtttgtgttctgttcaaaagtaaggtgatgtttcaatgtatattctcaagcatctgaaaacttctctagttgctctaaatctcaatatttccaatatcagccatgtacagtttttaaatgcttgcattctcttaggacattgttaacaatctgcttagaaaggggagtgacttttgcctcttttggctaatttgctttgcattgatttgtaactgtgtacttcagtatataccagcaactcctagcccagggatagcatatactcgcttactggttccagtgactgttcattcatcccacagtggcttccctggaaacaagttactctgataacaatttgatggtacttccctttataaggtaataaccagtccgggccaggcatggtggctcacgcctgtaatcccagcactttaggaggccgaggcgggcagatcacgatgtcaggaaatcaagaccatcctgactaacacagtgaaaccccgtctctactaaaaatacaaaaaccaaattagccacgcgtggtggcatgcgcctgtagtcccagctactcaggaggctgaggcgggagaatggcgtgaacctgggaagtggagcttgcagtgagccaagatcgtgccactgcactccagcctgggcgacagagtgagactccgtctcaaaataaaataaaataaaaataaaaataataataaaaaccagtcctaaaccaaattcttactttagtctctagcctcagagtttattagttcttagtaatgttactatgaaggcaaataggagacaaattattattctggtttttattgttactgccactgcaattcctatgattattgctataattccctatttaataggtaaacaagttacaacatattcgatggtcactagatagaaatagaaatggaatgtctttaccaagagaatatccgtgttttacagagaacaggaaacaagtactaaatggaatcttcagacaatcttttggtcttcttgtaggcagtggttcagcttttttacctactaaaattttggacagggttgttaacaggcaatacagtttaaaatgaactgttttaagttttcctttctgactttttcatactcctacattaatgcaataggattgaaggctacaacaatgataattgcaatatgctgaaataatgaactacagtaaatagctatagtgaatgtatgcccatagaaaagaatggaaaacaaatggcttttgattaaaggtacttattgtaacagatttcaaggtgaaattgttagttcagaaaagatggtagatagagtctttaaaaatactgtcactgggatgcgtgttcttctataatgctccctccatcccccacccgaagaaacacacactcctccctcctctgcatgtaaagcagtagttttgacaaataaaaccaaacagtaaaacctgacactggtgattggaccgtgcgtccctctggtttgtggatgaggagcatatctccgtgatagaataaccacgcttcatgctaactcccggccacatcgctgcatcctcttcatacataatttgcatcatggggtgtttctgcatatgttgtgcattttgatgttatttttagctacaatttttaaaacaataacatttttttaaatagactaatcaagaaagcgcctccagagtcaagaaaacaagtgctggggatgtgtgggtgggggtctgtctccccgcccagggcatttccctttgctgctgttgttactactccttccattactttttgtgactttagctttttgaaatttccattcctttgttttcccttgtgcatcaggatgtggctgttgaagtcatttatgttatgcgaggctgcaccacagtcatttaatgcaaacactggcttttgtgtaaggcactgactattctaccctcagcgaggaagacgttattggaaacttgagttatgagatggaaagaacattaatcctttcattgaaaacattagtcttttacatggattctctgtaatagcttgaagagaaattaaggaaatacaaactagtaatattaaaaatctgccatgtcattattatctacctgcccatagatgttcaccaccgttagcatttgagtgtgttttcttccagaagattttctatggatatatatatatacaaataaatacatgtagctttacagaaatagaatcgtgcttgatctacttttccgaaatttcttctctcacattgcaaaagttgtgaatgtctttccatctgaattattacagattttcaaaatatttttctggctactgacttttccagtatatgaatgtaagagtgaaagttcttcgatttcaccagttggatatgcccccttttctcttttctgccaatatcaattgtactgccctcttgcgctatcctaaatatgatcagatgagaattctgaaagagaagaaatctaggaaccctacttgatagagagttatcctcttgggttccctcctgacatttaggcctttttttttttttttttttttttttttttttttgagatggggtctgactctgtcacccagactggagtgcagtggcgcaatctcggctcactgcaatctctgcccccgcctgggtacaagcgattctcctgcctcagcctccctagtagctgggattacaggcacctgccactgcgcccagctaatttttgtatttttagtagagatggggtttcactgtgttagccaggatgttctcgatctcctgaccttgtggtccacccgccttggcctcccaaagtgctgggattacaggcatgagccaccgcgcctggccacatttagtacttttaagaagttattcctcttccatctcagcttcctggacacagttcgctatgacttttcttggaaattatgcattcccttagaatccttgtattttctgtttactttccctcaaagcaaggactcatgacctcacctgtagtgggcctccccatctctcatgtctttatgtggcccggacttagcagagacacctcttggtacatcattttgattgcatcatgagctttcccagagtctggagtgactctgtctttcagatttcattttaacctcctaatcacaggctatctttgatgcacctatctttacctccagttcttctgctaaagaactggaggcttgtggctcttgtcttccggtcaaacatgatgctctgctgactactcttccccatgcattcatcccaccccagaccctgcccttgccctcatccccatctgaatcattgcatcctcctagttcttggccaaaaaactggctctcctctagcccttcaaaccttgcctgggagtcatctttatggcaccttccctgattttttgttttgttttgttttgtttttggaaatggaatttcactcttgtcacccaggctggagtgcagtggcacgatcttggctcacggcaacctccgtctcctgggttcaagcaattctcctgcctcagcctcccaagtagctgggactacagacacctgccaccatgcccagctaatttttctatttttagtagagacggggtttcaccatgttggccaggctggtctcctgccctttggtgatcaacctgccttggcctcccaaagtgctgggattacaggcatcagctaccacacccagccgttgcaccttgcctgattaattccacttggctctagctagtatctggaaggacacctgggaggaacacttcaaacagctgtcagtgcagtgttgttgttgtttttgttttttaattaataggcttttttatagaacagttttaggtttacagaaaaattgatttgaaagtacaaagagttcctatattcctagcctccccgacccctgacaaacagtgtccctactgctaacatcttgcatcttacatttgttgaaattgaactaatatggatacattattattaactaaagtctatagttcatgttagagttcattcttcctgttgtacattctgtgtttgacaaatagatgacatgtgtcctaacaactctttgtgctctgcttatttgttcctcccaatccccaaaacccctgatttttttttttttttttactatccctgtagctttgccttttccaaaatgtcataaagttggaatcatacagtatgtacccttttcacattggcttctttcatgtggcaatatgcgtgtaagtttcctctatgtctttttgtgtctggagttggttcctaccggtgggtttatggtctcgctgacttcaagaatggagctgcggaccttcatggtgagtgttacagctcttaaagatggcatggacccaaagagtgagcagtagcaaggtttattgtgaagagcaaaaggacaaagcttccacagcgtggaaggggacccaagtgggttgctgctgctggctgtggtggccagcttttattcccttatttgtccctgcccatgttccatttctgttctgtcagagtgccctttttttcaatcctccctgcgattggctacctttagaatcctgctgattgatgcattttacagagcactaattggtgcgttttacagagcacttattggtgcattttacaaagtgctgattggtgcattttacgaacctcttgtaagacaggaaagttcctgattggtgcattttacatcctcttgtaagacaggaaagttcctcaagtccctacttgacccaggaagtccagctggcctcacctctcaatcccccctctaaacaggacaccccagctgctgttgggaactgggtgatgactgctctagctacttcctgctggataggggtgaagaaggggccctgcagttgtagtgccctccagaggggaacactctaggccaaagggctggtgggtcagtccaggggtccttggtagaagttgtgagttgagctcatttggggttccatttgtaagaccatctgtagcttgatggtatcgatcctggaggaaacaaatttgacaaagaggttaaaaacacagggcccgaaggtgagtaatagcaagatggctgtcatgggacgtagaaaggggagaaaccatgttgcccaactctagaggttggtataagagtttgaaaggcattgtctgatttcagaagccttttcctgtaactgctgggcagcatcttgtactatccctgagtggttagtgtaaaaacaacagtcttctcctaagaaggtgcagagtcttcctttctcagcagtgaggaggtctaggccttggcggttttggatattcactactgccaaagagtctatttgggattgcagagtaaggatagattttgttatttcttgcaaactgtcttgagaaatcctttgagagtgtgtggtagtaggataatgaagtagataaactggctattctggttcctgtagcagtggctattcttaaccgtataagtaggggtattagttgtatggccctgtactgacggacctgagctttgaggggcactgatagggtctgatttcctgcggtaatgttaatgttgggacttaggaagactaaggtacaggtgcctgtccagttagtggggaggcagatgtaagttgaagttccacataagaatatgccttggctgggtagacagaactggttgtgtatgttaaaaaggtgtgtgagtttgttgttttcattttcccatactcctagagtacttgccaaggtagtctggtgagtggctggaaaggggtgttgggagcaaactgagtgactccctgtgctctattttcccattggagaaaaaactgttttgtatctactaggaaccattcaagagagtgattgaaagagaggatgagaaggtattccttagtggtgggggtgctgctgcagggggtccaggggtgaatagtcatacagggagtatgtttgccattacaaaacctggactgtttgttaagcagggaggaggtgatgatttttgggggccctgagaagcggacaagccatctgaatagagcggtttgggtgccttggaagttactatgatcatttggggcttgaagttggagagtgtaattacactgatgggatagtaggtgccccaggggcaggcctgataacaggttgcgttggatgcataacggggcttggaaagttaagatggtattcacggttacagggcttttcattgctcatgtaataggtgaggttggaaatgtaagagcgtaaaagctggattgcatgtaaaaaaggttgatgtgattaggatttttgtcccggcaggagctacagtatatagtcctgctgcaaagagaatggttagtatactgcttaataatgtgatgaaactgtaaaaggattccattaaaggggcaaggagtggtgttaaagattatgtaggttttcacttatcctttttaaataggaaagagtttttccttaggatcagctataggggcctttttagtctgggatgtttccttctgaaataggagacacaaatcttccaatggttcacaggtttatcgaggctggtctggctgatcttgggactcctgagctgatggtcctacaggttcttcagggggtgtccaaagtttaactcgcatgtagtgaatccaagattccactcctgccaccttaactgcagtgggggtagagaggattactgagtatggtccttcccacaaggaatccatagatgaggaggaagaggggagggacttgaccaacagtaaatctcctggttggaacaactctgttcccttgtctctgtgacatcctttgggtaggtttttaacgttttgttggtattttgccaaagaagttatatctttgaccaacttggccgtttcctgatcaagtaggaggtcatttgtgagaaaaggtcatccatacagcacttcatatggactgagccccattttgtgaggagaattttggattctcaacaaggccatgggcaagagagtaggccatgggagatgagtttcttgtgttcgtttccttaagtgcctcttgagtgtttcgtttgccttctcagccttccctgaggattgtggcctccaggcacagtgaaagtgatattgtatccctagtgccctggaaattccctgagttaccgtggctttaagagccggaccattgtcgttttgtaagctttggggaagcccaaatctgggaattatttcatgagttagtactttaaccacttcctgagccttctccgtcttgcaggggaaggcttctatccaatttggttggtcaacacagaccaacaagtattgaaatccccttgacttaggcatatgggtgaagtctaactgccagtcctctccaggatagtgacctattctttgttccccaaaaggggccttacgatggaccaagagatttttcctttggcacacctcacaggctttgactacttgttggatggtctggaggagatatggccccataaatagggatttggccatttgatgagtgttctcaaacccatgtgaaaagtttggcagggggtcttaagtattttccactggctggcttcggatatgagtacctttccctcttctgccgttaaccaccccaaggggagaaaactatgcccccgtgaaagtccccattctgtttcgatcagggagtactggggcttaatctcttggagggggttgttccataccatgggtccttccataggtatttctaatgggaggttctgcctggcagcaattttggcctcagcatctgcccagtggtttccttctgccttttctccttcacctttttgatggcttcagcagtgtaacactgccacctccttgggtttttgcactgtgtgcaataactccataatttccttgtggtatttaatgggggttcccccagaggttaggaactccctttctttccatattgcagcatgggcatgtaggattagataagcatacttgctatctgtatacacatttattcttttttcctttcccggttctaaggcttgggtaagttctgctaactaggcgctggtccgtggggggaagagacttactttcaagtactgttacatcactaactatggcataacctgcccttcatatcccattctccacaaatgaacttccatcggtatataggttaaggtcaggattagctaagggtacttctaagagatcctgttgggaagcataagtctgggctacaatttgttggcagtcatactcgattggttctccatcctctgggagaaaagtagcagggttgagggctgcacacgtgtgtatttcaagcaccagtccctgaatgagtagcgcctggtacctgagtaggtggttttctgatagccataaatttcctttggcacctggtatgccatttacatcatgagtagtctagatggtgagatcctttccttgtattattttgatagcctctgacactaagatagccactgccacaactacccgtaaacagtgaggccagccttttgctactacatcaatttccttacttaggttgtggggttccttccttactggttgtggggttgtcctacaagtctgagtaaggactccaagagctattcccgctctctctgtgaggtataaagagaagttttgtcctggggaaggcttaagtcttgagtttgtactagggcctgctttaaggttttgaaggctgtttctgcctctggttcccattctactagatgaatatttgccctctcggtctccttgattagagtatagagtggcctggccatctcgctgtatccggggatccatagtcggtaaaagccagtgatcccaaggaacccccacaactgttttaatgtgttagggcaaggacaagccagtataggctgtatttgttctttgctgagggccctggttcctctggctaggattaggcttagatatttgacttgttgtaggcagagctgggccttcgatttagatgccttgtacccttgattagctagaaagttcaagagatctagagtagcctgctggcatgaagcttccgaactggtagccaaaagtaaatcatccacatactgaaggaccagcatgcctggacttgagaagtggcctagatcttgggacagtgcctgaccaaacagatgagggctatccctaaacccttgaggcaagaccgtccatgtaagttgggttttgtggtctgtgggatcctcaaaggcaaagagaaactgggagtccaagtgcagaggaacgcagaaggcagcatccttgaggtccagaacagtgaaaccattctgcttcctttggtatttgagagagcagggtataggggttgggtacaaccggatatagaggaattacttcctcactgatgagtctaggatcttgcactagtctccactgacgattcagtttttgtactcctagaattggggtgttgcaggggctactgcattttcttactaagcctcgaacttttaaatgtataacaatatcctgtaatcctttatgagcttcaggccttaagagatattgcctttgataaggaaaagtggtggggtcttatagcctgatttggactgggtgggcattttttgcctttccgaattgtccttccaatgcccagacttcagggttgattccctcctcaagtaggggacaacaaatgggtaacttgttccccatattcatatagttaatggctccagctttggctaatatgtccctccctaataagggtgtggggctttcaggcataagaaaagcatgtgaaaagagcaaagtctcccaattacaactgaggaggtgggagaaatacctggttacaggctgtcccaggattccttggatggtaatggatcttgaggacagctgtctggggcaggagattaacactgagaaggccatgccagtgtccaggaggaagtcaatttcctggccctcaatggctaaacttgcccagggctcagtgagggtgatgacatgagctggtgcttgcaccaggcaccctcagtcctgttgttggatcatctggttgggggcttctggcccggagaacctttgtcctctggggcagtaccccgtctagtgattgccttggcatagtggacatgggtgagggagtagcttgtttcttgttggacagtcttttttaaggtgtccttgcaaaccacactgataacaagccctactgggtgattggcctgctccattttctgtcctctctgaaccaccaaggtttgtttgtctgagggccatgactgaggctgcggcctttctcttatctcgcttttccttttctgcctgttcctcttggttcctattagagaacaccgcggttgccaggtttaataatgcctccagattttgttcagggccaagggctcgcttttggagctttctcctgatatctcagctgattgggtaataaacatcttttaggatcaattgaccctcgagggagttgggtgacaggggagtatattttcttaaggcctcccatagctgcttgaggaaggcagtaggattttcttcctttccctgagttatggtggacatcattgaataattcatgggctttttcctaattctccttagtccttctggaatacaggtcaacagatgtttgcgactccagttcccatgatctgagtctaggtcccagtggggatccataatggggatggcttgctgcccattagggaatttgtccctttcttcggctgtcattttgtcatttacttgactaagataccaggtatctccaaattctcgggctgcagctaaagctgcattcttttcattaaaggccagggtttgatctaacaatagcatgacatctctccaagtgaggtcgaaggtttgccctggaccctgtaggacatctatatacctaccaggatcatctgaaaactttcccaggtctaccttgatctgctttaattcagagagagagaaggtcccatgttgggccaaattcccctccccctacagcttaaaggagacataactgatagcctgaggggtttggtggtcctttggaaatttctttgcttgtttccttctggatggaggagattagaggaggctcatcattaataggaaggggagctgtagggaggctaggatatggaggtaatctgagaggtcctcctgtggaatgtaaatcgccagctttgcatagttgtggattatccttcagtaaaaagaaagcttggacataaggtatttcactccatttcccttccctcttacagaaaaggtcaacctgcagaatagtgttgtaatttatacttccctcaggtgaccatttttccctattagagagataatattaaggccagaccgtagtgcagaaaaaataagccgcttctttttcagggtttgcgggacaaattggtcccaatggcttaggatgcgtttcaagggtgagcttgttgatgcctgggtgtttcccatctgaaagaaaaaaccgcctgcagttttttttttttttctcttctccctgcccaagaacccacaacagtccctggatcctgctgttcggaatagctgtgctcaccaaagcagcagcggaaacactagttttcctcctagaccacaaaaaggactgaggaaggtcagatttagtggcccttaccaatggattctcaaaaacctgcacccttgcctttcgtctttagaccacaaagaggactgagaaaagtcagatttagtggcccttaccaatgcattcttgaaaacctgttagagtcctaagtgttttctcctgttgttattaggaccttacccttgtactataaagataatatgcctcaaaatggagtggagggccataccctgagggaaggaagggatctccagggttggaagagtgatgcgttttgtcctcacttatcatatgaataggaaggatataatttctgagtctcctcctatcctagctttgggaatagcctttgttaggtctgctagtctgaggagggatcctaaaattccagatagtcccccacaacagggctttggacaaaaattatgtctttctgattggtgagcctgggtgcctaaagaagggagcagagtcctgaaatttatattagaaatcatccttataggagaaactggaagagcaccagggacagggagtggtttttagaagcaagactaaccttggagaagagaggcgggagaaagtttgtctgacaggtgttaggacccaggaggcaagggtcaggatagataggatagatgggtgagtcttgtttgggctatgtaactttgagagttctgctcatggctgcagggccaaccaactttttgttgagaccccggagctgaatggctttcctctctgtcgaccctaggcttagcccggaagtgcaggaaaagcagaagctggttccaggcaaaccaatgctcctgactccaaacagtcgggggttgttagtgagccctttcccagagagcctgacatccatgtccttagtcctgtggccatgctagttgcttttaactggctgacaggtgcctagttttagcccctgaattctaaggaaaaataggacagaatagcaagcaaaaggggtctgatggtactcaccacgttgcaatatctgggaggatcccccaagatgtgtccagagttggttccagccggtggattcatggtctcgctgacttcaagaatggaggcacggaccttcacggtgagtgttacagctcttaaagatggcacagacccaaagagtgagcagtagcaaggttaactgtgaagagcgacaggacaaagcttccccagcgtggaaggggacccaaatgggttgccactgctggctggggtggcccgcttttattcccttatttgtcccctcccatattctgtttctgtcctatcagagtgccatttttttcaatcctccctgcgattggctacttttatactcctgctgattggtgcattttacagagcgttgattggtgcattttacagagcgttgattggtgcattttaccaagtgctgattggtgcgctttacaaacctcttataagacaggaaagttcctgattggtgtgttttacaatccttttgtaggacgggaaatttccccaagtccccactcaacccaggaagtccagctggcttcacctctcatttttatggcctgaaagcttatttgtttttagtgctgaataatattctattgtatggatgtaccacagttcatgtacccattcacgattatgaatgaagctgctataaacatttgagtgcaggtttttgtgtggacttaagtttttagtttatttgtgtagataccaaggagcatgcttgccacattgcatgttaagagtatgtttagctttgtaggaaactgccaaactgttttcccaagtagcttactatttgcattcccacccgcaatgacttgagagttcctatggctctgcatccttgccagcatctgctgttggcagtgtgttggattttggccattttcataggtggtatcttgtgtttgttttaattcacagttccctagtgattcataatgtggagcatctttttatgtgcttacttgccatctctatgtctaatttggtaaggtgtctggtcaggtcttttgtccattttaaaaactgggttgtttgttttctaatagtgaagttttctacagctctgttgtgtggttacttcttttttacatcaagatgagtcttactacctggttagattgggtgttacttgtagagatgctctccttccttccttctgtctcctagagcatttgccacacttcagatcctcagtaaatacagtcttcccaacccaatgcctgccacatgtttcctgacctcaagttcatatatcctctcgcattccctttactcctttccatacataacagtggtggtcactgctgagtccccctgaaggtgagcttatctacctctttttatatccaagctgcttaattgctataatatccaagctcccagatcacagcttttagttctttttctgaatctgaactggtgataagattaagaaatctcttggttcttttgcattaatttcttggttttgctgtctactataataatttaatagcatattttaaaaatgtttctgatggctgtttagttttgtctgctgactacaaaggttgttttgacctcatcttgctgacctgccaaaagcactaagtctatggcagtaagagagtggaaagtctgttccagtctctgtataatacaattacatgtactgtgtagcaataataattaacatgggaggaaatcagtacaaattagggatattcctgaatcattggctacactgtagataatgcagcttctcaagccagtttgttacaaatgggctacaggtatatccaagtatggattgcctcagccctcaggcagccttgacccctgaggctacagagcccctagcagggggggttaaccatttatgcaattatgctgctgcccagatgttattttctatacaagtagttcctttagagagagcaagtgcaagccccaagcactggcacaatatggagtggggaaaacaatgattttgaattcagaagaattcagttcctggtcagctctctgatggcagggattttgtctgctcagctcactgctctatccctgtacctaaatcagtacttggcacactgtaagcactcagtaaatatttatcgatctaattcttctgtttttttttttttttttttttttttttttgagacagagtctcgctcttattgcccaggctggagtccagccatctcagctcactgcaacctccacttcctgggttcaagcgattgtctgagtagctggaattacaggcacgtgccaccatgcctggctaaccttttttgtagttttagtagagacggggttttgccatgttggccaggctggtcttgaactcctgacctcaagtgatccgcctgactcagcctcccaaagtgctgggattacaagtgtgagccatctcgcccagcttcgatttaattattgaagcatacttgaattcaagcatgttacttaatcctctctgcacctcattttccagaattagaaatatagtttattcctatacagcagatataaatttatgtgtagacagttgggctgttgttgtaacctaaaagtgacatatgcacaacctgtagcacaatgccaggtacagagtaggggatccagtgggttctttcttaccctctttcatttgaagtttttaaagtatcaggtgaagatgatgatgatgatgataatgataatgaaagtgatattttttgcatacatttcagtaaagttcattaccttacactgatgtaatcctcagagcaattcttagacaattatggttttttaccccctctttattttattttatttttgagacggagtctcactctgtcgcccaggctggagtgcagtggcgcaatcttggctcacttcaacctctgcctcccgggttcaagcgattctcctgcctcagcctcctgagtagctgggactacaggcacctgccactacgcccagctaatttttttgtatttttagtagagacggggtttcaccgtgttagccaggatggtctcgatctcctgaccttgtgatccacccgcctcggcatcccaaagtgctgagagtgtaccccctctatcaatgatgagactgatgctgagaaaagtaacatgattatgtaagattacacaagtgaaacacaccaaaaacagaccttgaacccagtttttttattttctcacgtcaacttttcctccacaccaaatctaataaaattttataaagaattactttaaagactaaatcactttcgactagcatgttgtctggatgcaaatgatggtgataaagtaagtttaataatgcttaaaggaggtaaacaattcctaaaccttttaaaaaatctagtcagctaaagtaggtttacgctaaactttcatcagaatccttaaattctaaatcttgaacttttaaatcagtaatagagttttaatgtgaattaattgtctgtaacattttcaaaagataaaagtgataaatgcacaaacctacctgctattataaaacttgttgtggtggaatgagacaagaatagatgtactataagaacaagagggatatgaagaggcaggtttatgtcgatacttaaaatacatttgacgccatccttttgacaggaaggaatgtctttaaaatctcacaccagtgagagtgggaaaaaaatcagccatatttctgctttttttaccctttcattggaatgctcagtcacttggtctactctggttttgattcacaaatgagttttcagaaatgactgtcccactggctttttaaaagaaaaattcagtttttcctctgaagactgacacacaatcactcagagatggataatcctaaatgttttccttttccagctgaatttaatcttatgctatcaacaaaatctggaaaggtttactttctcatatcattcattactagttatgaattctgaaccgtatttgtaacctgttcatcacatattcatccctgcatgtattcattccctaaatatttattgaatgccagcaatacaccctgaactcggagaaaacataatctttaccctcaaaaagctcacagtctggtgctcagttgaccaaacatcgtgtttcttttctaccgagttgcaggtcttctctctgtggatgtcattgaatgtcgtttgcagaattctacttgctatagtaggcatctgtcttgttcatgagccacattacaacctcgtgtgttataggcaaaaaggcaatctaagaacggcctgacattcggacgcctaaggggacttccctagtgagggcacaagacagacaaatcccagaatattttctatatgcagaggaaacttctctggcatcttagaaagacaaagacagcaagactgaagatagaaacaggaggatagcaaccttttaaacaacttgtttttgtgaaatttgtttctgtttgctttgagaatgggggaaaagagaactctaattacaaactccacgtttctttcaactatactattttctttctttttttttttttgagacggagttttgctcttgttgcccacgctggagagcaatggcacgatcttggctcactgcaacctccgcctcctgggttcaagtggttctcctgcctcagccttctgagtagctgggattacaggcatgtgccaccacgcccggctaattttacatttttagcagagatgaggttcctccatgttggtcgggctggtctccaactcccgacctcaggtgatctgccggccttggcctcccaaagtgctgggattacaggcatgaggcactgcacctggcctttttttttgagacggagtctcgctctgtcgcccaggctggagtgcagtggtgtgatcttggctcactgcaaactctggccctcgggttcaagtgattcttctgcctcagcctcctgagtagctaactaatttttgtattttcagtagagactaatttttgtatttttagtagagacagtgtttcactgtgttggccaggcttgtctcgaattcctgacctttggtgatccacccacctgggcatcccaaagttctgggattacaggcgtgagcaactgtgcccaaccagttatactattttcaatcctatataatttgtacagctgaagtggcaactgcttgcttttaaatgggaagagaagatgtccccatttaatgcttagaaaagattgacttcggtttaagccaaaggagcatcctggagaaccgaatgattcatgattagtaattctcaaggaatggccatgtggctcttcatagcgttggcccttgggggggtctactttaatctttgttctaacccccgccgcccctgttgtccttttaatcctcatggatcaggtgcgttcacagataaccactaaagtgaggctgaaagaggttaggatggggatggacacctgtatttctgagaggacctctccatgatgtttaggaatggggttgacatccttcacctagaaggtcctttcccaagattggacattgattttggtcgctggagcagcctcatcagcatttctacaaggtccccagaagggaggaagctattcattgaatacttcatatggaggtggttttatgttatttttatgagatattaaggaatcttcagaaactcatagcatctccatgttgcagataaaagaggctcgatggaatgggagtgagtcagttcagagttactctgctaataataaacgtgctggctttgaacctacgtctctctgagtaataagcccctgccctctcttccaaagcacattccttcccttgaatcagagagcactagatgggaagggtgatgggagctacattatcactggcagatggaactattcagctcctgtccttccattctctaagaaccatgcatgtgtgtaaacacatgttgcatcagtgattgttccaggctttgcctacttgctcccaaacatgtgaaaaagaagaggaagattaagtaagtcattcatatattacttatatctgagtgtttgcaatcatataggggagcatagttcccacaaggaccggtttttgtaaacttttgcttctctttcctgtatttaggcattatatagctatggcagtgatcacccacaggtacaaattctgtatcattcattgcctttacttggaggtttacaaatatttttagtctctacttctttttcaaacacaatcttgaaacctcaacatatgaaacgaataaaggaaaattttgttagcataatgtatgttagatttcagcgtgtaatgctgacttataaaatcaagaagaaagaacaatgaagctttgtgatgaacacagaaatttgaaagcagtgttagagatgacagctgcaatcttctttaacttcagtttccaatttattgccttttgttgttaggtatattttttatgttgttgtgcagtattgagaaaaccctgattccctaaaataaggagttgcaaataataatgagttgttttatttttttaaacagttaccttgcaagctcaggatatgttttcctttaaacttatccacttaaaacgtgttcacttaaaacaaaaggaagaaaagaaatggcttctttcaaagctgatatcgctaacaatgtgaaaccatttacattttttaattggtaagcctgcgatttggaggaccaatgatagcttcctctagcctaaatcttccattagagggagaaaacactttttaaattataacattaatgagatgctcattgatgtacttaaaaaacaagaagaagaagaaactcataagcctgagggagggctcatctctttcaattttagaaggaagaaattgtctttgctttgcatggtgggtccaatcttgaactttagatttaatctctgacattggctaccataagcatggtatgtctgacagtttaatgccaataatttaattttattacaccattttatactacatgtttatttattacataccaaaattcactgaggacaagaactcagggtgttttgtctggtcttggccgttaattgtccatgatacactcatgctgtactagggtgctcacttgtgaaatttcatgcaagtggacgtagggagaacttaagtttatatgtttaaaaaaagcaatggtagcgctacaacctttctacctgagaaacaggatgtcactgagatgacgggatacctttattttgagatctacacaagcctggcagtatggtctggcccattagtagttgtggcaatgccaggatggaagttacatttgattaacggggtaactaagaatctaacttcagaagaactcttgctatcccctttaaccctcacaacaacagcaacaaataaatcagttggcaaatcttgaagatgtagagccttactaacaaaatggagttaagaaaacccttcatgcaagcaaaaaagcttgatctctgctagggacatcaaaggtgcagtggtgtggacgtccagacacagatctgatgtaggctttcctcttgggccttagcctagctcagtggttttcaaattccactgtatgtgagcattgttgcacagggtggtataaacaaaaactgtatatagtgtccttgttgggcaatgtaagacacttttatttattgagccaatacttacagagtgccttctctgtgctaagactcataggtgctgcagtttgagcaaggatgaagagaagtcagttaatgggtgatacaaaaatacagttaaatagaaggagtaagttttaggattcaatagtacatatcacttgtacccccaaaatatgtacacctgtgatatatcagtaatgaataaataaggagcatcattctagcgcaggaaacaaaccaacaaggactttgtggtgtaacatcagctgtgatgaatgaagagaagaatcagaggggcgagggaagagggggcctgctcttttagacaaggcgaccagggagggacacatcacagcagagacctgaatgaagagaactcatttgccagaggagcattctaggtaggaccaggattgtgcctggatgtggaagggagtgtggaggccactatgctggagcagaacatagggaggagatgggcaggaaaaaagaggaggagggtttcacatagttggggtcagatcatgtagggccttctaagtcttgacatggaccaggactgtggtttttaccataaatgtaataggaagcattgaaaggtttgagtggaatggtattaggatctgatttgcaccttacaatttcaaggatacttttgaacccacacactctgcattgggtgggaactttagaccctagcccctgaattaagtgttattctactatatggcacatggagagcttttctgaaactacagttacttaataatgagaaattcaatttaaaaataaaacgcagatgctctgaagcccgttggtagaatctttggggcttttaaataagtttaaaagctacaagcttcaataaagattaaattagaaatcctatataaagcttctaagagtgtaactagcattttagtaatgcttactaagtgctggttctgtccctttctgctctcctattttttttatcagcgcctttgctattaggccaggcgcagtagctcacacctgtaatcccagcactttgggaggccgaggtgggaggatcacttgacgccagaagttcaaaaccagcctgggcaacatagtgcgattctgccttgataaaaaataaaaataggcagggtgtggtggctaacacttctaatcctagcactttgggaggctgaggcaggtggatcacttgaggccaggagtttgagacaaacctggccaacatggtgaaaccccatccctactaaaaatacaaaaattagctgggtgggtggtgggcacctgtaataccagctactcaggaggctgaggcaggagaatagtttgaacccaagaggccaaggttgcagtatgctgagatcatgccactgcactctaacgtgggtgacagaacgagaccctgtctcaaaaaaattaattaattaaaaatttttaaaaaatacaattaaaaaatacctttgctattgatgtctgtttctgattgtctgtcatcccggtacactatatttactttccagggaaactgagtcattcaacaagcctctggcttctagtgataagcactatcattagaaagaattatgttctgtgtgttaaggataagggacacattctttttggaaaatagtgcttgtgagtctaggaatagttgtataatctgggaatatatgctaatgctatagctgagttcaaatcacttttttaaaaatgcaaacttatcttctctgtcaccaagcatgtcttccatacaaaaggcacatttctgtagcttcatccatgttactctaggctatttcctctagtttattaaccacacgctcagcaaactgtagagagtatggtctgatccctttctcccataataaaaattttaagactatgtacttgttgatagatgacaccaacaggatatattttacagaaatgaaacaacaacatgtgaagaatattttaggtcactgtaaagttcctttaatagaaaaaaaactttagatttaactgttaaaccctttgaaaaagaaataatttatttcatgcaaatgactaaagcaaaatggagtgtgcagaagacctacctgcatactgtatgtaaaatacagttttctgggcttcactcccaggaattctgattcacaaatctggggttgggcagctttcaattttgagaagtgccccgagtaagctgatgtcaggaatgtgaattttaacaggcaccccaaaggaaggctgtgggaaaccacatttgagaaacactgccaaattaccaaaggaactttaactttgtgttatagaaatatcaaacacatttaacagacacttctcaaaagaagacatttatgcagccaaaagacacgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgcaataaagacacatgcacatgtatgtttatggcggcactattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaattggaaatcatcattctcagtaaactatcacaaggacaaaaaaccaaacaccgcatgttctcactcatagatgggaattgaacaatgagaacacatggacacaggaaggggaacatcacactctggggactgttgtggggtggggggaggggggagggatagcattaggagatacacctaatgctagatgacgaggtaatgggtgcagcacaccagcatggcacatgtatacatatgtaactaacctgcacattgtgcacatgtaccctaaaacttaaagtataataataatataaaaacttaaaaaaaaaagaaatatcaaacacatttgaaagcagagaggtggtaaatgaacgcttttgccccaccaccccattcagcagcagagccaacatcgttttctctactccacctctgcacctggattattttgaagcaaattccaaataacagtattccctggaccttgcatcttcataacagattgctgttgactcaaaatatctataaaatattttactatttctataaatgattaggattcttcttctcatacacaactacaacatcatcatcacaccaaaaaatgcattaacagtcatttctcaatatcatcaaatatcccgtcagtattcatattttcctaattgacttattaataagttttattttatgttgtaggattttttaatagtttatttgaaccaagatccaaataaaggtcatttcggtctcctaaacctcttttacactactcggtatcacctatgtcttttttttattttgcagttttttctgttgagaaaccagaccatttgtctggtagaatttcccacccgtctgggtttggatgattgcctccatgtggtgttgctaagcatgtccctctgtctcctgaatttcttgggaattgctaggaagttctagaggcattgttttgtttgctttgctttgcctgactgcttcatagttggtgttgtgttgtgtatttccttcaggaggtaatggttggtggcatctctttttgcagtgagactgtcatctgaattcataaatttatcagggattgcaaatagtggtagtctaattctattattatttgttcatttgttagcaggaattattgttcatgaagagaaactccttgcatctgtaatttatctacccggtgcttcaggttttgtaggaaaagcaggataatatactagattctgtctatttaccaatttgcacgatacagctagttcacagtgtcaaaccaagtcactgtgttttgaaagcatgactgtaaattcatagattgcagcatatctgttgtgtttcagtccatgacagtgattaccctttttcatgttcagatggtcccctgtctgagcattgggatcctattcagtttggctactgagtccttttaatccaatactggctgtctttgatagttttcttgctttctagtataacactatgttccaggctcatcttgtacatttcttgccttagctctgggatcagcttttttccaaggagacctggtttctttcagtgagaaatgatatttggagaccaaagactgggccccaggggaactgttctcactgggttgaatattgtttttcctttccagtggacacagccagtgataggaaatctgtgtctctctagatatagatatagatcgattgtgtgtactttttttttttttttttgagacggagcctcgctctgtcgcccaggctggaatgcagtggcgcaatctcggctcactgcaagctccacctcccaggttcacgccattctcctgcctcagcctcccgagtagctgggactacaggcgcccgccaccacgcctggctaatcttttctgtttttagtagagacggggtttcactgtgttagccaggatggtctcgatctcctgaccttgtgatcggccctccttggcctcccaaagtgctgggattacaggcatgagccatcgtgcctggccgtgtgtacgtattttttaaggtaaaatacctcatgagtttatactgatgtgccacaaggcttttacttaacttcattcattttacatcagtattttctttctctcaaactgaaaatagcagttctcactcacaccaacacaatttactcatttactttctcccacactacacttgcaataatttccgaacaaaaatgccagtgacattgcaacaatatgcttactgaaaatgtttaaggttttttttattttgattgtttagttttgtattggtttttagtccactgggctagagatggacaattacattacaatatgttagggtcatttggaatagttacagtctgtgtgtttatgccaataactggatatacatttgagttcacttactttaatttgagacttcctaagaggcttttgaaaagtgattcttgttcaataattatataaaaatatttaaattttcctgaaacaaaacccacaaaacaaggtgaagtcgttgaagtctgtctttcatgcctgtctgctttattttctcctttttaccatttttaggcatatctttcatttttattataagcaatcatactatttaggtaggtttttttttttttttttttttttttgctccaatagatttatttatttatttagagacagggtctcactttgtcacccaggctggagtacagtggtacagtcttggctcactgcagccttgaactcttaggcttaagcaatccttctgcctcagccccccaagtagctgggactacaggtgtgccccaccatgcccgctattttttttgtttgtttgtttttccagaccaagccttgctctgtcacccgggctggagagcagtggcaccatcttggctcactgcagcctcaccctcctgggtttaagcaattctcgtgcctcagcctcctgagtagatgggattacaggtgtgcgccaccacgaccaggtaatttttggatttttggtagagacggggttttgccatgttggccaggctagtctcaagttcctggcctcaagtgatccacccgccttggcctcccaaagtgttgggattacaggtgtgagccaccatgcccagccttccagtaaaaatgtttagaataattccttaatatggtacccttcttatcccccaaacttttcttagctgttgtttattggtttccaactctgagtgattttgaaattcttagtaccctttctttcttattttcttctctggctataatttgatttaaggtaatatccttttactcccacttaacatctatgttagtgagattattttcgttcctttcatattcttcccgcgtgtttttttttaatcattatactatctatattgtcagggcacatagtcattatatcgttctggctatatgtaatattgtttccttgtaatcatctttcagtaacagacctacagctgattatgtgttaaatgctcacccagtctttgtatcagtgcctttccagccagactggttgcctgactcttctcccttgcagattactaagggtttctgcgaacaatattccttgggtccttgcatattcataacagattgttgttggctggaagatcattttggctgggtataagatccttggcttagttgtctttcctgagtgtcacgctactgacttttagcatgaagcctggctcttgaaaaatcgggtgacactctaattttctgtcccttataggtaactcagtcattttacctgagtgtccaaagaatttttttttgttttctttcctaggtcagtttttccaggtgcatggagtattctgtcaatatatagtttcaaatctttttctacttctagaatttgtgcttcagtcacgattttaagcatttgctgtttttattgcttttcttcttcaaaggctcttattacagtgttatgttgggttttctttgctcatgttccttttctgagtctttctcttgaattctatttctttcctcatttctttttgatgtttaacactttctcctttctattttttagcactcctcaaagattatctgttgtatgtattccctcttgtgttccttcttatttggtcttcatctagaaaatggattttcttttttcgttttcttcaaattctttcccacgttcttttgcctctctctatccaactatttcttttctccaatcacttcatttctgaatgtttttattgggattagtgttcctttatctcttcttactgcctcattttcttttagctcttttgaaatattaaagttttcatctgttttgggggcatgtctctgtggtaagaatgctactctgatttttcttcttataataactgtgcactgtatttgaccacaatcctattttgttactcatttttaagtggaatgagttttcttgtatttttagggataagggatgggccagaaaatattttctagtgtctaggccatagaactccgtcttctgttgtttccatggaataaaataaggcctatattttcttagcttcgtcttctctgcctcccttcacttggatctgccccctcccttcactttggctaaattattactgccatgttcgatttagattctgctctcaaaagtttcttctcaaggtgatttggtcgtggaaggaagcttagatttgttggtctcaagagtgccctggctccgtaacacctaagcacctcagaccttcccagggttccttgccctcaccccatgaattggattctgcaggaccccttgccaatgatgctgctgtgctcaaaatagctcaccaccctgctgaccgtgccgtaaggacctttggaagcttgggagcccgttgtgccaaaaccttcagatgcccactgcctctcctccaactttctcttgcacagatattgcttctgcctggctctgtcactataaatggttcggccacacccattcctgtcttcaggtttatggactacacagtaacctcattttgtcttgatgtggtccatgggtttttggctgtgtaattccaatttctctgtttttgttgttatcattgctattgttactggcagggaggaggagggcagggattctgaaaaatttttttaaactgtgctacctttgacactggtgccatcatcttccctgaattcccgctttaattttttcttttcttttcttttttttttttaagacagggtctcactctgtttcccaggttggagtgcagtggtgctattttggctcactgcaacctctggctcctgggttcaagcaatcatcccaccttagcctcccaagtagctgggactaaaggtgtatgtatgtattccctcttgtgttccttcttatttggtcttcatctagaaaatggttttttttttttcttttacttcaaattctttcccacgttcttttgcctctctctatccaactatttgttttctccaatcacttcatttctgaatgtttttattgggattagtgttcctttatctcttcttacttcctcattttcttttagctcttttgaaatatcaaagttttcatctgttttgggggcatgtctctgtggtaagaatgtgccaccacgcctggctaattttttgtatttttggtagagatggggttttgccatgttgcccaggctggagactcctgggttcaagcgatccacccatttagacctcccaaagtgctgggattacaggcatgagccaccgcacctggccccacttcaatttttttttttttttgagacgaagtcttgctcttgtcccccaggctggagtgcaatggcaccgtctcagctcactgcaacctccgcctcccgggttcaagtgattctcctgcctcagcctcccgagtagctgggattacaggtgcctaccatcacacccacctaatttttgtatttttggtaaagatggggtttcaccatgttgcccaggctggtctcgaacttccgacctcagatgatctgcccacttcagcctcccaaaagtgctgggattacaggcgtgagccactgtgcctggccccactttaattttttaatagtgcttgagaagatgtttctgctaaatactatgcctctggattaaacctcaaatacttcaaaatgaaaagtttgatttcggtcacagatttttagtaaatactttttagggacaagaaaactacaaagtgctttgaaaaacaaaacaagctcaattttttatttgtttaacatatgtagaaaataaaattaatacacgtatcttttccaaattaacacagtatgaaaccaaccactactaattcatcaaaagacacaatttagatcaagtttaggcttggttaggacgctggacgctgagtaaatggtagctctgaggctgaaaaaaaacccctgagtcactctggtacacattctgatgtcagcatccccaccccaccccaacccttattcccgccccgcccccggccccgccccccccccccccccccccccgcgaaaagaagtctctagctctgaaaattggcttgttataactttacaaatgtagttgccaaattgccattgacatcacatttttctttttggcttttagtagctagatagtaatactataaaggaactctctgctttttctattttgtcctttttaaattcttggaggcccttcataacatggaacacaggatgggcaaacgtgcttcttatagtgtaggttagatttagcaccttttgacaaagggccttgtttcctgtgcagtttaaatttagatccactgagaatctgagaaattcagtaatgaaagggtaactttggagtttcctcttttggaagctttccttattaaattctattaatgactctgttagacttgattcccatcttacacaagagattccagaatagcaacttgaattgcttcttagtccctcttacgaagtcactccttcatttggcattgatcgagtacctcccgtgtactggctgacggggcttatatacagagccactaccttatttttcattctgttattttaagagtttcttgatagtccatctacttaagaagtgttgctattaaatttcagtctatctcataaatattattctgagatcctcctggctggatttataggtataaatcattcttggataaaatatacaatataaacagtaagtggaccagttatctgattatacgtgctctgagtctacagaaagacaatatcttggtatgtttcaggagacttgtagagatgaggtgtaggacttctcatttctaattaaaactaattaaaatttactgtctacaagggagatggattgaacatcacctttacctttctcttgacagcaatgaaacctgactcaaagctggcactaaatgtattatttcagtatctgtgtcctattatgtgttgtaatattttggattaaaaaatggagaaaaaataaacaagaaatttttatttctgctaaaaagtcaacagagtccattgttatctttctttgcttttcagatggcagaaattgggtgtcaggtcctataacacaggggttcccaacccctgggccatggaccattatgggtctgtggcctgttaggaactgggtggcacaccagtaggtgagaggcaggcgagccggcattagccagctcagccagcctaagctccacctcctgtcagatcagtggcagcattagattctttctcataggaaagtgaaccgtactgtgaactgcacatgtgagggatctaggttgtaccttccttatgagaatctaatgcctgatccccctacccctagcctcatggaccagtgccaaaaagtttggggaccactgccataagaagtcccgaccagaagtgtcacatctttctattgcatgatgctgcttcttgaacacccatagtagccaaggccagaattagtgtggcaccctcttccccagacaaggtccatggacagtgcatttcaaaatacaggaagctctccttacactctctgctacctagcttccatggttatcaagtaattatactttatgctgagccaacttatgcatttaggaagagatgaagagaaattatatcctcaaatgggctggaacaaaagggaataccaataatttgtaagttaatcaaattataattaaagcaggaagagacacaaggagcttggattatctatgttttctgttagaaaataatacaacaaaagtatccagggagtcttatcagttctgtaggaatttggcagaacagtaaggttataagttgtccttttaattcccagccacctctggcctctgcttaccatggccctgccttctgacttgctgtttgctcagctccttagtgcatgggaagagcagaaacatcaggggaagagcgctgagatctgctgtgcacctgtgccgcacagcccttcccatgtagacatgtgtagcttttgggtttgccagtggatggaacttatccgcatcaagtagccttccacgggggtggtgctgatacgcactcccacccacagccgatacagcctaatcacaagtggaacaatcagagtggaaagtagcggaaagtagcagcctctggtttccaaatgtgagagagcctcagggctcagtcctcaaacctggtctgttttttgttgatgccttcaaaccatctcaaaactgacaccttctccagcctgggccttttctttgaacctcaggcttgcatatcccactgtctcttaactgccttcagtgggatgaactcttgatattctaccccaacctgcttctcccactgccttcccatctccttccagttactcaggccacagttgttgacgttgtccttgatgcctctttttctcctacacaattctgctggtccacggtgccaccatctcttggctggagttcatcagtaacctcctgagtagtctctctgcttcttctcagaatatctcctccatgcaacagccagcatgaactggtgaaaatgtagtccagaccctgtacctcctctgatcaaaaccctccagtgcctctcagctcactcagagtaaggacctcagactttattgtggctcaaagaacttgtcacccccaccctctgacttcatttcctgctccccaccccctttactcagtgccaggaacaccacctcgatggtgttcctccaacacaccacacaggagcccaccccaggaccttggtaccttctgttctttctgtcaggaaggctcttcccccagtcaccacattgctttctatttccctttcttcaggcttttccccaaaagttactgtctctgtgaggtcttttttgactgacaagcttgaaaaaatggtcaccagaccaccaccctagcccccttttctgcttaactttttagcatctatcaccatttaatggaaaatacttcattataaatcttttatttccatgaggataggtaattatttgttgttgggggtgtctttgtcagcatctagtacagtgcctggcagatggatgctcaataaatattgatttaatgggttatgagggtgttaatataaaattagcatttattcagcaactactatgagtcagccactgggctaagtggcttacatgttaagaacctcacagaaggccaggtgtggtggctcacgcctgtaatcccagcactttgggaggctgaagcaggcagatcacctgaggtcaggagtttgagtccaggctggccaacgtggtgaaaccccatctctactaaaaatacaaaaattagccagttgtggtggcaggcgcctgtagtcccagccactcaggaggctaaggcaggagaatagctggaacccgggaggtggagattgcagtgagccaagattgcaccactgcactccagcctgggtgacagagtgagactctgtctccaaaaaaaaaagaaaaagaaaaagaacctcacagcaacctagtaggtgagcactgttactcttgttttacaggtgagaaaattgagccctagagaaataaagtaacttgcttcaggtctcatggttaaggggaacctgggccctaacagtccacttcctgtaccttcaaccacggctctaccgcctccgctaggagatggcccgaggacattccttagctggcttcagcttgctctttttcccctgcggtccacccctgtctcctgcttggtcatcagtgatttccatgccatcccatgtcattggaccagttgtgtgtttttaataggagttctcatctcactttctccacagctttgccaattctgctctccccctcctgtctaaataccttcctcccttggcttcctgaacaccactgtcttcgggtgccatcatccctttctggcccctccttcctaagtcttcaggtgttccctttctacctgctttctacgcctctaagtgttggagttcctcatggcttagtctctagaccactttgcttctccacttaagtgttctgctagatgatctcatccaaactcacagtgccttgatggatccatgactcctgcatccatgtttctaggccagacctctcatcatcttcgggcctgtgtctccagctacctactctgcacctcctttggggtatcacaatgtcacctgaactcagcacgttcaaagtcaaagttataacaatcaccatcccaccaaacctcatctacccaagaattccccatctcagccattggcatcatctagttacccaagacagatgcctaaaagtcctccttgaagcatttctgtccctcttcctctgcatctaatgtgtcaccaagtcctactgatgcaatctcctcagtgtctttcgaatgcactctctctcttccggcccactatcaccattctagtcctaaaacctaccttctttctaggagccacagcttctctggagtttttacacctcttccaactgttcccatcaccccgttcttttctttgacaacattttttacatataaaaataggtatttatgtgattatatcatgaatgtcttttctccccaactaagaagcactatgagagcagggagcttcctgtttctccccgttcaatcctcagctcctagcagcacagtgcctggtgtatagcagattctccatcagtatttgatttgttgagtgaaaaacttagatgtattaaatgacaaactgagatcaagggagaatgaagaatcaatcagaagcagatagaaaattatgctgtgtggtatggcaacatcatgaatggactgttaccgataatacacactgagtcatcaaagaaacattaacatgtattctctattttaaaagggaggtacataaatatagaaccaaataaacagatctcaggaacatttccattcagtaagcaaagttttagaagggaaagagaaattaagttcacatcatttcccaataacacagatgaatgttttccatccaattctgaggacaaagatagcacctcctcgcccatccatgccaacggaggctgaggtagcacagataattgaaattacagtgaagaaggaaaggggttgattgatttgcatgccatctcttttctttaatagtggaggaattgccaaaaaaggctaaaaatgggcaacaggaaaagggagaaacagtaagaatcttggataatcttccactagataattaagacttaactgggtctgttttgatgtgtgcacatgtttctgtacatggagaaggatgaacccacaaatattataaatgccaatttccgaaggcttttggaaaatgtaacccatagcatatggtgtcaaattaatttggggttttacttgtttcagtctgatttgggcacattgaattatgagataatagtttggcatccatgtttgctgagtgcttgttgtaagtttctcaatttcacaaaaattctctgaggttagaggacgcgtcgtgaccctcgtttggcaggtgaggaggtagcggcacagagccgatccgtggctcgcctgagctccggcaggaactcctgggcggagctgctgagacccaggtctgcagactgtcactctggcttcactatttctggccttcctttgagcacttttcttacttttgttctgtttcatgcacttaatgcacctgtttcatcatgctgcctgtcacagttaaaggaatttaaaacagaatggatcgtatttgacagtaaggagctgtacagctgaattccatcaagacaatgtgcttgtagccccaacggcattaaaactttcaaatgatgctttatcacaacttcctctgggctgcacgtgacaaaggggtgcttaaccaggagggacatctctctttgcttgtaggggcaggttgctgttttttgcccacctctaaaatctccttggagcactcagttcttcttatcctccttaaagccaacaactataaaatttaatttaatgttgaacagctgtttctgttgcggtccaggtgaaatttgaggtatcagctaattgtgctaaagttcccaaaaagaagtattcagaaggtgtggatcaccaattacctcttggcagagctgtgaactaataactagtagcagtagataatgtactcagatgccacatgaaatgcaaaagattctatgctttattccataaagcatggctataggacattgtctactatgtaactaatatttaaatatttatagatttttaaaagatttcttcaaccttcttttctcaccctgtttctagatctgatgcacaaaggaaaataataatacaaaacccataacctattcattgtattgttgcggtagatcgagctacatgctgcacagcaaaagaccttctttgcacttctttcaagcagaattattgctgtatattcactctgaactgagaggtgaggattgaactgtgtagtgcctcagaaaatatcaagagttttaaaacattagttttgagagattgaaatacatagaaacttggaatgtttgaatgtcagcccagacattggcaggcttccatgcagatttcattgtgagtaaaatgtgtactcagtggctgggttcaagcccttcatagtttataagcaaatgtctctgcttcttctagatcattgcaaaaaaaaaaaagaagaagaagaagagaagaaaagaaaaaagaaataggttaagcaaattttgtggtggtgcttatgtgtgcacagacatgcatgaggcctccgcatcttccaaacttggaaagcatattttaacagcacaaatatatctacatgtttgatctacatcagagcctctttttttccctcttccttgcatgcttttaaattatatagtttaaatgttttaactattaaatctgtttggtcttcaagctgtaaacatcacacacagctaataagctttaggaaagaaaaggaaattgacatttagtatagaggttctacaaaaccaatgaaaaccatgcaaatgagctatggaacagagagatttgcatatcctcgttgatttcatgatgatattctcagcatgagcctggcagccttgcctttttacctcttgggatgatgcatgtactggtggtagagccctgcagggtcaatttaacgagtgtaacattgtgattttccatgcggtttctcagaaccactgagcaaaatgcagcaataaccagtgacagaggaaatcgatttttgaagtaaatacttttggaggaggggaagaaggtacattcccttcatatttaatgttgccaaagtaggttgaacaagtttttatattagtaccatttggtatttcaaaataaatagattatccaccatttccatcactctctggataccctcacatgtttaccaccaaaactcctgcgcagagactggtcctcttttgcaaactgcctttggctcccccgcgatctctcatcagaaaagcaggctaaggaatctgcttttgcccccatcctgttagaatgataaatagtagcctgatggccaagttgtatatttatttaatacatcgtctgtattgatagtttatgatgtcctggatatgaatacacgaaagcacagttgcatagtggcgaagaaggattttgatatcgtggagatctggatttgaactcaactctggcagttctccctgccttagtttcttgcccgtaaatgggggtgatgaggtagttgtgagaattaaatgagagactatgcaaattgttataatactccctggaaaatagttaaatacccaatagatagcatcactattttgaaatgctttcaaaattatactcgagttttacttctgcaaaatcaaggcagctttcttcagaaaagagagaaatgaacttcacccctaaaatgtacttggagaattttagagggtcttttccaagttgttataaagcacttctgaagtgaatttgcccatttctgcccacaccaatcttataacattccaggaataaaatctgcactcgagtttaaaaataaaacgggtggaacaaactgaattagaagtccttggcagacatcccccccagcagaatgttctctcaattggtggtattgcaataaaagagatgtatattttttagtctgctcttcctccctgataatttcagccagttgtatttctctattctaaaaacctggtatgcttggatttaatctcaccactcctatctacgctcctgctcctacccccacacccatttcccccaaaaaaaccccacatctgcacagaccctccttcccaagaaaacatggaggcgggctgctctctgataccgtacatgtgcattccggactgtgctgaggaaggtcatagaaacatgagagggctctgctgttgtcagttgtaaagactgccaagaaagaacaacaaaaaaatctcaaatgcattcacatttctcccgcctcttttttcttctgtaaatattcaaccctttttagagaggcttttgataatgtgttatctcagcaaacaccacgaaccttggatgtacgcagtactccctaatcccataggaatgactcagtcaagagagttagatgaaatatggttggcaagattgggtggggaatcttgttactacacacacatacacacacacacacacgcgcacacacacacacacaccagcagcaccagccactgcacccctatcatcgccatagacattatgtaaaaactagacattctcctctcccttacacagtcagttgcatctttcccaaaaatggaaggggaaaaagctttctttggctgagccatatgcaaaaaatcatggaacatctgtgtaagtaacaacatacaacaagacaaattattggtggtaaaaggcaaagcccttgtttcaaaaacatgtctggaaatagtgtgtatacagaaccttcctttgtgctaattactcataataactgtcagctttgtgtaccacaggctgggctgttaataactagtggtcgcagtacggtgttctttttctttccctttctttttttttttttcctatccttccttccctctttcctgccttcttttcattgttgttgcacaaatcatatagccttattccaatagttgctggaagaccaaatcagagatgtgggggattcagggactcgcgacatcttggagtatactagtggataaatgccacttcacccctgatgtggccgtttccctccaacacttgtctaaggagtgcagggactttggggtccaagcaatgtatcagtaaacttcagaatttttttcctaacatttaactctattctcagtctcaacacccgccacaaaaataatgtcactccaggcaaatttagtcgcttacggattctgagtcttattgtgattttgcctgagtggcaagcttttcaggcacgtgtacttaaaaatgtgatgtggtagaatttgcctccagctaggaatccacagacttgggtttgagctccacgtcccacagtcaccacgtgatcttcagaaaagaatcactgaactgcctgtgcctccatgcccccgtttgtcaagagggaggtggtaatacctgctgcggtttttatgtggatcgaatgggcctaaaactcatagaaacacagaatgcttctatgataagagaaaactccagccaggctcagtggctcacacctgtaatctcagcattttgggaggccgagatgggtggatcacctgaggccaggagtttgagaccagcctggccaacatggcaaaaccctatctctactaaaaatacaaaaattagccaggcgtggtggtgggcacctgtaatcccagctacttgggaggctaaggcatgagaatcacttgaacctgggaggcggaggttgcagtcagctgagatcgtaccactgcactccagcctggaggagactctttctcaaaaaaaaaaaaaaaaaacgaacaaaaaatactctgatgctattgctactggttgtttttttttttaatgctaaaaggactccaaacatcctgttatcacccactgtcaaatttctgcatatattttgcagtgccagtgagaaacttggggtctctacagtcagtaaggaaaaaggagtttgaaagaactaagggatctctgtctatggggaagaaatagtagggcagagaatttaaatttagggttcttaggaaatgatgcaccagggccaccgcacagccctcatgtctcctctcttcagtgtcctctctgcctccatcacctagtgaggagggaacaggtgcaggaacaggtcgccagggtgtccagcaggtgacctcccacccccctaccctcgccgcccccactgctccactggcagcctatgtcccaaccaaaccttacttcacattgtaattctaatgttctgtgcgtgttcatcgccatatttccctccatctgacccagcccgtcaaaatccttcctctacttcagggcccagctcccatcccctcttccgcaaagccttctaaccgcaaacccattaacctctccccacttggggcttctgagtccctttattatttatggttaggagaaagcatcacgtcggtctggtgatgtgtagtgagttgtgtgaatgtgttagcagagcagggtggccctgcatgtgatggttgggtgttagctggagtgagccagcctgggttcaaatctccctctggcatcagcttgtgctgtaattggggtaagtgctgaaactctccctgtctcctttcctcatttgcaaacttggcttaataatgatagctacctcaaaaagttgttgtgataattaaatgaatgtcaagctcttggaacagtgcaagcgcttaagaaatattatgttggtgcaaaagtaattgtgattttgccattactttcaatggcaaaaaccacaattacttttgcaccaacccagtatttgctattactagtcctggtcagctgagcatggtggctcatgtctataatctcaacactttgggaggccgaggcaggtggatcgcctgaggtcaggagtttgagaccagcctggccaacatggtgaaaccccgtcgcaactaaaaacacaaaaatgtgctgggcatggtggtgagcgcctgtaatccctactactccagaggctgaggcaggagaatcacttgaacctgggagccagaggttgcagtgagccgagattgccccattgcactccagcctgggtgacaagagcaaaactacatctcagaaaaaaaaaaaaaaaggcctggtctaccagagacaagaggccatgtcttgtccatgaaagccttgcaaccatattttacagatagaaaagacccagtccatgaacattaaagtcagtatcaggtacatttatcaacataaaatctgttcctttgaatcagctcaataataaaagagtgcagctgagcaccccctcccacagccccatgcctctagtcactgaaaatctgtgaggaatttttatagagtgtttcagaacagagcatttcaagacaaccctagagccctatggaatacattttcaatcatctttctgcgtctgctttcttttttgggtgcacacagcagacactggtgatgaggcatgtgcctgtgtgcactgttgttttatagaagctgaatgaaagcctgggagttgtatctgcctgaaaacttccatcctggcttctagagctcaacacctgaaacgctggaggcagttgaggtcactttgaaaacggaacccttgatgttctgctcaaactttagaggcatttacaacaaatcaggcaaatgaaagtgtggaaaaatcagaaacgaggaccactctgtcttagggattttgtcattgtatcgtgtgtgtgtttatgaatgtgagtgtgtgtcacatgtgagtgcatttaaccttcatgcaataagagagtagttttccacttagaaccagccaactctctataaaatttacctccgtgattctaattttgctccctccgccgtgggcaagttggcaatgtctgaatgtctgaagtcatttttgcttgtcacgactggggaggagctaccagcatctagtgagtagaagtgaggaatgctgctaaacatcctgcaacacacaggacagcccccaccacaaagaatcatccagcacaagatgtcaacagtgccaaggctgagaaaccctggtttaccttaaccttaaaagaacaattcgaatgcttgggaagggatgtctgccacatctgtactggagagaagcatggcccccagtcaaggacatggagagttccatgtctggatctagaccgtgtccatccacaaagatgcctcctgctcttctccgacatacaatctggtccatgagaatagactttattggtgagggggcggggctttaggtgagcggcattgaagggcttgttctgagcttggcctctgctggcagattattttctggccactttaatctcgatcctgcctctacttggtctttttttttttttctttcccccagtttttggatcttatagttccacaggacaagatacatctaagagatgggggaaaaggttaaagcagcaaggggatgctggatagagggggagggaaacaagaaaggaaaaaacaagacagagagacagagatagacagagatgtacaaatgggggctgcttggttaaagtgtcctggagttttcagcaagagattttgctgccagtgtctctccatccttctctctgcctctctctctctctctcacacacacacacatacagacacacacacacacacactcggccccaccaccacacacaggccaggtggctctgcttacatacatggcttggcgcttttactccttggctaagaccatttcacacatgaacaacacagcctcctcctagagatttgtcatccatctgcttgcagaagagctgtctgtttccctctgaaaattggtccaatcaacattttcctttggccagggtagcttaccagcagctcctccataaggtccataattgcaatttctcattctcatttgcctggctggcttcacccttctgtcctctctgcaccttcccacaagtgccccaccctccccaccagccctctcctccttttgtgttaataagccctgtcaaaatgaatgacagaatcaacttccttctcccaaaatggctcattactcataaatttcaagcaatattgccttctgtcctcaaaaggtttgcagatttttttcccccaactgatcccctttccagagtgaaatagcggatgaatgccttgcctagcaccctctctaagctctgcctctgtggcagtattgtgggccaatatgccaacgagtctttccttgtgatctgctccagcctgtcttgtgccatatgcttgtggcagacagtggttaatatcagtctgtgagcatcttgaggctagctttgaagtctaattctaatgtcatcatgcttatagggtgcacactttgtttgttctggaacagagggtcatctgctacgggatgtggaacactgaccctgatattgcagccgtgtttgtggttgagtgagggagcaggtgatgggcataggagggaaccaagccctgagccgtgtttcagggatgctcggtcccatcccctttctcccagatgacttcttattcttaaattttgaatagtgagtaacacaagcaggaggtgggatagcatgagaacttaggaaatcttcccatctctttgttacttacaagataaatgtctatactgaagctttagggacccagattacaactgaattgttttataaatgcgtctgaaatctgctgttttgaaggacaaagtaatacctgaagaatgattaagaaggcttagagaatccgcaggctccaaggtgtgtgaataatacctttccatggttcactaccaggtgatctggacctacagccagtcttctgtgtttcagtatattatgttgggagcattcccagacagttaatgcgtaaaatgctattcaaattctcctttaccgaaaggcattttaaagtaatacacgtgggtgaggaatacaagtgcctggtgggatacttttggtaaacaacgtggcacagtgggatggagtagggtctactttttcccaaatgtgaagttagtagctacagaggggtcctgagacagaaagcatttgtaaatattaatttgtgctctgtttcacagaatctgaaatcaggcatctgtgcactttaaaatatgaaagaactaagagatctagtgtttggtagcattttagagggaaaaaaggccatagctcaaatattgctctgatttcagttggctgaatttatgtgtaaagggcatgttagggaatagtctgcaaaggtaccagaaactgccattcatggaaggccctgagtgcaaaatgcagcagtcagtagttctgacccatgccattagatggttctggaaggtcctcagaggagacgcaacaccaacagtgacactgcttccagctcaggcaggctggagctgttctgagtcttcctgaaggttctgaatggtccagcccttggactcccttcagagagtcatggagcacccacatttcctttgcacctgaaacacttctttgtttctgtcttcaccctgactcctcatctattcagagatcccagctgatcctctctttcaaagccaggccagtgagctcttacagaagcttacttcagcattccttccaccgtcttctgagtagcagggcagacagagacagcaatggagaattccagttgattccccataaaatggccactttgttgtggggcatgagctggtctgtacttgtttgtgcctggcagtgcacacactagaaccctgggcaaccctggatgtaaatcaactagatactattattaaatagccgaaggtttgccagtgcagcctggagcaaagagagaggggtaaaatcaggctcccaacagacttccccataggaaacctctcctctgctgtgattttccagatgagctgcgtaaatggctccaaatcaccgaatgtttgtgcacgcaggctccattcatgcgcatgcacacacccggcttgtgtccttcttccctctcgtcccttgaacccgtagctcttgattctgcctgtaggagcaatgatgttgtagcaaccatgacaaaagaaacaaaatcagaaggcagatccaggccgctccctgccacctgccctctgtctaccttagacagatcacttaggcccactgggtcttgataagacatggtcttttcacacctgttcttccagtcttataggattacctggaggatcatgtgatgcgaaggatgtaaaagtgctccaaggggttaaaaggactttatataataaattcctacaaactgctataggcacagccatagctctgaaactagcattctcgtaaggctagtccaatccataagtttcgtttgcttcaagcagctcagatagacactctctgaagataaatgatgcataaaaacaccattgtttgtgatcagaataatcaggtaccactaaatagtcctgcatgtgtatgcatgataccagcagcctccaacttgcttctccaggagcactgtacttaacttggaaacccctttatttaatttctgtccactcacaaagcttcaccttgtcttctctcctctctgtcctcccgaggttaatccttgagagcctgtaatcaaggctaggccctgcccaccttaagtcaccctcccctctctctaggcctccacctcactggggagcgtcattgcagccagtggcaagaagctgcaaaattctctcatctgtgaagagagcccctaaaaccccaaatcccggaccagtagaggaaaccattgctgccctaatatcacatgttacaagtcttcgagcccatggtatctgagatgttaggagctagcattccttgtaattaaacccctggaacatcacaaggacccagttcagggggcttggttggttgactgattgatgacagcatctcaattatgtaggagatttctgtaaagaggagtgactggaaggaaaagaagataaccttcatttatatcatgagaccttgcgtagtagaaggccgtgaggatgggaacaaagtgaaatcatgaaaaacagcctgatgcaaaatgacaaagaagaatttcagggtcgttgagatcacacttgaacaataactgaacagagccagcactacagttttcagacctgatggctaacaagtgaaatgtattcagagagaggtgtgtgattataaagactccccctacccctggtgctctattccactgactgtccctttatgaaaaatgaattctagagttccctttctgaaatttcttacctgaatcagatcagatatgacaattctattttttaaagcaccttactgaaaataaagtgcttttcagtagtaaacctttaagattcctggtttccctctgacttgtgaaaatatgaaagaactgaaattagaccacattggcccaggttgggaaaacagatggcagagataaggcagatcaaagaaacatctctctgtgggtgaaggagttcctggttgtcatgtatccattttttgtagcgttttccctacttgaggaggctgttgtgaagggcaggattcttcactgaatctttattgtaaaaggcataggtgtgtcttgggtggattccagttctcaggttgatttgcttgacaactcttaggaaggaacaattaatactgctgcccctcaactagctagggagatttcactgtggaggtagaagtcggattcactgaggcagaattgccagggcttgagacccttcatgcctctcttttccaagtctctctctccaagaaagggtgaacttttcaagtcaaagagcagggacgtaaataaatgcagttatggctgtcttaggaggatccattcacttaaggcaaaggtcttagaagttacagaagaggagagagaatgggaactactgtggcaccaggatgtctggagaagagaaagtgcgcttactgtgcacagcttcctctccctcacctgcgccacggtgaacccacctatatctttctgctggcaaaaacatttgctcagtgtgtcgccggagtacttgagtgtctgatatttctcaaggcagaatctacctcactgtctctgaaacctcaaaatatgtggccctctcgaaggataacagttggcagcaacctaaggctgttctgctccaacttggaatgaagaggaatatgatttggccattcttcttagcacagaggcaaataaaaaaaaaaacccttatatacttcaaaagatgaagatcttacttcttactggctatctttgcaccaggtcctgggattggcatataataaaaaatgcatatgcagtggccatgaaatgggcttaaaggtcaatcttggctgccagtcgtggctaaactgcattgtattccatgtttttttccatattgcccctgcagtgtacatatacatgcacagtcatggcccctgcacactgtgtacacactcacgcctgcacacatgtatgcatatcaacgcctgcacatgtacttgtatgcacactcacccacacatgtgcatttgtgtgcactcacttctgcacacctatttgcatgcacgctcatctcccacaaatatgtatgcatgcacactcacgccccccccaccctcccgtgtgaaactctgcacctgcttgtctttaccctcacccttgaacctgtgtataacctcataaagtaggaagaagcccagtgttgaactctacagccttttacattcaaaatggttttgaaaaatgcccattcagaggaacaggaaagcaccaaacctaaaaggtctgaggacctttccatgctttctgtctcctaatctcagagctgtaccaatctgttatttaaaaattagtcattatttatccaaggcaggaggggacaaatgtaactgttagttcagtaaatgatttcattcttttttttttcctgtgtcctttctactgttaaagtgacgaaaatgacaccacggtttgatatgtggggttggtttcagtttgaataatctcatccttagctgcatgtgaactcatgtcttctcacactctattagataaaagcctaaaacaggaaggccagaaacaactgtttttaaaaagctcatgctaccctggcaacttaagttggaagaacctaataaataaatacaaagctgcccctctgtcctaatgtacttcttctgaattccagctgggcacctcatggtttcatgcctgaatcacaaaggcgagtgccagtacccagccagagcagttttcctaccataaaccagtaaatgtgtgtgtatcacatgtaagtcagggtcagatggggaaaatcaactacaaaaccgcagagacattatgcaaaattggattacgtacatgttttcagttttgtctcttagcagtttaagtctttaattaaaatacacacgagagagagagacagagagagagagagagaatctgtaactgttagattttataggccccggttatgagataatagccttccaagtaatttttatgggtcattctatctagtggcaacttagactataaagccatctcccagcttcccaaaagtaatgtctgttttctcactttctaataattacttcagatttgaaagtaaggagttgtcacagtgaatacaaattagagtcagcttcagggtattactaaatgtggattgttttgttccgagttttatccattttaggcagagtaacatgatcatttatatacatctgcctctatgcaggctgtgtagacatactcagaacaccagcttcacctcttcagtcttctaagacagtctttctaatactctatattgtctaatagctaagctattgttaaataaaaacacgcaaatgtttgcagttaggctcccccctccattctcaacctcttaagtgatacagacagtaaatgcattttgatgtttatttagaaagttggcatcctgggactgttcacaagatagctaatttgtctgaaggtccccagagacagtgaaagtcatcccaccatctctctagctgccctcataccggggaagtaaaatgcagcatagaacactgcagctcacgttatggagaacagtggtgctatggtgatttcctttctattcaaatcatttagtgaggatttacataatttgcattaacgtgtgactttcgatcacttatgctgcagcagagtattcgttgcctatgttctctaaggcaccagtgtggtggttcatgtgtccttgtataaaagattactgtcctccccatccccagtctttgtatctgtgcaccagaacaaaatgccctcggatcatggccacccaggccagagaatgaggacccacactttaaaaaccctgtagatgataggatgagcggtcctcatccgtcccctccctgagagtgaggttgggttggagtagaaggatggactctgccaaatgatgacagcagccctgagagtccttctcacaggtggccagctctgtcccctccagcctcaccacacattcccctagtacacaaaggcagacccgggcagccactcagcatgcacatgtagcagtgtcccctgtacactggtaccctcaaggcctccctggcacctttgcttgttacgttggctgatttcttcaaagggaaatatgggatgtggtgcagcctggccctcacacactctgaaaatagcactgcccagggccaggccttttcctttgcacactgccatacccaccctggaaagtactccatggttgtatcacaagaaaacagccatttgggcattttaaattactcaaaatattataaaaatatttataaaatatattaatgtatatatttataaaatacaaagagtatatgattaccaggcaaatgagtagacagtgatagaactatcataagaataggattggctattaattataataatgattggaatagataacatttattgaacatgtattatgtgccaagcactgtgctaaaatatttacatgcagcagttcatcaaaagctcatgggaagccatgtgcagtgtcatgcacctgtactcccagctacttgggtggctgaggcaggaggatcacttgagccccagagtttgagcctagcctaggcaacatagcaagaacccatctcaaagaagaaaacaatacaaaaagctcatgacagttgtaagacatatgtaccatcattacccttattcaacagaaaaggaaattggggcttagggtgggtggttaccttacttgtacaaagtcacacagctagtaagtggaggagttggttcaatgaaggataaccagggaagcatctgtgggcatatcgaggcctgaaaataggaacaccttggccaaatttcagaccatgacatcaagcgaatgcttgaaagctaaggaacaaatagaaatatgttgtatcatttataacaaattgttaccattaacacctacaattattagcgttaggagtattgcggtgggaattgaacaatgagaacacatggacacaggaaggggaacatcacactctggggactgttgtggggtggggggaggggggaggggggagggacagcattaggagatatacctaatgctaaatgacgagttaatgggtgcagcacaccagcatggcacatgtatacatatgcaactaacctgcacattgtgcacatgtaacctaaaacttaaagtataataataataaaataaaataaaaaaaaggagtattgcatggtcagactgttcagatctcatgaatgctccctgcttctctattccttctttgatttgacatgtgccaggccatgtattccagtggatttctgtactttctactttattccaaaggctaagcattcctgaaagccacagagggagttgatgtgcttaaggaaagaagtatcgcttaatgtggccaaaaaccgattccatttctgtacaaatgcaaggagtttttgccaggagccagggattaatagtctagaggaagggactaattgtacacaggaacaatatttacttttataatgggaatagtttgagacagtgcatcttctagacacaaacattcagtaggaagggttatgcattaattctttcatttaatgagcattttaagcacctattatgtgccaaatatcttttcgtagctctacaacagtgttcacttctcaatcttttgctacaccagagcgttgggaccatgctcccattaatcaccctgtctcaaacaacatgctttaccttcattcgttgatttactcatccattccttctcatagtttttaacctcaagagctctgaggttcagggtggaataatatggagggcctttgagaggctaacttttgaaccaaatcttcgaggatgaactagggtagtggcaggtagaaaactgcctttatatttagccttctttggtacctggtcatggatttcttcttcaagcatgaatggcatcagttgtctgggagtgagatacagtgttcgtatgctgagaaacagattaggccattaaaaaaaaagttgtggccacgtgtggtggctcacgcctatagtcccagcactttgggaggccgaggcagggggatcacgaggtcaggagatcgagaccatcctggctaatatggcgaaaccccgtctctagtaaatatacaaaaaattagccaggtatggtggtgggcgcctgtagtcctagctactcgggaggctgaggcaggacaatcgcttgaacctgggaggcggagcttgcagtgagccgagatcgtgccactgctctccagcctgggtgacagagcaagactccgtctcaagaaaaaaaaaaaataagaaacttgtaactccctctctctacttgatgaagtagacatcaggaaagactttcttattctgctttccattaaaagccataacttggaaattattattgattgggcttggtgtggtggcttgcgcctgtaatcccagtgacttgggaggctgaggcaggaggattgcctaaggtcagaagttaaagaccagcctgggcaacatagtgagaccctgtctcaaaagaaaatttttttttaagtagcctagcatggtgatgcatacctgtagtcccaggtactggggaagctgaggtgggagaatcacttgagcccagcagttcaaggctgcagtgatctatgattacaccactgccctccagcctcggcaacagagcaaaacctcatctctaaaaaataaataaaataatatcttaggggaagttgacaaaacattagaaatattgtagggttaggtgcctgttgagccccaggatttattccattattcactcatatcttcatgtatccattcaataaatacttattaaaagcctacaccatgcaagataaaagccacattctactgagtatgcaatgatacacggtatggggtttctgctttatggaaactaaaggcctactagaggaattcaggaattccagtgtgtaccagctcggctgtaacacagtgaggaagagataggaaccatgaactaagcggtgaaaatgtgatgggattcagaggggtcagaggtattggatacagtgagattattttaaacgtttagggtgtacgagcaagatgagtaggagatttctttaggaaacatctccctatgaaataaaagtttatataaaaggaataataattacagttgatatttatgaatacttaatctgggccagggactatacttagtacttttcatgcattgtctgattaggtcctcacaacagccctgtaaggcaggtattgtactttcttatattttatagtttgcactattgtgtgctccatggttatagcaaaagctttgtctgtaaaaggccacagggatagaaggcagagaggaaagtagatgtgtgatgcagtattaattattgagccaataaaatctctctaatttagattttttaggaggaagtcattttacattttacattaatttaatctatattgagagatccttctaagaaaataagttgcattacttcaagtatacatagccatataaattattgaccaattttttttttccaattcatagacattactttccagaaactagataatgaccatttgttatcagcacactgactgcaaaatggatgatgaagaaagcctgggttttttttttttttttttgaaagcttggtagttcttcttgtgaataaattaaacactttcctgacgatcctgtttgcattattgacttatatgtactggctcatatgtagctgcccatgtataattctccccactcattctgaagggagggaaaaaaacgattaaaaatttcccctccttctttttcctgttttgagattatttttgctcccagcagaggcgcggaggagggagctctcagagccccattctgttccctacctacagcatgaaggatccagataaccgcagaatgaatgaggtttgagcatttgtttttgctataagtaagatggtttcccattaataaaagtggcactcagtttactttgtcttcgccagacaggcaaagggtaaattaaggtggttacctgtggtgtcccagctctttcccaaggctggactagtgtgagccgagaaccaggcaggactcactcacaggtccctttctctgctacttctgctctggttttatgcgaagccctatttcccagctgcttcgggtaaacaaggacttctgtgttgaaataataaccacttgggctgggcgcggtggctcacgcctgtaatcccagcactttgggaggccaaggagggtggagcatctgaggtcaggagttcgagaccatcctggccaacatggccaaaccccatctctcctaaaaatacaaaaaattagccgggcatggtggcaggtgccgtagttccagctactcgggaggctgaggcaggagaatctcttgaacccaggaggcagaggttgcagtgagccgagatcgcaccatttcactccagtctgggcgacagagtgagaccctgtctcaaaaaaaccaaaaacaaacaaacaaaaaaaccacttattgtttcactgcctaatattaattaattggccaaatttctattttattatattccatatattttaaaataatttcttcttctgttgtacaaaccaagatagaagataatttgcccaagaacacaattggtaggtatcctagctaggaaagtgggtgcttctgaaaattataaaaatgaaatgaggtaattttctgggcccttggtacaatgcctgagatgtcatatatactcagctaattataagtgacattttgttctagaatccagtagctcaacttttagtccattgtgctgaacacaaatctatagatccttaaattgtatacttttattaatttaattttaaagagccagaaaaattgactacattggaaacattccagtccaccaacatattgagtagaaagaaggacaaaggccatattctctttcagatgctacaaattgtgtatattttcagtaagctgtgtctgcttaaggaggcattactgcattcggatagataaactcaaataaaaaggcctgagtgaagaggctctactgggtttagcgtttttttgttgttgttgttcagttttgcatgtgtgtttttaaatcagtttatggttcataagctgatgaagcagtgagtacaagtttgaactatgagaagcaggtttgaataagtctagacatttggttatcttctgtctagcattcatttgtgtcgtgggcgtcacactctggggattagtgtttcattatgcagaagctgttttatctttagctttcttataatagcttaaagtgaattctgagtggagagagaatgaaggccaggccttagtaactgcaagaatcataccaaaatgggttggatgggttttaacagtgaccgataagcattacgacctcactctctgatagttcagttggctcgatgctgtctcatcacctcatttagggtacaatatgctgaggaactgaccaaaggtccctgaacagtgagagatagggaagagcagaaatccgttcctgtaccaagtgtctaacacttaatataggtgagagctggcgtgagattatctgtgctgtggaaaaatgaggacctatcgatacctctaagtatataatcactgccgtgtcacattttaattagctccttgaggctatagaaagaagttcgcttcttatcctccaaattaagcatcacttttacaaacaatcaatgttccattttcaaaaccccaagtagagcaatgtttgattttccttactttccagctttgagaatgtttcatttttagaaatatgttataggaatgtaaagtaactcttgtttccccaaataaccacctccttattatctgttcccctaagctgaatcctttcaaaggaaattttgtcttcaggctaagtttagtggctgatggaaatcaaaattatatcaggtgggccattgcgtcagtaaaaaagcccagaccaccaccacacaggatttttctccagacacccaaacatcatgtcacaaagctcaaaaaagtagtgattaacatgcagtgctttcaggaggcccacattgccgattcagtcccagtatgggctcgtcagtttcactttcattcattcatttatttatttattcccccacccattgattcacattcactcatccattcattaaacatttgctgcacacaatatcactgttagacagactttcagaaatgattgggttcctgtattacagacatgagcccacggcacaaaggtcaaactaagagtaagatggatgtttatagcacaagcctataacaaaaagaatgggtcccgagccgcatcttcttccaaatgcacaaactatatttgtaccttaaaaaaaaaacaaaaacagtgtttccttttgagaggcagcatggtatatgggaagaacacggatttaagaactagacaggcctgggtttgaattctgcatccataatgtgctaactgtatcatttcgaggaagttcttttgagtttcagtttgtctttaaatagagtcatcatttctactttgtagggttgtgtgaggattaaatataaaatatgcagcataatgactggcacatttaaacgaagtgctcagcaagtgctatttcccttcccctttcttcatttctaacatagtttgggaatggtttaggatgactctttttcttcttgtgaatagatagagacctcatcaccctaacactagaaaactataggacagagaccatacttcttgctgtggccagccctcatccactttgatgatgcttgcagctcccaagagagacaacagcccccacggcatggccaagagaggagcaaactctctccccaaggcagtcactctggggatgccattgttccattgccaaactcatgacctttggggaatttggaaatctactactttgtggggagaaaaggacaaagaaagtcaagattaagctttatatgtaaaggccttttattttaatggtgttgaattgagtttggattttgcgtacccttcaaatttcttagggtgtgggtgagggcatcctaggagatttaattagctccttgagcggcactgaagtttgcgacattgaggcacattttcttctattgtccattgaagtgggggagcctggcaatgaaatttctgagaaactgacgctgttgccgtggatagaattgtatggatatttgaatttagtttagtcacttggtggagttttattttgttgtttggtttcttttggaaagagaaaattagtatagtatgaatctgagcagtctggttacatgctttaatgggcctctgagataaagcagaaaaggatgtagtctagtagtaaccctttagatgataagggacacgcaggaggctgtccaagacagtctgttaatcttaatagtctctcacttgttaagacctgatttatttcaaactaaatttcttgttttgagtttccgggtgaaagttctggactgaatccctaaaaacatgcacaacaaagaagaaggcttttagaaaggtttctcctattgacagggttcatattctatagttcacaattcagtgaatcaacatttatattaatttcatccgttacaacctcagaatttgcctacaagatccaatggcatttttactgcccttatttagcaagcctatacagtacttcatgcacttggtcatgtcttcaactaatatttattgggtgtcttccctaagcaagatagtgcgagagagagagctgagttaaaacattcaagataacctcaagaagctgacaatctactaagggagataagacatacatattaataagaacaacttaaacacaaaggacaagatgatatgtggcatatcttatcaattaaataatgttggacttcagagggtgaaggaattaggcatgaaggtatatctcaacagggctgtgaatgactggaaacaaggtcttctctcttcacactgtgagccagccacatccatactacggtgacattcatttctcccccaggccagctatgggcagaagtttaattatccttgaacgtcttcaatgatcctcatctttgcccttgttccctctttatcctttctttctccccaatgtcttaaatcctgatgcagccagggagattttttttttttaaccttcaagaaggtaaaaaactatgccagggcaaaatgccagatcaatgttgctattaatataatcagatataaactttttccagttggcaccaacaaccctgggccttctctgagtaccacctataaacagggcttcaatttcccatttttgcatacttactaatgtactacagatcttgcactgactttaattcaatatcaatattaaagtcatatgaggtagtagtaaatagagatagccataccttagagtcaataagacataaaattagttatgttattattattattaattatgcataatatgtcattttcctgaagagaacagactaatagctgatttcagcaagcatctttaggcttttgttttcaaattattttacatctttttcttttcttttcttttcttttttttttttttttttttgacacagaggtctcactctgtcacccaggctggagtgccgtggtgtgatctcagctcactgcaacctccgcctcccaggttcaagcaattctcctgcctcagcctcccaagtagctgaaactacaggcatgtgctactacacacggctaatttttgtatttttggtagagacgtggtttcagcatgttggccaggatggtctcaaactcctggcctcaagtgatccgcctgcattggcctcccaaagagctgggattacaggcgtgagccactgtgcctggccacccacctattttccatctttagcactggccgttctcattcaaaatacgtactgctacactaagaggagacttaacttcaaattcactttgctccacggatgttgtatatgacctgaatagatgtaattctgacaagcttgtagttcattggaggctcacaatttgaaagaaatgcatgattaagactttagaacataaagaagattctagtaaaacaaatgattgcacccttttggattttttgcatattatctttatgtagggaagggaatgatatgttagaaagaatcctcaaacaggtttagacaaatcactggttgaaccataatctccaaaatatcgctacatcagaaaaagcccaacatagcctctgaggtattcgtcagaaatcccagtgcaagcattaggaaagaaatgtactccctgctcctcacctttgtaagtcagatttagtcttcactgttcatttcaggttctctgcctccataggggtcccttcagcacttgtttggttctctaattggcttatgatagtgggtcttacatcatcaactggattgtaaattccttcagaaagagatgtcaattaagtacacagcagagtcacagtatttcaaaattggaagtcatagtaagggggaaggagggccgctagatgctgtgattcacacggcgtcatagtaagcaagaggccgaggcagtgccagcacccaggtagggctccggtgccaccctctgcttcatcctctgccaagcctatcacgacggtcgttcagctcatgctctccatgcacgtctggtgatttgatgctcatctttgccagcttcagagcatcactggacacatgcccagtcttgaagggttaattttcaagtaccaagcatgctttggacaaactcaaatctgttccttgttttcgctcaacccgcaaccagcatcatcagcccagacgcagcttccccagaaggccagcaggtggagcacagttttgtggaacttctctagaactcgctgtttaaaagccgcaaaccaagacatgtgaggctgtggggtggggggcaaagaagagccccagattctgcacgtctggaagcttttaaaattgtcttacaacaattttagacctacaaaagccagcttttgaaattgcataaacggcaagtcgagttcttttttttttttttttttgagacctagtcttactctattgcccaggctggaatgcagtggcacgatcttagctcactgtagcctccacctcccaggttcaagctattcccctgcctcagcctcccgagtagctgagactacaggcgtgagccaccacgccaggttaatttttgtatttttagtagagacagtgtttcactatgttggccaggctggtcttgaactcctgaccttaagtgatccacctgcctctgcctcccaaagtgctttgattagaggcatgagccacggtgcctggccagcaagtcaaatttttaattagacttaaaatgttggtgctcataacaactacagttactgtggttttttttttttagtttcataaagaggacagacgctaaggcaattgtgtggaacagagcagcttctcggggtaaccatctcctgctgatgtataaatatcggggcaaaactgagtaagttttagaaaataaatgtcaaagcaagtccgagtcatttattccttagcaggaaatatcgatcctgtgacattatttgattataatgactgtttctattaggttaaatgactgaggtatacttaaccagtttaggtgaagaatgaggctcattgcaccatttgattgactaaaccttagaacccatgtattctttttatttgttcagtcaccaatttttatgaagcacctactgtgtgccaaacaccctcttgggtgccaaggtaagaattaaattttggaattaagcaaagcatgatggctcatccatgtagtcccagctactcagcagactgagacaggaggatcgcttgaacccaggagattgaggctgcagtgagctaagaacatgccactaccctccagcctggatgacagagacctcaactctaaaaaacaggttttttaaaattggaattaaacacacttgggttcaagttctacttcagctacttattagttgtgagaaaataaatgtcaaatgtttttcaatttgcataagttatttaaccacattatccttactttccttatcattaaaaccctgaaaaggttgtaagtgacaaaatacgtgatacacacttagtgcctgtcagatgataggcctgagttactgttaacttttttttttttttttaccatcctcatcatgttcctcattctcatcttcttccagggttctcacttgatgaaggaaagtatttaagacaatacttctttaacatacttaataatggaatggatatagaaatgggagaaatcagtgtgaaagcaggctttggtgaggccactatttaaaataactatagtttatttaaaggagacacgaagtaactgagatttcacaaggccccagacccccttctcgaatgttattatcaactcccgtttctgccctgtgatgtcatgagggttgatgatcggttcttcttttattttgttgccaagtacagcagggatatgtgtcctctctattcctgagtggtgaaagttctcttctgagaccacaaaacatggtggcctcaggttctttatggccccacggtctcttcctgcacccctccccaaggggctgggttggtagatattcctaatgttatatcccctgttgttgacacccccatgcccccaatcccgcatgcctagcagatgcaccttaacccaaccactctgggtcagttccttcctcacacagcaagctgctaagaaggttgaagaattactggacttcagataccacatggcaccattatccctggcaggtttcctgtcactgcctgtttctttttcttccaggaggctcatcaaacaggcctccacacaaacagaacatccatccacttcacaggccacccagacgtatccagagatgcccagatgagacctgatttgcctgggttaaccgtgtgtctgcagctcagaccctccaatggggcttctagctacatagtctaatgatgaaaagctactggcctgggatttaagagcacagctttctagcctaactccacaactgtgcccctgggaattttagtctcctctctgcatttcaacttcaccaactaaataagtaccttttaatatctaattgaattgatatgctatataagcaaaccagatgttgtgagtaaaaccagcttcagcatccaaaagttgatacagatacttttgaggagcatgtttcaacatattccttaggacagccttactatgagaaggtcatctctcagtgatttcaatgtgccattggaagaagagcttctgccatttaaatgtccagttaggcactggtggacacagcagtatccttcccattcattccgaccatattattttgaatcataaaggcatatccttagaggagaacatttaaaaaatttaataatgtatttgtttcattaacatgaagttaagactttaagataagggtagtgcccacaacacaatcttttaaaatgaagccaagttaacagtcattactctgtgatctcaggcatgcccattatctctctgagctataacttcctcatggatgatcactagtctcctgccgctgtgaacttttacaaatctgattccatagtacacatcttaagtgttagaaatgcttgttctttggtgctgtaaagaaatagaccttgaacataaatttaatttcctcagcaagaccatttttactttctgcagaaagggtacacttgccagcagttttgccacaagagtacacggaacaaaggagacagggtcattataacctgacgcgtccaccctactgctatgtccagtttccattggctggaatgggacctcacattctgtatttgtcccgaatggctagcagcttagaactttttaaaagcagcaaaagcagaagagaacaaaggaaggaggaagtaacttgtgaaatgctgagaaaggtaaaaaaccttcaaataaggaagaggaacaggctatgacctaatgcttgcttggaccagtataagcatgctagggtaaatatttaggctaaattgtgggagctaagaacataaagtacattgatttctttattacagctagcagatatttaagaatgttagcacaggtctttgaataaattttgcttctaagagaaagtactattaattcctaattagatggggaggaaaatctttgaagaggaacctctactttactttttacattaaggaaatagggtgtctagtaatgccctcaaaagttatgaatgcccggtatccgttaggtttgaactaactgatcttcacattactttaaaaatagagatgactcaattattggttggctgtgagtaaaaccaaataaagctttatttaaagttttatttagattcttgaaaaaattatttaacttgggttctccttggtatgattaatttagagagaaaggaatctgagaatgctgttgacctcatcattccttcacatgttccacttttttagtctctcattttaacttaatgaaggaaagtcatagggagaaaaaagagagagaaaagaagataaggctgtgaagagagagggttgttttaagacctcacgttgaacaatcagctaaatctgcattgaaagcaagagaaatagctcaaacacaggtttatagtattttctttctgagagtgaacattgtgcagtaaaaggtccttcacatgctatggttcatacactggcatttcatgaagcagtagggagcagagttaaccccaccaagagcactgcagtgcggccttccttcccagcccccgttccagcacctctttccatttcccgacttttctttcaccgccagtaaatttaatgtcttcagctgagcactgatttcatgagcgtaaaggacattagcagtacttcgcacatggtatgcacaaatattaggcaagtccaaggacaggatgagctgcaagcagtctatgataagagtcaaaggcaggagttggggttgtagactcctccagccaaccacagcaaccaggaatttggatgcttcggccgccagagtgcttgcaagagttcatctctgaaatcgcttccattccagcgctaacattttatgaaacctgtgcttttcaaacagattgttttattgcttcctgcatcaccaatgtgttttctctttgctcccagctccctgagagcattttgaattatagcacagatcattgccatccacaaggtgcatgacatcacagtggacttgggggaagcaatgtcaaatgagactgagtggaatgggaaggagataggctggaaaatttaaataaaggtctttaggataaaatacagaatccagaatagttcctaactctcactacgtagtcgtttgtagcaaactgctaggactcttggcttttattggtgtgatatagatgcgctgctccttaatggtagagactgtgtctttaatcaaaagttggctacagagttgtttgtgcctgtgatatacttattagtccagagcagatatattttctgtcgtgtgtgctgaggagcactgatgtaaatccacttaatgttcatatcaaactctattctccaggaaaaggtgagggactgaaatgtacatacttgttggctggtcacatttgatattcagagacccaaatgagaaagtcttgcttctgagaaagtacccaaacaccaggacatcttccaagccccacacagtagcattaatgttttaggtgtgcaataaatagtgctgaatgaaggaagaaagtttcccaggctagaaacaggtgagtggagacgtgattattattaatacaaaatctggtgtgaggtgggggtgggaccctctccccaggctgtaccgacagccccttgctctcagtcggactcccaggctgagatccggccactaaagagggaacagtgacatttcacaggaaatgacccagaaaactaacaacgtggagtgtgtgtgcgtgtgtgcgcgcgcgcgagtgcgcgtgcatgtgcgtatggtgcacatgtggtgggggctggggacagcttgaatacaacccagggaccttaactggaggaaagactttaccaggcagactctggtaaaagtcgagcaggaagctgagcgtgacaggaaccccaagggtgtcaaaatgccccctcactcagcatctcttgagtcccatcaggacagaacttgtgcttagtcaggttctggacctgacagatgtgaaccagacgccctctcattgctgggggctctgggagggaaaggtgggatgaagagggcacattcctcccaaaggacaaagcaccttttagtggaaaatgtgaaaacaaaacatgctcagttcaaacaaggctcactttggtccagtacttcctttgttatgttcctgcctcttaaatctttctgctttaaagaactctccaagaaaatattttcagagtatacttttcagaggccctgtggaagccaagaataaatggcctccttttttgggtaaagagtcatatgtttaagatagttttatttgctccccccacctcctgccccgcatgcacacacgttgatatggttaactatcttctgctctgaatcagtattaagaatgggcacagagatgactaaaagccagaatttaccatattatcccacaaagcagtaacttttcaattttaggatacataatttcagcatttttcctatcactagatgtttagagctccctccagtgtctctatattgtcatatttactttgagatttttttttttcccaaagatcctaagaattcttttaaccatagcagggagagtatgttattgtctttaagcttacttcaagaacagaacgtgaaagccagaaatatcacatgcagccccacaacctatagattgtccattcctgctgtctgtgctttttttcaggatgaggagagttttggaggtagaagaagatgaagtggtcagaggatgggactcaggaggggacagggtaataaatatggtatgaaagttgctgcatttaaagagcttagggccgggcgccatggctcacgcctgtaatcctagcacttttggaggccaaggtgtgaggatcacttgagctcaagagttcgagaccagcctggccaatgtggcgaaaccccatctctactaaaaatacaaaaattagtcaggtgtattggcatgcatctgtagtcccaactacttaaggggctgaagcaggagaattgcttgaacccagaaggtcaaggctgaagtgagctgagattacaccactgcactccaacctgagtgacaaagtgagaccctgtcttaaaaaatttttttttaaagagcttgaataacttcctcttcttagaaaacgcataaactctgatgtgtcagctgagaagccgaggacctgggatttcaacctcttgcccgtgtgtttgtgattctggcgtgaaggtgatgatgcatttccaaagttgaacttggtctgctaggtttgggatgtggcagaattctggttcctgccagagtcccagtctttctgagtgtatgtgtgtgtacatgtgtgtgcatgtgtgacgtatgtatttatatccatacatacatacacgtgcacatctacatgtgtatgtatatataatcaagatgttcaaaattcaaagcgctgttttaagagagttaaaaaaaattcactatctacagatttgaattcagactgggttaaaaccaccttcctcctctggttgtcaagaggaaggttttggagttcgtgaattttttctgtggagttaagataacgtttgatgtaggagagcaaagctgcttcccatgcctaattccataaaaagcccagaacctctgaggcccatcttcagccaagcagccttgccctctggccttttctgcaacagtgagacaacagccctgggcacagcgggagttggttctgacaccagatgttctctgctcctggttaatgtcagtgagggctggaagttgaataaatgagaacaggagtggtctgggcccatgtaaatgatcctcccttgaaaggaggaacagctttcatcatttgttccagctaagccttgcatgcattatagatctggtgctaagcagtgggaaagatctcataagtaatgttttatgttctttctgtctctcctcttctgttgttcttggcttgtgggttgtgttcgtgttgttaactggaaaattgctataagccagttgtctcgtaagttttaaaaacgaattagaaaaaccataaaatcctctggcctatgcacattgtccctgttttgtgaaaacattaaagggtaaataaaaaggaaggagaacagtcaataatgtgcatcaaatatattctgagttctagagaaattaatgaccaagcattagaactagaagcaaaaaaaaaaaaaaaaaaaaaaaaaaaaaaaaaaaaaactgtcagtggttggcgagaagtcttgttttttccagccatatagatcaactgatgatatggtttggctgtgtccctgcccagatttcatcttgacctcccatgtgtgtgggagggacctggtgggaggtattgaatcatggggggcaggtctttcccatgctgttctcgtggtaatggataagtctcacgagatctgatggttttaaaaagaggcattcccctgcataagctctctctcattttttgcctgccaccatccatgtaagatgtgacttgctcctccttgccttccaccatgattgagaggcttcctcagccatgtggaactgtaagtccaattaaacctctttcttttgtaaattgctcagtctcgggtatgtctttatcaacagcataaaaatggactaatacgactggtggttgagaaaatgtagcagcctgagatttaagaaacaagtgatccctgagacagagcccttgaccctaaaggggaaaaatattcagttacactcatgagatataaacatagtacttttgttgtaactgctgagaactgaagagctaaaagtcaacattattttcctttttgagactcaaagtgtgtccaccaggagcactcttcccaatggaggcaaaatctgccaaagttgtttttgttgctgtctaaccttagaccatttcatctgccccaactaaaagtcctagccacagctctctcaagcgattctccaccctcagcctctgagtagctgggactgcaggcacatgtaccacacccagctattttttttaaatttttaaattatgttttttagagtcaagggtctcaccttgtttctccggctgatcttgacctcctggtgtcaagtgatcctcctgcctcagcttcccaaaacaccaggattacaggtgtgagcctggtcccccaggcttgacttggcacattgaatcttttatgaagaacaattaatgacttcccatgttgtgtaaagagacgggcaaatgtggcttcaaagcaagtcttgccaaccctcgctacaaccagactgtccctggcctaagcaagcccctcccatgtagacctggaaagccacttccaggtttcaaggatgagttttagaaaattaatggggtactagcatatgtgggtcaactctttattttaatgtaaggacactggacactttaaaataagttttctaatctttttaaaaaggaagggatattttaacatccccaaagtgaaaataatataatatcagagtaagtcctagaaatttaatattatggtacatttactatgttgtctttatttttcttcatttccacggattggccctggttctcagaccagcatgtgggaactactgggttggagtgttagccaataaaaatggccaaaaagtagaccatgaccttctttgagcttttctctggcttgtaattcccgaagctccttctagtgccaaaatacttctccctccctccctcttttagactgtaagctcattgagaacaaggacaatatggtaatcttaatatctttagcacacagtcagatatgaaagagacacatcataaatattggattaacaaatgaatgttctgaaggggaatgtggttgttgccactgtagaaaaggttcaggaaccaggaattcttgtgtaagatgtcatccacatagtcactggagaattccacagttgggttgagggcaaataggaatgccatgatccaggtacctagaactggcttgaaaacttgtaccttgcaacaataaatggaagccaatggccatgtggtctggccatggccacgtggtcagaagagaaggaattttcgaatgaggatagaggaagtagccacggagccctgaacaggggcttgggaggttgagctctctccacctcagagggctgtaggagaaacagggctgtctgcagggagccaaggttacagtctgggttggagagaatgttctgaggaaaggctgaagcaagaagagagctactttttactagattactgtgtattcagagggcagagtggaaataattaatactgagtgaatagaaggacagacagacctaaggataggtgagagaggtctgtctggtgcttctgaaagtttcaagtgtctaggaagcccccagcgttctagtggaaatgcacattctggttctgtcagtctgggtgggacctgagattctgcatttcccacatgctccctagtgatgctgatgctgctgggctgtgggccatggtgaggctagcgtttaggtcaaggaaacaagcatcttcagaggatgtcctccaggagcccaggcaacagttagaaggtcaatggaaaattctctggctgcagctgatcttttctgcttccctttagagcagggaatctcaacagcactgttgacatttggggcccagatcatcctatttggggaagcagggagatggagggggtggaggtgtcccgtgcattgggagaaatttagcagcattcctggcctctatgcgctggatgctggtagcacccggcagttgtgacaatcaaaaatgtcctcagacacttccaggtgtcccttgcagagcaaaattgcttccggttgagagccagagggttagaaggagaattatgtgtcttccctccccgcttgctgccacctccacctcttgtcttctagaaccatgaggcagaaatgacttaagtctgatatgcttggaacgcaacactcttttcgctatttctgtctttagaaatgttgagaaagtgtttgcctttatttgacggcctgattactttaaggtgtcctcggcatagaccagtgagcgccttggccctatttgctgacagttttaatagaacagcagggaaagtcctttccaagaaagtgttggctacgtagcctaacgtcattttaagtcatcaccatacacccaccaaacctctgagataaaatggaaactccatcatctcttgccagggtaatggtgttagtaattcactagtgacctctaagaatttctctgtgcattcactgccacatttaacttttgttacacggcctccaaaatgttttccagccacaaggtcagtccattgacaatctcaaaaatcctgacaaggggacagatgggtttagtttttgcctttgtgatggttagttctgcttaatgtgttgagaaaacatctgaaggttttaaccctggctggagtcgtgagacggaggcatgtttaatggaatagcacacgatcgtcctctcatggtgagtccacgttggagggcccaaagacccatgttgtacaatcggttcaactttttctgaaagccaaagaaaacctacctccaaacaggatttagtctcaagctagagcaaaaatgtacatcatgttgaaaagtcttctccaagtgctacaattcataagcagtgttgtgtttttactggaaaagcttgccatctagccaagcattcttcacatttttcccaggatttagtcataaaatcattttagacatattgcaaggataaaatgtgtacatatctgataaaaggcagggatttttttcttcttttttgctgtataactcctggaggaggcgaaaaacaaactagacacacacatacacactcacaaaacacacgtatttgtgcatatgtatgtgtatatagagagtgcacacatgttcatatatatacgtgtatatgtgtatgtatatagtttgttttccccctcatgaaatgtgtgtgtgtgtaaaataaactctatacacatatacatatatattattttcaccattaagtgcaagaacttggattctttattcacgattacttctatttgaatttaaattagatgccttaggcttctctttgggtttgaataacttagacacaaagtataaaacacttcctaatgatgcccacctgcctaggacatctttaggaattcaggtggaagtgtgtttgcatttgatttatctaagacgttgcagcagtggggatgtaatttctgcctttgggcaggaagggagcttagatggtggagttcgtatttgtaaacgtagatgtgggtgcctcaaagttggctgcgttgctaactaaaggaaggagagaagtgagcccagatgttgaccttttgaaaaaaaagtcccattttcatgacagattggcataaaagcaataacctgtggtaaagtctaaagaatacaagatttggatttctggatttgagtcctgtctatgcaacttactagatatgtggccttggacagatcacctaatctcacctgtcaaacagggacaatgaaactcaacatagcaatggttgcgaggagttaatgaggtaatccgtcaaattctgtggccgtggtgaaggatgatacaaatatccagtggcgtttttgttcttgaagatagtattcttgtgtgagttcttgccaacacacatacaattacatttctgagtcagactgatttcagtagcagataaacagagggagtaaatcagcaatagattagttggaaactctggacagcaatgatttggtggcatatggcttggtggtatgtacctgcacatgtaatcatggaaagttgactattcctactgttctcccctagttctatttcacttaagaaaaagttggaatggataccagcagtgtgctgataaaagtttagctactactggcggccgggcacagtggcactttgagaggctgaggcaggcagatcacctgaggtcaggagtttgagaccagcctggccaacatagtgaaaccccatctctactaaaaatataaatactagccgggcatggtggtgggcacctgtaattccagctactcgggaggctgaagcaggagaatcacttggaggtggaggttgcagtgagccaagatcgtgccattgcactccagcctggatgacagaacgagacttcatctcaaaaaaacaaaaaacaaaaaaacaaaaaacaaaacaaaaagtttagctactggctcgggaataacaggacgtttgatttgtagcatttactgatttctgtaatataaatactctcactgtgactaatttcaaactaccaatgtgacattaccaaccatgagattgtaaagagatgcacagtagcacaccaccatataggacagtcgtgcatcacttaataatgggaatgcattctgagaaatgcatccttacatcgtccttctgcaaatatcataaagtgtgttcacccaagcctagatggtacagcctgctacacatctaagctatataatgcagcctgttgctcctaggatacaaacttggacatagggttacgattgcctacagcactcagcaccttactgtactgaatactgtaggcacttgtaacacaatgttcctaaacatagtttttgtgcatctagacatagaataggtacagtaaaaatgaagtagaaaagattttaaaagggcacacctatatagggcacttaccatgaatggagcttgcaggactggaagttgctctgggtgagtcagtgagtgggtggtgagtgaatgtgaaggcctaggacatcactgtatcactgtaccccactgtagactttataaggactgtacacttaggctacactaagtttgttttttaaattgttctttctttgataataaattaaccacgctcagcttacttttttactttataaactttttaatttttaaaaactttttgataactttcataatagcactcagtttaaaatacaaacacattttacagctgtacaagaatattttctttctttatatctttattctataagcttgtttttgtagaaactaagtctcactatgttgcccaggctggtttcgcgcacccgggctcaagccatcctcctgcctcagcctcccaaaatgctgggattacaggtgtacaccaccacatccagtttataagctttttcttattaaaaaaagttttttttttttaagttttctgttaaaaactaagacacaaacacatacattagcctagccccacacagggtcatgatggtcagtatcactgtcttctacctccttatcttttccatctgtaaggtcttcagaggcaataccatgaatggagccatcatctgcgatgataacaatgccttcttcttgaacacctccagagggacctgcctgaggctgtttacagttaattggcttttttttttttttttttttttttttgagacggagtctcgctctgtcaccaggctggagtgcagtggcacaatctcagctcactgcaacctccgactccctggttcaagtgattcttctgcctcagccacccgaagagctgagattacaggcacgtgccactatgcccagctaatttttgtatttttagtagagatgggtttcaccatgttggccaggatggtctcgatctcctgacctcgtgatctgcccaccttggcctcccaaagtgctgggattacaggcatgagccactgcgcccggcctacagttaatttcttataggtagaaagagtccactctcaaataacaataaaaagtatagtatcgtaaatacacaaaccagtaacatagtcatttattttcactatcaactattatgtactgtgcgtaattgcatgtgctatacttttataggactggcactgcaggacgtttatatataccagcatcaccacaaacatatgagtaatgtattacactattacattggacagctacagcatcagtaggcagtagaaaattttcagctccattataatcttatgtgaccgctgtcacatatgcaatccgcggctgacccaaatgttgttatgtggtgcatgactttatatccactatacaagtagatgtaattaacctcagtcatacagataatagtaaaatagagtaaaatgagggatgatgatgagtttttgtttttgttcttgtttttttttttttttttttttgagacggagtttcgctcttgttggccaggctggaatgcaatggcgcaatcttggctcaccgcaacctccacctcccgggttcaagtgattctcctgcctcagcctcctgagtagtgtgattacaggcatgagccaccatgcccagctaattttgtatttttagtagagacgggatttctccatgttggtccgactggtctcgaactccccgatctcgggtgatccgcctcgcctcaggagtttttaatataatttattaaaccataagtttatataagttaatttttaacattggctatgttgaacgcttggctgtcaagcttaactgttagctctcacagacctggctccaacatgctactgtttctccttggctgtgttacagtacaaagttataccatgaattagcaagttcaggaccatcctggaaagccagcgtggaaaatgcagtcataaatggatttttatttctgtggactttggactggctgtctactcttggtctcacattctctactgcatatctctttggctaagaaaattagtattgaaaaatggtttatggatctagttattggagctagtattcaactttttagttacttaaaagataggacttaaacagagctgaattttatagggtcttttattttcttctttggtccttaagagaagactgcagaaaactagacaagaggaatttgaatgttctcataacaaagaactgataaaggtttgaagtgaaaaatatgctaattaccgtgaattgatcattacacaatatatacatgtattgaaacatcatactctagcccataaatataagaaattatcagatgtcaattaacaatggaataaaatgaaattaaattttaaaatgaaaacattctagaaaatattcccaagaagagatttatttatttatttttctggctatctatccttaagggttcgggaaaaaatggccggtggagaacaaaagattgaaattttagctcattcatgatgcacgtgaccgggaaggagtgttaagatgtcctgtacttccttccataatcacaggttgaggtgagggttgcctaaagtctgatcagccacattttgacagtggagactcagaggcctagttaggaacacagaaggaaaaatgttaaaggcagacctttataaccaaaacaatcaacaggtctaaaagccaaagaaaccagtatttcagaattgttaacttactcctagatgtgtgttaggcatcgggcttatcttaaagaagtgtcttagaccacagaaacatagacccatgatatttggaccaagcataggttaaaactaggggagggaggcacgaattacaaaaaaaaaaaaaaaaaggtgattccatgttagaatcccatgttgaaaaggtattacactttattgtaatacagacaagatttcactgtgttggccagactggtcttgaactcctgacctcgtgatcctcccaccttggcctcccaaagtgctgggattacaggtgtgagccactgcgtctggcctaaaaagcatattttaaaattagtcacatatggaagctaagtagtgcattttgtgtttccgaacaggacttaaaacgtcagtgccataaacactggtatgtattcagacacactggtcatatgtcatgaatttggtagacatatttgtaggcaaataatgtagagatagagtcacatattttaaactaaacaactcactatgaaccatcatgatggttcacacctacaattccaacactttggaaggccaaggtaggaagatcacttgaggtcaggaattcaagaccggcctgggcaaaaaagcaaaactcctctctacaaaaaaatttaaaaattagccgggtatggttgtacatctctgtagtcttagctactcaggaggctgatgtgggaggattgcttgagcccaggagtttgaggctgcagtgagctatggatgtaacccagaaagaccctgtctctaaaaaaaataaatatatacaataaaataaaaataaattaaaaatttaaaaagccactgtgattcttctctgtgatcattcgtaagtcatacactattttgtgtgggtgaaacatgtgatctgttagtgggtctgagaaaatcatatttattaagcaaaaaagtcaatatgtgcttgtgttttgcttatgaatttactcgaataaaatgtctgaaggtcttgaaacttcttaaaagaaaatggttcttacttcattttggtgtgtttacattaaggggagccatgtgacctcttatgagagttactgtcaaatttcaagtgcatgggcattgcctggaggacttgttcaaacacagattgctggaaagcccaagaatttgcatttgtaacaagtttacaggtgatcatgatgccgctttccctgggtgactcactttgagaaccactgtcttgtgagtttagagataaagaatggttgaggtcgtgtgcgatggctcatgcctctagtcctagcactttgggaggccaaagcgggtggatcacctgaggtcaggagttcgagaccagcctgcctaacatgatgaaaccctgtctctactaaaaatacaaaaattagccaggtgtggtggcgggcgcctgtaatcccagctactcaggaggctgaggcaggagaatcgcttgaacctagaaggcggaggttgcagggagccaagattacaccgcttcactccaacctgggctatagagcaaaactccatctcaaaaaaaaaaaagaatgggttggaaaaaatgtctgcacatcagtaagcacaaaataaccattgataaatagcattacaagcatccaggatcctaacaggaggggagaaaatcaggccactttagaaacacttttatgactggcagttatccagtttgctactaaggtcaggtctaaaagattgttaagactagcctgtttctgtatccatgggtatcagctggggaagccaagttctgtctttgtgcttggcagccctccccaatgccatgtctctgctgatgacattggaatttcctccaaattaaacagcctgacagcagccatctgtaaagaaggcagcaaggttacgagtgatcactggctagtgccatttctgctgccaaccaggcaggcaaagcttctggcatgttcttgaccacctctgagaagagttgatgtttcctttggggtatcatagagtttctgccacccagctctgtttctctgcctcctggtgcctgcccctaattattgcatagttgtcactgatcctggtaacctgactgctggatttttgctccagaaacctacagtaaaggagaccgtaggccaccagaagccaggaggaaacatcaggctgcagtcaagggcactgccttctcccctccaggctgctgggctttgagggcagagaaataaaaagactgaaagggattagaggcctggagtccacaacaaagccctgtagtcatccaccaccttgcacagcctcttcctgccatgcttacaggtgaaaagtctagttcataggacacattgcttttccagaaccttccgctgccttccagagccagcattcttcctgaaaactctctcttgccagttgtttgccttcagagttacagtttaaaaaccaacacttaaactgatatcctctgaagaaaaaaacagataacaaattcatgaatcatagttatacttaaatttcctccgtcacagagaaacatgttatttttagaaagtggatcccaaacctaactgatcagaatcccttgggggaaatgtttttaaaaaataccattacctgtgcactggcccagaaaatccagggccattagagactgcaaatgtctgagaatctgtgtttcctaaaaggcacaatggtgattctgatgggcagccatgtttgagaacctctgattgaattgtgcacaattttgatggtgctgctgttgcattataggtaattcaaagaagagcttcttttttttaaaaaaaaatagtaatctataaatataatagttttcatctgaatagtgttttcttgttttcagaagaccttcataactttttttttttttttttttttttgagatggagtcttgctgtgtcacccaggctggagtgcagtgacgcaatctcggctcactgcaacctccgcctcccaggttcatgtgattctcctgcctcagcctcctgattagctgggattacagacgtgtgctcctacgcccagctaattttttatatttttagtagagatggggtttatccatgttgtccaggctgatctcaaactcccaacctcagatggttcacctgcctcggcctcccaaagtggtgggattacaggcgtgagccaccacgcctggccataactattatctttgacaattttcctgggaggtggatgacaggacctgttactgacgccagtttacatctgagatgctgcagtggagaggaattggaactagaaccgacacttacggcttcttgtctggtgtactctctgctgttccatcttcattgcttgtgtgcatgcgtgtgtgtgtgtgtgtgtgtgtgtgtgatgtgtttatttgactccttgaatctatgttgtcttgtttttcgtaaatggattaacgccactaccacggatcatcagggagatatgacgctagagatagataagccaaatggaggtagaaaatccaaactgaaaacagggagagaagctaagatagacccaaggagtctaacaacccaagttctaaactagagagaaggccactgttcatctatttcagggatgggcagttatggaaatagtatgaactcaggcatcccaaaggcagtgcagtgtatgagagaaagatgcttgcatgcatactcccagcaaagctctcagtggggcccaagatgcagggcatggagggtaataaagattagccaggaaggtgataggacaacagatactgaaaacatggcaatgaaaaaacatcagcattcagaggtgagaattaccattgccagaagttcttgggaagtaaaacaagtacagagctatgggtcaaggatctcacagttagagtactagtagcagtagggtggacttgagtctgtagtttgggaccagctgctaacttaaagcctgggaagctcgtgttagccagacattacagatactttttatgtcaccttgaacaagcttcactatccttatatttaaaataaggagtaggcctattaataatctgtatgtatttcttgcagtaaggaaatctaattttgggaaatgaatagcaagaacatagcttggtgcagtgagtcagtgagaggatttacaaaaggtgaacgtacacaggactcttaatactgatcctgggctagtcatgtcattgcacatgacacctgctgttggaaggaacaggttaagcatttagttgtgtgcaatgaacctgtgagccctgtgggctggtcccacttatttgaaatagaacgattgcagtgcctatgtgagtcagggtacacctgaatgtttagttagtgctttccattaacccttttcaattttgcttctatgttttcttttcctccagaaggaaaatgagcagaaggtgtgtcacatgctcgctttttatctgctgcgtagttcttgtagtgaaaggattgtcgataagttcagaaaccaagactactgctgcctccccttcattcattcagtagtcttacagcctaaagaagacaagaaaattaaggactctcaaggcaaaaggaagtcaaatgaaattgggaagtgggtctacagtaaatgcaatatctgtcgctttcttttagaactgcataaaccacatggaaattttccgtgtatatttgctaccaagggatgctatcatctttttctttccttttttttttttctttttttttggagatggagtctcgctctgtcactcaggctggagtgcagtggcgccatctccactcactacaacctccgcctcccgggttcaagcgattctcctgcctcagcctcccgagtagctgagatgacaggcgcgtgccaccacgcccggctaatttttgtacttttagtacagacgaggtttcaccatgttggtcaggctggtctctcgaactcctcacctcgtgatctgcccgccttggcctcccaaagtgctgggattacaggcgtgagccaccacgccgggccactatcatctttttaatttaggcacatagtgctcaggaaaagacaaggatgatggatggtaattaagtaaatgaagacagcattggtcaggagggcagtataaacaaagtaaaatagaaagtctcttgttctattttttttaaataatgataattatatatttcttacagtcatatccagagcttacttgaatctaaagcagtatttatctttgcagcaagcctatgaattagctttacagactgtaggatgcagagacccttggattagaaaagttcagtaacccatgagcagaggcatgagaatgttaaaacaagtcactaaaggtcacatagcattccactagctgggctgtggttagcactcatgacctcctggggtctcatcttttctgaatcttattgaatcatgccagctttctgatatggtccataaaatgctgatagaaatcacatgtgaagttcccaactgtgaggacagcagacttcctttagaagataaatactagacctaatctaatacactttatttgacgtagcagaatttctcctgcatccttatttcaaaagcatacctgcctgtggtcttcccgggtcttaggagagtccatatgtctgatggaagcagacaatctagtgctactcagagaaaccaccacttgatcctcagtttttttgaggaatttcatgtgtttttatgtgaagaatcactctcaggaaagttctgtattttggtagcagagatcctgtcaagaaggcagtgagatagatacacataataagctgttcatcattactgctgatggaactcttcccaggcctgcagctgacagcattgcatgggacctgcagcccctttcaccgtgactgcagattctttggttaagagactgtcagtggtcaaggctctgccccggcttctcgggatcttcacactcccctgtgcatagtaggctttgggttattggccatcatgaaaaccaagattgtcgtttaatgatcacatctatggacttggggtcggaggaacctggattcacatcttggctcctccactgactggtaagttgcttagattagttgcttttttcctctctggctgaatttatgcaattgggagttttaaaaagtatccactaaattcattgttgttgttgttaagatttagttgtgtattgtacactacctggcatgtagtggatgtttggtcaatggtaactattaaaattattgcagatatcctcaggtattatatttttgacaggagatatctgatagcctgattcgatattttatgtggaaggaagaattaaatacagaagaaccctaagacaatgctatctgttctagagagtgtttcgttaaagttgcagtgtttcataacgaagcaggcaggacggccctctgctatgcagagctctcccgctcatgacaacacaacaagcactcccggttcatccctacctactcatcccaacaatgtttccaagttgttttaaggattcagaatggccccactccttttcagatgtccctgggagggtaacccctgccttgtttgagaatcacgagcaagcatagtctgagtttgacttctgtacccaagtagcagggcaccacctccctctcagtggctgatggagaggtcttccacagtgaactttcagtgaagaagttcatgtctctctacattatctgttttactcagcattcagagatatgtggtgcctccacaggggccatatccaggctttctgatgaccctatagggagcaatggcaatttaatgaggaggggaaaagatcagcttaacctagcttctacttcatccgggttctcatggttagttgagagtgctgatccgtgaccaccattgagtcattgatctcccgctcttcctagtcaatctgtcattcagagatttgcttgatcccttgtgccagatgcatgtatttaacaagctaacatgcactaagcatctgctatgtgtcaggtactattagacgcatcatactacaatgactaagacacagtccttgtcctcaaagaaatagtagccctgggagtaaaaatgatataggggaggctgggcacggtagttcacgcctgtaatcctagcactttgggaggctgaggcaggcagattgcttgagcccaggagtttgagaccagcctgggcaacatagtgaaaccccgtctcctttaaaaataatcaaaatatttttaaaaagtgatttgaaggagtaacatcctgttcatgttcagaggcattcagcctatgagcccaaggagttacgctcatttctctctatgtacatcttttagtcctaatatgcgtttcttcatttcttttatttttgttaccattatactctttacacaaggtccttcaccagagacctgttatcagtgtcagagacccagccctggtggccttgtgcagcagatcagaataactcaaggagctcccacatttgctctcctgactttctagaggcacacgatatccacatatgttaatgtattggttttatcataggtttctccttgcatttctttcatgtaaaagtgttaagagttcagtctgatctgaaagcaaaagtttaagttctcagcataactattcttacaatcttgtgcctttgcaaatatgttaaaatgttctcagccccctccagtcctgaactccccatttttttatggttaacgcgctgtcaccactacccagcagactacaaagcagcagcaagtgcaatgcagagaacgcgatgtagatcttgttcaaagcagctgacatgttgtcatctcaggaagggcagaatggcaaggaggagtgattgatggaaacttgatggagcaaccttcacttaattatttttgcatagattcctgaattgtggcttctttgctggaaaaaataataatgatcctgtaatgcagactgctttagaggctggaatgtgtcatcgtatgtgaggattaccacttgctcttttagaaccccaagcatctatctctacctagaaattttttatcgtgaagactaatagccttaagggtgaaggagaggacagagaccctaacccagagtaagataggaatgattaggaatgattgttggtgataatcagatgaacacactgtagccctgtatcaggagagaaaatgtgtttgagattagcacgttatcagaaaaatgtttgcacttatcttattctttgaataagttgcaagctatttctcttctttcacaaaggcaaagtagtaagccaaacctgtaatcagaaaaatattgatatgttagatagagaaagttatttttgtgtgtttgtttcagttgttgaatcaactggtatgtatcgagtacctactgcatgtagggggattgtagagaactttcagcgtcaagttagagattttaaactttatcctagaagtaaaacgagaaattaaggcactgagttagaaaggagctagaccatgatttctcccatatctcttgtgcaaatggcactagccaagccagaagcccctatgctgttcctccatgtgcccctgcccagccattcagcagccttggtgctgagtctgcctgggacatctcccctgtccgcctcctcttctccatgcttactgcccctgcagcaggccaaacctgatgacagctcagtggcattgcagcaagttcctcccgactgtttgccttgcctgtagaacctggtcccttctcatccatcttctactctatgaccagagtgacatttttaatcaaaaaatgttcctgcctaacccttctgagattctccataccttcaagagatatcttggggagagaagggcactcgttacctccttcctcccctcctggcatgccatacttgtgcttccctgaatgtggcatgtccccttatgtgactctgcatgagctccctcctctgtctagacaatgttccctctcacatcacatgcagtcacacattcctgtgtactcttcaaaactcaaccctgccatcagctccaaggagcccaccctaacttttccctcctggtctcactgagccactctgtgcttcccacccatgaaactcatatgtaagatttttagtgtctgttctcttgaccatctctgcacactggatacagatgtattagtctcttctcacattgctatgagaactacctgagactggataatgtgtaaagaaaagaggtttaattggctcatgtttccacaggctgtacaggaaacatggctggggaggcctcaggaaacttacaatcatggcagaaggagaaggggaagccagcacgtcctacgtggctggagcaggaggaagggaaaggggaggtgctacacacttttaaacaaccagatctcatgagaactcactatcatgagaacagagagggagaaatctaagcccgtgatccagtcatctcccaccaggcccttcctccaaacactggggattacaatttgacatgagatttgggtggggacacaaatgccaaccatatcaatggagctccttgagaacaggaactgtgtcttttagatcttctgttttatatgtctgatgcatagtaggcagttggtgatcactcatttggtgaatgaagtgttaggctgaactgaagtgggaatgaatatgaagagataccacacacctgcattccttgctatctgtgccatttgttccatctcatatctcatggtcacaccagtctgagcaaggtcagatactctttttagagaaccttctgtggccttattccatgttcagttgtttaatcacgattacctttatttttgtattggtccatgtcctgagtattttttaaagcattgactgttgtggatccatggagaagtcagagaaaacagatgaagctctctgataggaaaaaggattgaataatcttgccatccaaactgtggtatcaaaatatgactatatatgttgcaatcaggtgcatgcgtttcttggctttcctggatgtgcaaaatagaattcaagacagggtacagagagaacacattctacataccccacataaccttggcatgactgtttggaccttgctggtaagaagtggcattggctagtcttttgttcacaggctggcaaggttgctcctgattttctctttacacggataattcctttactgaccaaatctcatgagagcaaagtgaagtatcctgtagctggcactacattcatgaccttttctatgacaggttaatcatttctttgtgtgttcactcactgacctttacttcattggccaaaggagtgccccatgtcaaagtaatgtcctcgttcctccattccatcatccctttggggcagaaaagatgctgtcttacccgtttttgtccccagactagctgggtgcctggtgtgtagatgttaaatgaataaattgtttaggcaaagccgttagtagcatgatctaatgaccacaaacagaaaagtgtgtgtggtggggaagggcaacttatattttaagaattgtgttttaataagtggtgaattatttcagtataaatccagtattatcattaataatagataaatatattgagcatttaccataagcaccatattctatcgcctctcccattacgtgaaagactaagttttatagtttgaaaagaaggaaaataggaaatatataactacatttaatattatagcataaagggctcaagtggaatgatgctggtatgacagagtattcccaacagtcctcccagttctttttacattaatataaaatgttccatgaattaaagaaaaatatagcaagtcataaacatttacaattctctttcctcaccatctaaggaggacaagttctgtgcttatttagcttgctattccttgtgaggtcagaaaggtcaatgattaaacttagattaggccaaattcctccttaagagaagatatggtgcggggtagggagtggggaacataagaacagccattatagggacctgtaagagaggagggcgagatgggaggaagagcaatcgtcctgggaaaagggaacttgggacagagaggagtaacaaggctttcagggagtctttctgagcatggtgccatgctccctactccccacttccaccctccccactccccccctcccattcacctctgccatccaggccttcccaggaacacttggccaagacttgcaagtttatttattttttttttagctcatcagctgtcattagtgatagtgtcttttatgtgcagcccaagacaatttttctccttccagtgtggcccagggaagccaaaagattggacacccctgctctagatgtgagtcttggatgaccacccttcactctacctaggctacagtaacagacgttgaaagtcagcatcttcattgttatggaggaatggaaatgggataaactattttaaaacaattttggatttaaaaaaatagtttaaatattcctgttctctcaccccacccacccctaacttctttgcattattaattttcttagctaatcttatttctaaaaaagcaaaaccttccaagggaattctttttcttttctttagggagagagtctcactcttgtcacccaggctggagagcactggcacgatcatagctcactgcatcctcaaacttctgggcccaagtgatgcttccacctcagcctcccaagttgctgggactataagtgcacaccaccgtacctgggtatttttttttttttttgagatggaatctcgctctgttgcccaggctggagtgcagtagtgtgatcccagctcactgcaagctccgcctcccaggttcacaccattctcctgcctggctatttttttaagcttcttgtatagatggggtcttgctatgttgcccaggctggtcttaaactcctggcctcaagggatcctcctgccttggcctcccaaagtgctgagattagagccataagccaccaggcctggcccaaatgaattattaatttgttttgggtagaattactaatagccaattactagttagtggaacttcaatttgggatgtttttatctatttgaataaactttcattctgtataactccatgtctaaatctataaatgtagacatacatcagtatagaaacgtcagtggctcttagattgggtactttaataataactctccatgactgaccactggggacttctcaaggagcaggagaagtatctaccaaacgtagatacctgagaaatagtggagtctgctgtaatgttcactgtggataacctgactggcagagttgtcccttctggaagagaggcagctcaggtcactgtgtaaggcacctgtcttaacttgcaatgggaattttgcagtcaggtgaggggcacaatatatgtgaagaggaagtgaatgttgttgatagcatcacatcataattaaattccagccactggatgatgaagtcattccttcacacacaaacggcattatatgcctgtaatatttttccagggctgccattacaaagtgccagaaactgggtgacttaacagacattgagtgtctcacagctggggggcctggaagtcagagatcaaggtgtgggcagggccatgctccctgtgaagatgctcgggaaggatctgttccaggtcactccctagcttctggtggctccttagcatgtggctctgtcactccagtcctcacagagcactctgcctgtgtgcctgagtccacatttccccctttttttttcatgatggagtcttgctctgtcacccaggctggggtgcagtggtgcgatctcacttactgcaacctctgcctcccaggttcaagagattctcctccctcattctcccgagtagctggaattataggcgcccgccaccacgccaggctaatttttgtaatagtagagacagggtttcaccatgttggctagactggtctcgaactcctgacctcatgatccgcctgcctcgacctcccaaagtgctgggattacaggcgtgagccaccgcgcccagcccacatttccccttttcacaaggacaccagttctgtcagattaggaacccctctcctccaggatgacctcatcttaactaattatatctgcaacaaccctatttccaagtaagttcacattcagaggtattaggggtcaggatgtcaatatataaatttggagggacagaattcagcccataacaatgcctgccagtggtagttttttgggggtcagggtgagtctagtatctgcattttcaacagcatgcctttttggggagatgagtgtcaagcattcactgatttgaggtaacggggccctcttgagtctgtgatgtaatctcacactcccctaagagctatttatggcctacaagcctgtgcacatttgaatgcgcgtgtgcagaaaagacaatgagccagacaggcttctacacccacttaagagcactcacatggatcagtcacccaccctgaatgccacgttagttttgacatctgaaatgtgtctggcattttcaggcagagaaggcttttaaaaaaaaaaaaaagtcacatggatgccagttccttactatctccctaaaagagcctaaacacagaaatccagacacaggaactcacaagaatattagataataaatagccaagcttctgaagaggcctggaaccagagaatgatatttaagggttattaagcttaattttttgcactgtggtctgcctggcatatagtagacactcactgaaagtttgtgaacagatgactaggagagtctctgttccgtgggtatgaatcttaaagatgcatgtattcagccccttctcctggcttctgttctaagcagagggaatctgatgccttgtttctgcgcatctgtgatctgggcagattacagatgtcacaagccagtgatgtacacctggattgcatcctgaccaaaatcagggaagtacccgctggcatgttgaggacctcctttgaagaaaatcctgtggctaaaccaattcattgcccttgggagagaaacattctatagcctgctgggtggatgtgtacagtccatgtggacccacctaagtttcctattttgttccttctttcttgttttcctttccttcctcttttcttactttttaagccacttattgagtttatcctttcaaaactcatcttgaggatatgttcaaaaatgacccatctagagcttcctgtacacttctttgcagagtgagttgctgctgacttatttctccttccagcgtcttgctgatgcctctgtagagtcatttattacctgcgtaagagtgacctctacacgtgcctggttcccaacaagacatggagtctcaactgaattttactcatctctgtttccctaatacctagtgcagtacctggttagcacttcctggatgttcagtgtatggttattgaatgaatgaatgaataagctgttactttctgcttgcatagcactgttctagagtgtcatggaggacacaaaggaatagaattgatagtaggtcattcttcagttgcgttgcatcacaagggtaaaacgtgtacttattcaaaataagtggcataataataacttcttaaaatttttattttatttttccgtaagttattgggatacaggtggtatttggttacataagttctttagtggcgatttgtgagattttggtgcacccatcacctgagcagtatacactgcaccatatttgcagtcttttatccctctccccactcccactcttccccctaagtgcccaaagtccgctgtatcattcttatgcctttgcatcctcatagcttagctctcacatatcagtgagaacatatgatgtttggttttccattcttgagttacttcacttagaataatagtctccaatctcatccaggtcactgcaaatgctgttaattcattcctttttatggctgagtagtattccatcatatatatgtaccacagttcctttatccactcaattgatgggcatttgggttggttccatgattttgcaattgtgaattgtgctgctataaacatgcgtgtgcaagtatctttttcgaataatgacttattttcctctgggtagatacccagtagtgggcttgctgaatcggcatcataataacttaataagtcaagaggaggtctgggcactgtgctcatgcctatactcccagcattttgggaagctgaggtgggaggactgcttgaacccaggagtttgagaccagcctgggaaatatagtgagactttgtctttacaaaaaagttaaaaaattagccaggggtggtggtgtgcacctgtagtcccagctactcaggaggctgaggtgggaggatatttcagccagggcagtcaaggctgcggtgagccgtgattgcaccactgcactccagcctcggtgacagagtgagaccctgtctctaaataaataaataaataaataaataaataaataaataaagtcaagagaggggcccagtggtgtaatggaagagcactgttcatagaatctgtagatttgttttctagtcctggctccacaagttacatattctgtgctcctgggaacttcccttaacctacatgagcctgagtttactgatctaaaaagtgggcctaacgcctatctgaaagaattactggggatattaagggtataatgtatattataaagtgcttggtaagtcatagcatggtatctaaatctaaggtatgttgcttttatgacacaaggcagtatctgagttaggacagaccaggggagtggtacaatcagttaatgttctgagttgctgggtaggagttagcaagtaaggcacgtgcaagaattagaacttggccagagctttgaagaataaggccacctggcatagacaaagggaagcagtgtggcctgagtacctgcacacaggttgtggtgggccaggaggatatgaacgagccccatggctgccatagagggctggtggtgcccgagatggccctccttgccatgaagtaggcagaaggcgcttagagctctagtttcccaaatggagctcaattgcttgtcatattacatacacgtgctgttatgtgtgatgatgctctgttctaaccctgaaagacctggtggagccttagcaaatcactggccattctcccaaacactgcgtgtgcttatgctatgccgccatagttttacaagcatttttcagcgtttatgcaaatgctgcccttctgtctttggtaactgctttgctcatctttcaggattcagcttacatcttgtcttctctgtgccacattcctgtcagcagccacctcacaccacccgctcctgtgcacacaggcgtacagagatagtcttgttcctctctgctcttagagcaccattcagctacccccagtggagcactaatcccagtgagctgtgatggtttcttggtgtctgtctccccgcgagaccatgggctcttggtgaacagcggctgtagcctgttcagctctgaccctccggaccctcatataacctgtatgacccatgaaggtgcacagcaatgggaaggatgagggaagaagaaggatcttttcaaactctgtacattcttcacacagaaaagcaggctcatatcagctgacttgttctcccaggcagagaacaagagtgtgccacattcactccagttgaatggtttcaaacttttcttcctttgaggtggatgtatttttggcttttggcagtgtcttagtccatttggactgctaagcaaaataccgtaaacttataaacaacagaaatacatttctcacagtgctggtggctgggaagtccaagatcaaggtgccagcagcttcaggatttggtgaggtttgatttttttggttcatagatgacaccttcttggtgtgtcctcacatggtggaaggagcaaggtcgctctctggggtcccttatagatgggcactaatcccatatatgagggatactgaaagtaaattgatggaagtgctcgtgtgaatgaatgaatgaatgaaaccattttgaagctagattgctaggttcctgcaggttatatctttgtatactccttacctttcaagaatgtctgcagctctctgcatacaataacttccttgagtatatataactacagtatgacaaggcttttaaattgaacaattctaaagactgtttttttgagtccaaaaagtagaatttggtatcaacattaggtttaaaagaagtgatttcagagtttgtcaactattcaagtgtcagaaaaaaataatgtaaatgatgtgcttaagacatttatttttgtattctcgattctcctgaaataaagggaaattgtcttgaaaagctgtagattttaaatgaaaaggaaagcgggaaggtgacataatttgcctctgcctttgcagaaattcaagtgtatatggcctctctccaatccaccattttcccacctccacaggccccatgtcagctgtttccttcatatcattgcaatgctttgagggtgattgttggtttaagctacagtcccttcaaatttgtgaaagactaaacagattgataacaactccacctagattaaatgaaattctgtgggtagacaggctagtcaaaatacaatccccacacaccccaagtgagcattgcttctcctttcagatatgctgtgggtacaaagaaaggatttagtccaaagtgccttggggttttgttcagtccagagtgtaatttttttctctcttttgcctatagccatttctgtaacattactgaaagggcttttttcctaatgaagcatgaaaattgatcgtatcttgccaggagagttcttcctaagtcttaagatattaaagatttcatgagaaccgcatgaagaatatcttcttgaatcatttacatttttcccttttgtaggcttatgtaaccatgcagaaaatctaataataagtgtgctattagtgtaccatgtgccatcccgcaggcagctgtgccatggggcaccagtgcccagggcttgtggatagcattaacctgtacaactttctaaagtaaagcccagtgggaaatctgtaggtaattgaacagatagtccatttttatcagacttccccctgccccttccctgttctgtcttttctcttttcttgtgccagaaggaaacaccttggccataggcctttcattcacaatggagtatattttccaaagcaaatagcttggactatttcaattcccagagcaatctaggtgggcacacagagctaaatttgggtttgaaagaactcttaaattagtatcataggaaggcaatgagcaggaaaaaaaaaaataaagatacaagcattgtggtctgatggaaattatccagcactcacttacaaatgacaagtgggtaccacccagcctttctcatgttccaaaatttaataaagggttccatctaggtcccccagaaactactgtgattatcagggtgagagaagggggaatgatgaatttttgtaatgccccaatctttgtaaccaggcatagaaggacattcgctgggctcaggatgggtgttagcatgtagtggataaaggaattgcagagttgttgacagctgtttcctcagagacacttgtcctgatgatatttgctttggattctaagtaacagagctgtagttcttaaagtttaaattgaaaaaaaggagttttctgtcaagtggcttagtcatggaaatcagtgaagttaagcttgggcaataatatatccttttcaaatccaggtgccttcctgatcatgccagagcttttgtgactcctttctccttggtgttcttcttttgatgcggcgatagggtctgaacacgtccaggctgtctttgctgggagagggcagaatgcctcggctttcttcagccttgcctttcttcattgtcttcaccctgcagcacttctgcaaagctgctggggtaggtgggtgagtgggcgtcttttctttgctagcccaagctgagttctgaagggaagttagcagggctcagctgctgccgcaaagtcagtcagaccaattctcatttgcatgcctacagaattagacatattcaggggctcgggttaatgccataccctcctcttgtccttggaaaactgtaagaatgcgtgcaggtaactctgcagcaattctgtgttgctcagatgtatttctcttctttcagaattcctccttctatagcattcccctaatatttatgtgctggggctttcttctttcatcccaggccccagcttcgctctatatcagacagaggtgggagctgctgatcaagggggcacacttgccatccaaacctcacgatgctcacaggtgtcctttcaaccctgctaacccagatgatacatcaccatttatacctttggaggcattttctctttaattgatgctcacttagacctaagattgttcattaaagtccagaggtgctcattaaaatgaacattggatagtgtggtagatgcaggttatcattatgaatccaagaaagggctctgtggaacttgttatatacggcatttataggttgttaaattaaaggattagtgttgtgctaaaccattttcaggttaatcagttgtgggaaaccagatctaatgttaaagcaggcttaaactatggtttttatagtagggaagtttttaagctactgttatttctaataaaccctctagcttgctaatcgagcatacttttcaatttttgcacttaactgaatatggtcttgttccctaatttttttatgtgtgggctttatttcttcaagctggattgtaagttcctttttagcagggtctatgtcttttttttttttttttttgctcatatcctaaaagcttctggtataattcgaggtatatagcagatgctaaggattttattgagtgattactacatttttagagtgtcattacaatgtattatcacctggtttatgccgtggtgctttatgtaacatgtgcctatttacagaacattgatataacatgttggtctgcaaccaggttgttatcagcaataggaaaagcattacagagttcatatggaagtagaggagaaacaggtctaatttgggtgtgatgccctgtattagtctgttttcatgctgctaataaagacatacccaagcctaggtaatttataaagaaaaagaggtttaatggactcacagttccacgtggctggggaggcttcacaatcatggtggaaggcaaaaggcatgtcttacatggcagcaggcaagagaaaatgagaggcaatcaaaaggggaaacctcttataaaacaatcagatctcgtgagacttattcactaccacgagaacagtatgggggaaactgcccccattattcagttgtctcccagcaggtccctcctacaatatgtgggaattgtgggagctacgattcaggatgacacttgggtggggacacagccaaactatatcatgccctaacctgatcagatatggcttccagactggcccctggagtggcctgaataccttcaccaagacacgtgtgtgggacagatcaaaagtttccatctgccatttgtctttcacttggtaactgctaatgattgcttgttaaccatacacattaatatgcccgtgaagcagatagaaaataaaataagtaaaaaattgtataagtggaaaaactaagacccaaacaagaaattatggatcatttctaaatggtggccaggacgtttatacggagaaaccataccattgaaccataatcaatgtaagaatacaactgatggtttcagactttcaggaatagaatgagtctcaggcagacatgttctcaggcaacatggcctgggacatccccagaaacctcctccatggagttaacaggacacctacatggccctatgtgtccctccacttgggcctcttgttcaacctcgtatcacatgtccccttcctaccacataaacttctgtctctacattctctactctaccacaggttcatttatttgtttgtttgtttgtttgtttgtttgtttgtttatttatttatttatttattttgatacagtgtctcactttgctgtccagctggagtgcagtgtgcaatcacagctccctatagcctctgtctcccaggctcaagtgatcctcctgcctcagcctccctagtagcaaggactatagacatgtgccaccacgcccagctaatttttaccttttttttgtagagatgagttctcactgggttgcccaggctggtctcaaactcctgggctcaagtgatccttctgcctcagactcccaaagagcttggattacagacatgagccactgtgcccagcccacagtcatgttttaaagtgtctgagctataaatactactataaaggtgtcaactggttgtatatgtgggcccttggcatttcagaaatgacagttattgccaaccattaccaaatggaatccattttatccaaatgggcatggttggggctgagcatgggatggagtaatgcagtcttattgcatttcagtgttagagggctttcactcggtttgcagtttctccacagctcacccaccaattctacctgtgtacttcttttctgttccctctcaacttcttttccattctctccttcctcttgtttctgtccatatctctggcttcttttaatttcccttttcccttctttcttattggtctggccctgggtctggtgagaccaagggcacagaaggatactggctccatgccaacctttcctccaaggcacaatctccttcttggcatttactgagatgttcaacttcctgtgtttctaatattccttcctgttttataaaagaaaaatagattggatttgcaaagtgccttaatttgttgattttctaaaaagcaattttaaaaatgtgtatcaacaatatcacatacatgtaactgatttattgactctggcttgccctgggtttaatcacacataaagaaattttacaataacacatgatccagtagagaaagaagtcaaagaaatatgtaaagtcctgtgacctctgtagacatttgggattaaaccaaattaaaacacctgtatgggctgggcatggtggctcatgcctgtaattccagcactttgggaggctaaggcaggaggatcacttgagcccaggattttgagaccagcctaggtaccatagcaagacccaatctctactgaaaaaaataaaaataaaaataaaaataaaaataaaaataaataaccaggcatagtggcatgcctgtagtcccagctactcaggaagctgagatgggaggatcacttgagccagcagtttgagactgcagtgagctatgattgcaccactgcactctagatgcaacagagcaagaccctgtctcggctcaaaaaaaagaaaacacttgtatcaattcaggtcaaatattggtttcttttttttaagagcagattaacatcttgcatatcttttgctatcacatttcttcttatctgaccagctgaaatggaactagtgttaaatacaaataataaaacctgtaaagatcctaagtttttgcatggtacaataaatcctcactcattcacatgcttggagaaagtccagtctgattcaattaatgaaaagcaaaaaaaaaaaaaaattgtaactacataatttttatctcatgtattagctcctatttagttcacataagtgttcaaataggtactcatttttaattaacaaaatatttgtgtgtagtgagtatttttaaaccaattaaaacagttccttcttgtaagtaaattaagtgctattcttagacgatggtatgcatcattcatttgctttgcaaaccattctttcacaccattctagttggtgtgaaagcaaattgagcccatctctactggaatttattgcattctcttaatttctgacactctatgctcccaatagtagggactccatcttagccaccacgacatcccaggcatggctcctagaataatttcagctctttaagactcaattaatatttgctcactgattaatatttagctccattaatttatgtgtccaaattccttaccatttgccaagtgcttttggattttacagttagttacaaactgtagtttaaggtttttctggctttacttcattcttcctttaactagctttaaaaaactagtttataattctagttacaatacaatgttaagtgaaagaactgattcaaaattatatattcagaattattctaactttgtaaacatgcatagatatatgtgagctttaaaaaagaaaattatatatatatgccaaaatacaatcaaaatgtaaatagtggatatatcatgttggagatattaggagcagttttatattttttaagttttctgtgtttccacatatgatcacactttatttttatatcagaaaaaagctatcttagttgtgcattgtacattagaaatattagttttgaagataacctaaacacaagtttttatttcttctgtcacagttgcctcttttcttaaaatcgtgtttgccagtttctttcacgacactgcaaacaattttagtagcttcagttctttgataaatctgtagcttttagatctttgattactattagcaaagaaaagatagacccaaatgaaaaacagttgcatttttgaaatatgtccggcgggggttgatgtggaaagaacaattcctctcaactccagggtcaaagcagcagccctgccaggctctgtcggggtcgcctggagaacatcacttaactttctacatcagttcctgcttctggacattataacattcatgatatccacctcatgcaggattcctgggaggagcagatcagatcataatgtgtgtgaaggggctttgaacgacagtcaccacattattaccaccataagcattatttccatttcaaaaatggtagaggagggaagatgcagatgttctctttatgttggctcggcaccaggcacgtccaggttgtgctgctttaccctccagcatgaagagttagaaggtaaatatcgatattgcttttcataactaatagcttcatagttcatgtcaggtgatttcttggcttccgttagcatttcagagaccattatacacagcagccatcctctgcagagctggagaaaactcatttttcaaggcaaatagtcccaagtcagggttcagtcctggtggaatgaaataaagaaggagagtttatctttaaggtaagctagcatttaagtagatgttggatattatcagagatgcttatgaggggcagagagcattgaagacttataccctttgcacatctttaaatgcctgtaagtgcttaccaggagccaagagcgaacgggtggctgcgtgcaaatgctagaggttaacccctgtccatgggcatttaccgcatgagtaaaaatttattgcagagttcaggactgtgattctgctgctcatttctgtagcgtatttctttatctgaaaggatgcccattgtcctttctagctttttgggccataaccgtgagggaaggcccaaaggaagaacctctgttggagatcaggtttattcatccatgtgggtggaggtacgaaggagggaagaacctctgttggatatcgggtttctttgtctgtgtgggttggagactagtagaataggggaaaccacatactgcccattcctccaggatcattttccatttggatatttagaaagcaacaagagaggagttttagaagacaaggtagatgatttcaagttactttaacatagaggaagaaagtttccttctatttttaatggctagtgcatgatttgtgggagtgaagattgggagggggcacggacgaacaccaggaagaggcggttaatttattggtccccattaattgaatttaataagtgagttttgtcagtttagcaatatccattagtttcagagagtgtttcagtattattctgtaaaagcatccagggatatattttacagctacagcatagattatcttgcacacatattgaagtaaagatacctttcaacattccagatactgacttttcacccaaatttgaaaatctccatttagcactttctaaaataccagtgaaaattaatatagttttgtagatttatgtactaagatgcagattaagacatgtggaatctaatgaacatagcaggaaaagaaaattttctcaagtctgttcattactattcctcatcacattttttattatttaatagcttattccttgaatatgtgtgacttgggattagatgtgccagttggaagacctcagaggttcagaaattcacagacatgtgaaatataaaaccgtattcatttagcagatactgataggcatataaaatagaaccttcatcatctatctttagaaaaagaagattaaacagaagtgtaattaatttgccaactctgcttcccgattgagacatttatcaaagttgatctttaatcattagtttcctaatctgtaaaatgaagtctattatgacctctaaggtctatttgtaacagttaggattaggttcagttccatatcaccaaaaaaaaaaaaaaaaaaaaaaaagaagaagaagtcaagccaaagaaatagacatttatttttctctcacataaaagtggttttgagaggtaagcagtccagggtgattatggtcactgcacaggctcagaaacattgtcacctttctattctgccatgctgtagtatatttcttttcttttctttctttttttttttgagacagattcttgctctgtctcccaggctggagtgcagtggcatgatttcagctcactgcaacctcttcctcttgggttcgagcaattgtcctgcctcaggctcccgagtaactgggactacaggtgcgcaccaacatgtctggctaatttttatgtattttttagtagagacagggtttcacatgttggccaagctggtctcgaactcctgacctcaagtgatgcacccgcctcagcctatgtctcacatacaagatggctgcatagctctagcctttaacattaccattccagaaagcagaaaggaggaagagacgaaggacctaccccctttccaaagacacttgccagaggaaccataccacatttttgtttacttcatgtcaacaagaatttagtctaggcatacctagctgcaaggctaggcataccttcttgcaagtctaggcataccttcttgcaaggcaagaagaagatcaggtcattcagttgggcagcaatgtgtctacctcaaaaccaaggtttctacttctaaggaaaagaaggaaagtgggatattggggtaagcaacaattatccacaggttttgagctcaaaaagccgtgatcgcatgtttctgggaaaatttgacctatacaatcgagtctgaatgtgtgctgggtgtgtacaaatcagacaacttcaactgtgagccttcattagctctcccctttatctagacttaggattgtatttccaggcataggtcagaatctttacactgattgtgtgtgtgtctgtatgtgtgtgtgtgtgtgtgtgtgtgagagagagagagagagagagagagagagaaacagaatcttggctgcaagatgtgctgaatataaacacaataacttagcaatttataactgcccctttcccatctctgccccctccccagtatcagcatacgcagtgttacccccacactatcaatatgtcaatgattaatagcaactggcaaatgtgtgctttccatgagacttgtatgcaaggttactcgggttcacagaggctgctaataacagcagcactattgaattatgctatgtgtctgtgtctgttaagacaggtcggaggacaggggaggaaacttcccccagggtaattgagagacaaagtcactaaaagctacagatctccagtttgggctctatgcatgagattgttcttaaaagtcaaagaaatataaaaggaaattgcacatttgtaatttttttaagttccccatttcatagctcattaaaaccaggactttaatattctgggtcagaacccccattggatatttttgtgaacatgtaacatgtgggttgattagaggtttgggcctgtttttttctttttctttttttttttttttcagacagagtctcactctgtcacccaggctggagtgtagtggtgtagtctcggctcactgcaacctccacctcccgggttcaagtgattctcctgtctcagcctcccgagtagctgggattacaggtgcccgccatcatgcccggctaatttttgtatttttaatagagaaggggtttcaatatgttggctagtctggtctccaacacctgacctcaagtgatccacctgcctcggcctcccaaagtgctgggattacaggcatgagccaccgtgcccagcctggcctattttatttcatgcatatatagtttaagtgtctctgagattcttgatcaactaacaaaatccaagaggcccttttgttatattctaaattcattcctgcttctgattgttgcaaaggggtcagcggatagggtgccagagccagaagttagctaggtggcaggttctgaattaatgtggtattctgggtaatataatgtcatttcctagggaactgccagcatctagctgacctccaagaggacaagtggtcaggaaggtggagatagtattagaactgttattattgttgttgtttttaacaagcagacctgtcatgaaacttgccatagaggtccccttttccatatatcaccaaagcctcataggtaagaaaaggtaaacatccaagattgtttctttaaagattgctgttgggcagaccaagatttagccacaaaaataaacataatctctgatgctgagaagagatcagaatgagttgaaacacaggggaaaaaagaagtaagcagaaaaaaattttacaatagtagatatggggattagatagatagacggctatatagatatataggactctgaatagacccattacaggcaggcatgtaagtggaaatgattaatatatagatgtagacacaggtaattctatataaatgtggaagagcagcaggaagtttctacagctgggaaggaaaaggtaattttttaaaaatgaggtcattacaggttgtttgggtccaggcagattcccattgtcctccctaaacactgcttgtaaacagttttgggactgaatgcaccctttgactgtagtctatgctttacattgactagaactgacaaacagatgaaaagtaaaataatgtttctagagattttctatttggttatgtcatttttttccatggacacatctggctaaagccaaggggtgttaagcccccaaatgtcatttgaatgttcttacagtatgaagaagaggaagaagaaacactttgaaaaccaataattcggccaggcgcagtggctcaatgcctgtaatcccagcactttgggaggccaatgtgggtggatcacctgaggtcaggagttcgagaccagcctggccaacatggtgaaaccccatctctactaaaaatacaaaaagttaggcaggcgtggtgatgcgtgcctgcagtcccagctactcaggaggctgaggcagaagaatcacttgaacttgggaggcagaggttgcagtaagccaaggttgcaccactgcactccagcctgggcaacagagtgagactttgtctcaataagaaaaaaaagaaaaccggtaattctgttttggaactccttgctctgctatggcacatgtatacatatgtaacaaacgtgcacattgtgcatatgtaccctagaacttaaagtgtaataaaatatatatatatatgaaaaaagaaaaagaaaacaacagtgctgattgaggtgtcacacttttgctggttgtctctcctgggtatacctctagcttatcaccgccattctgggaagacaggagcaactgccttttagctgtagtcaccactcatttccctgttagccccttgtggactggaagctccttgaaggagacaaggcaccaagtcacattttacttcatatcccaccaccatgatgtgcctggcacgtaaatgttgaataatctgaacgagtggatccctgaacagtttaataaaatggggtttaaggagactgtgacattcatgaatagcatcacatccaggcttatttctatggctttctattgggctcaatgcctgggtccctggcacatgagaaacaagtatccttgagcagtaggggaaccataccttattcttaccacctcaaaatatctagaactggctgggtgcggtggctcatgcctgtaatcccagcacattgggaggctgaggcgggcagatcacgaggtcaggagatcgagaccatcctggctaacacagtgaaaccctatctctactaaaaatacaaaaaattagccaggcgtggtggcgggtgcctgtagtcccagatactcgggaggctgaggcaggagaatggtgtgaacgtggaggcggagcttgcagtgagctgagatcgcgccactgcactccagcctggcgacagaacgagcctccatctccaaaaaaaaaaaatctagaacctcagcatgaagccatttttaaaatggtgccctatacttagtcaaattcaggcaattcagtttggggaattattttctgtaaatgaggtgctctgaatcagagttctgactccagctttactggctgcctaagtgccatggtttagtgtaatgaaaatacagtggggggtccttaaggcatcattcagggtctacctttaagcgactccagctcttgaacttaatgaactggacactttcaagttctgaacatggtaaataaaagccagcacctgctgccaaaataccttgtctcataatcaaaatcatttctagagccagcggaacatggattccctgagaaattcccactgactcagcaattttaggttgggattttattttagagtcacttaacgaaaagatttcacctagtggcatggccccaatatttatcaggtaactctggccccatctcagcagactgactgattcaatcatcttaccctttactggggatgaaacgaaatgcttactaactcactcctgaccccacctgccactccaagtcattccagcaaacaaatccgtaatagattgctgagagggggaagataggtgaaattggagaatacactaaaaatcaactagttttaaacggtacgggtgggagccatgccccctctgtactggtccactttataaatcccagagggaactcattctatgcttgaaggaaaactttgccttgttctttggttagattgtgctgaacagatcaattcatgtcaaagagcatcaacttttcttatttatgccatggcttccataccacatcacactttatttactcttagtggaaccttgaatcaatgatcaattttgttttgtccttcagtggagtatcagacaccaggacaacctggtcagcaaatattctgaagtcctcagcagttattactagacaggatattagcatatggcacatcatggaattaatttatgtaacacatacttagcatgcacctatcaaatatgtatcaggcacagtgccacggccttaggatggagaagaaaaaacatagttcttgctctcagagagcttagatctagaagttgatagatgctgttttccaagtttctccacttgtatttctgaaactgtgaacagccaactgacatgtagtaagcaatcatttttccagaaaaagtctgttggggtgaaataacatgataagggatctgagaaaagtaggcagggtagggatggcaatggggaagattccgttataaaggaacagcatacatatagattatatcgctgtatatttgtgtctgtgaagcacctcatttaattagatggtatcatggcaactagaagagtgcttacttaaatgagcggctccatgcaaagccctagcagactgaaagtgctttgtaggtattagctgttattattcctactgctcatcactaatatgtagtaggcactccataaaggtttgcgacatgagtgggtgggagatttagtgctgaaatgtaaacctatacataaactgaatatcacatctatatgaatagagaaccttttacagtacaagcaagagcaagatgttcacattatattctgcaaagaatgatctgaacacttaaacttacaggctccgaaagtgtctctctgcccaacatccctatccatttaaatagaaatggcagtagcagcttcctggtgctgctggtgggaagagccgtggtaaggtgtctcctttctttcactccggagcgggggtgatgacaggagagggaccgggcgggagcgaagtgatgatggtgataatgggggtaactgctgagagcgggagggtgggggccaggaacaggaggagtgtgagcgtgagaagacagtgctcagaagccgacacccaggtgacttctctggaatctccctgctctgaaatgggtaacgtggctcctttctctgaagctccaacacttaaaggagcttcttgttttaagcttcttgtgttaagctccagatttttacaagcatctcttcagagcctggtctccaaagccatccgtccagtcagatcaagagctacttgccctgtttctccatagtcacgaactggttaatgtgaggggaaggcaagaatggtctccatcgtcacgggtttctgccttggtttgaagcaagctccagcagttacatgaacaccagttacggaatgtctacagttatgacaagacacagcagggctgacccggctcacccagcaagggaacaaaggccatccacacgtcagacccagcaattcaggtgaaggaacacacagaacctcctagttcgctggatgaggagtcccccaatttcaccagataatcacacaacatgttttcatatggccacatgcccacagcctcaagaaggtgaagcattttcagagaatgattcctgacactacagaaacattgaccatttagaatcagaagaccctcagtcaaggctggcctcacaggaaaatcaaatgtaatgattcccataatgagttcaagccagacaactgaattatgcatctgacattaaaacaactgggggattgtaggaggaggagaagtttgggaagagagaggacagtgtaatcttctgggagtaaaatttattactgaacattaaaaaaagatctgcaagttaagttgagagtcattttgtttatactcgaaatgctacaatgtcctttgatttgtttatgcaagttttaggggacaagttacgtttttttagcatataatctacatttattcccaaaacactgctcctgagacaatccatcagatatttcctcaaggctgtggaaaaggggataaaaggcatatttttaaaggtgggcgtgtatgtgcaaaacatgtttgttttaaagagatctgaatgctgtagaaataattagccatgtgcgtgaacgaaaataatgaataccaaatggtacaatgtcctgcttgaatcctgtttcagaaacagaatgtgaaggaaacattacgttctctcatccctctcttttctctttcacccttgttacccctgaattttgtaataatcactattacccttttggctatgaatttaatgtctctatatatagagccacacccctaacacagattcttcttgcctctcagagacagttaaatgtctttgggtattgcactacttattctccataggggctcagacatattcactattgagcattttcattagctaaaataaattaaatgtatgtcgtaaatgtgcagcaacactgaagaagctgcgagctacatcttgtccttgggagtcatttacttagaataagtaaagactttctcacttgctagtttcaggcgtcttaccttgtgttattccttacaaatggacagggctgttctagaacccacttcctgaatacagggaaagaccccagtggtgtattgggataatggagacagacaggtctgaatgtgaggtgtggacgtgggcttgtgtgtgtgttttctccactggatttcttcaaacctaaagttgctggatcacatttctaacaacaatttgcctgaccttataggatctcctttctcactgaatatgttacgattagaggaactaagattggctaaaggacttttggaatgagccctggacttaaaaacccgttgaagagggagcaaacaagaggaacagtgttttccaagaggcttacttctcttaaattgaaatatagtcatgttccctggctctgagggcactttctcagagcccatatgtttattcaagcatttgcttcgtgatgtgggaggctcagccagtgtaatcccaggcatgagatgttcaaatgctgaatatgttattcaagcacattatttcccattgacatatgtaaatttaaaaataaaataataatgcaaatttacatattgaatcttgggaatggaaaacacatttccgatgtcactgggtatatctgttcccctactttaaaataggactatagagctgttctctttgaagtcatctctgaccatacagtttaatccagtgggcattaattcagattctgggttagtgtcttgtagaagctctccggtgcttctaatattcagcagatattgagaacccatggtctaatccaatggccattcttagtctttctgtttctctgctgcatttaatataattgatgtcttaattttcttctgtcttttttatttttattttttacgtccataggttttgggggaacaggtggtgtttggttacatgaataagttcttcggtggtgatttctgagattttcggtgcagccatcacccgagcactatacactgtacccattttgtagtcatttatccctcacccccctcccaccctttctcccaagtccccaaagtccactgtatcattgtgaggcctttgcatcctcatggcttggctcccacttatgcgtgagaacatactgttataggatctctggggtgtcaatttttctgatgggaaacttctgtggccgcaacgccttttaagcccaagtttttgtcctgcgtccagaaagaatgaggtacacagacatgtgaagggtgaaaaagaagagttttatttagtgttagaacaactcggaggagtggggagctcctctctataagcagatcgtcccattgagtgttcagctctcagcagagaggaggccctggaaagggtggctcctctctgcaggcaagtcattctgcaggtctctgaagcactcctcttagcagagagggtagctcctctctgccagcaggtcatctctgcagctggttgtcccatcgtctccagctatcagcagagagggtactcctctctgcaactggtcatccagtcccattctctctctgccccctttgtccctggccatcctcctgcctgctgtggctaagcccagggcttttatggacctcagaggggaggaagtatgtgccaattggtccatgggtggccatgggtggacggaagaggcaccacgagtccccactctggtcggcaggactggcagcccggcccccagccttcaggccctccctcgcctgaaggtggggcctaattggggactcccctcttttctgccccggaccctgtcttcctcctgctgccattcatggccccggggcttggccccaacccagctctgagatctgagtgggtgcctggaacggagagaggccaggcagtgggcgcagacacatctgagcatgcagagatggggagggtccttcctggggcgcccaagggtgcaggctgcagagacgcccaggtcctgtgcctgggagggttggccacagctgcacccgggagctcccgccctgacaactcggaaggggcagggctcccgcttgttcctggctcctgcctgcttcctggaatgggaggcccaggtctgcagccgtgggtgcggcagctgcagctgcacctgggaaggcagatcctgcctgttccaggctcccccaagagcacagggagactcggatctacagctgcagtttgggtggctgtggccccaagagggcggggctcctgcttgctctgtggagcaggaggcctgggtctgcagctgcagttcaggtggctgcagtggcacgcggagctcccatcccaactcggaatgaacagggctgccaccagctccatggagtatgcagcaccagccgcgcagccagcttgatggcagcagccactgccatcattacggtgttcagttttccattcctgagttacttcacttagaataatggtatccagttccaaacaggttgctgtgaatgctattattttgttcctttttatggctgagtagtattctgtgatatatacatacaataatttatccactcattgattgatgggcatttgggctggttccatatttctgcaattgcgaattgtgctgctgtaaacatgcatgtgcaagtatctttttcataagacgtctcctctgggtagatacccagtagtgggattgttggatcaaatggtagttctactttaagttctttaaggaatctccacactgttttccatagtggttgtattagtctacattcccaccagcaatgtaaaagtgttcccgtttcaccacatccccatcaatatctatcattttttttattatggccatttttgcatcttcgcccttcttgactacttttcctctctctaaccaaaattatggtaggtgtttgctcttcttgccttttgattgcctttcttggatatttctcccagtgtcagcttccctcccgggtactggtgctgcttctgtcaccccgttcccttacctactcttggtcctttcaggagagttcctgtatgtttatcttagagccacgtaaagctaaatgggtcttactatctttattaacgagctttattatctgcccctcctctagcttagcactctgtccattctgtgtatcttattgcagttgtacctttcctattcccacctgagagctcccactcctttggttcaacccagcttccatcaatcattcctcgagccttgccaattttttgtctctcttccatgtttattgtcgctacctgagtctagaccctctgggaactgagctgattggattgcagtcttctgcacggggagccatggtgtagagtggaaagtgtaatggatgtggagttagaaagatcaaattctggactcggttaagcatttaattaaaatgtcttggccaggcatggtggctcacacctgtaatcccagcactttgggaggccgatgtgggtggatcatttgaggtcaggagtttgagaccagcctgaccaacatggtgaaatctcgcctctaccaaaaatacaaaaattagccgggcatggtggcgggcacctgtagtcccagctactcaggaggctgaggcagaagaaccgcttgaacccgggaggcagaggttgcagtgagccggggtcacgccactgcactccagcctgggtgacagagtgagactgcgtctcaaaaagcaaaaaaaaataaaataaaataaataaaataaaataaaataaaataaaaaataataaaataaaaataaaaatgtctcaaacccataggaccttagtagtgcatatttgtctctaggcctgtttcgccacctataaaataagctgcattttataaatggaataactataaatgaatataaatcgatgtggaatttgcataaattccatatagatttgggtttcttggccttatgctgaaaccagcatttgagactgttggtgaaaagaatataaagaggtggtgtggtgtacatattactgtccgtattatggtctgattgtcaccacagtcctccatattagctttttatatgacccctgctttcccaatctagatctccagaatttttttggtgttttttgaatataatcaaaagtttgttttgctcaagattcatcttcctaaaaatgtttgacaaatgcctaatttgaaaattagtttgctgtcttcaagcttctcttaggaaagaaacgtggtccaaaagaagtttgtctagtatgcagggatttttaaaaactggataacccagggtggtctgcataagttatatgcttttcccccaaagaatttcaaacggctttcctggtatcatttgtccttatgtttctttagttccaggacagttcatactgttcttggcagcttacaaaatgagaaactgaggtattgtaattcagtctacttcccttccaaggaaaattgaaaaacactgtggggaaaatactaacaattatgtgagcctcaactttagattctgaaaaatttattcatggaaagcaaaaattcattactattcccataacattgccaacagcaaagagattatattcagaattaaatacagccctgttccatttcttctttgctttgaaactcagtgtgagacagcagtggaaccttttctgacttaaggccaaattaggtcaaaaacctttgctttgaaccttctgagtcatagaataagcagggaggaggaagaaaatccgtgacctgtgccacgattttttactgaggttttgtgcaaagagtgccgtgggcaggaaatgtaggaagaagagaggacatcacttcttcagtgtttccctgtatgtccagagataggaaattcagacatttgctttatttgctaaacttcacagatgtgagcaagaggaatattagaggcaatgtgtctaaattacttacttcgatgtaatgacttcagagctctcaggaggagaatggtcgcggggaaggaacgagcccaaccaatggcatgcccagagtcagcccttcatctgcagttttaagaagtggtggttggagcaagacgtgtttgcagttacaggaataagcaggagagggcagctcaagttgcccatcaaaagggtgggtgaggggctgggcgtggtgcctcacgcctgtaatcccagcactttgggaggccaaggcgggtggatcacctgaggtcaggaattcaagaccagccttgccaatacggtgaaaccccgtctctactaaaaatagaaaaaaattagccgggcgtggtggcgcatgcctataatcccagctactcaggaggctgaggcaggagaattgtttgaacctgggaggcagaggttgcagtgagccgagatcgtgccacttcacaccggcctgggcgacagagcgagactccgtctcaaaaaagaaaaaaaaaaaagggtgggtgagtattcctgcaggaaggggaagattgagcagagaaaaatgtcatccctttcttatccatggggcttctcctcccccaccaagctcatccatcagggtcgacactgctcttgtttgtgtcttcgcttagaagagcctgctagaagagtggcagatgagtcacctgtcactaaaagtaggtgttcttagtgctggggaaaatggaaggtggcagcaaattcctgctgcagttttccgtaaaattggattaccactactggttttaggtgcccctggttttaggtgctctgtatgtaagtttgtgcaaaagtacagcggcatctgtgggcatccaagctgggttctgctctcagcaaactgaagcaagcccaggccagtccaagggaagatggctgtggaccttccttctgttttatgcagcctagtttgaggcagttcaactgccccagagttaaacagttcaccatacataatagaggacttcgtaattaaaataaatacctctccaccaagagaggagaaaaagaaagatgtgcacagtgtgatgcagaaatgcaaggtgccctaaagtcaaatatgttacaggacacagtgtgcagctgtcagggcctctggccagtctccagctatgctggaggtattttctgtgctctgaccataggctacaagaccacatggctgctgctccactctgtagagtttcttgcatatcagaaaatctgagacctgacatttgtgatgaatatttcttgtacccatcacaaatcagaagaacaacccagagaggatgtcaggcacctgttggtctttcctcttgatctacttgttgcctccaagcaactaaggttctttttagagctctcacccctcaaagtgtagataattatattatcctctaaatatctaaaaactttgtttaaaaggactcgattttgttttctgggaaaagcttggtttaatacaaacaaattccatgtgtaacccagctttataaaatagaagggtccgagtgcggtggctgtaatccccacactttgggaggctgaggcaggtagatcaggaggtcaggagattgagaccatcctggctaacacagtgaaatcccgtctctactaaaaatacaaaaaattagccaggcatggtggcgcacacctgtagtcccagctactagagaggctgaggcaggagaatcgcttgaacccaggaggcagaggttgcagtgagccgagattgcaccactgcactccagcctgggcgacagagcgagactccatctcaaaaaaaaaaataagtgaaataagatagaaggaagggggtctggctttattgtggagggcactgttttagggaggtacatacatgaatatgttcctccgtcagggaactgagggtccactgcactgattctcaaccatggctgcacattgaaatcactgatacccactccgaccctataggttctgagttcagtggcctggagtgtggtgtgaccggcaagacttttcaaaatctttccaggtgattctcctgtgctgccaaggttaagaagcacaggtctagtgtagtagttccccaacctagctgccaatcagaatcaccaaaagagatttttaaaatacagattcctaggtcccagcccagacctacacaatcttgggaaactacagaggatgtgtatttttacagcatcacatgtatttctgattatcgactcaggggaccctcactgtaatgtcctcatgcacgattgtgatcttaaagcataatgcctgtagcagtttttatttatttattctcgtagacgaagctgtttttcactgcttcaagtttaatggccaagtgtgtttgtaattgtggttttttgttttttgctttttttgagacaaggtcttgctctgtcgtccaggctggagtgcagtggtgcaatctcagctcattgcaacctccgcctcccaggttcaagtgattctcatgcctcagcctcctgagtagcagggattacaggcacaagccaccatgcctggctaatttttgtagttttagtagagacgggggttttggcatgttggccaggctggtctcgaactcctgaccccaagatccgcccacctcagcctcccaaagtgctgggactacaggtgtgagccaccatgccgggcctcctgtaattgcttgttaagagaatcagacacctttctgaagccactaaccaaccagcagcattccccattctatgagcgcttttcctttctgctttcttggcacatttctgtcatagacctcgttctcagccttgttgagacacctcctttagtttagtgtggagtattttcctagaacaccgcagccagacgtcccccgttatccgcaggttgatttctgaggccaactgcagactgaaagtatgaaatggaaaattccagaaataaacagttcctaagttttaagttgcgtgctgttctcagtagcatgataaaatctcacgccttaccccatcctaacgcagacgtgaatcgtccctttctccagcttgtccgctgcgcagcgctccccgccggtgagtcacctagcggccatcttggtgcttagatccactgtggtgggatggaagtgcttgtgttcaagtcacctttattttacttaatgatggtcccaaagcacttagtgatgctggcatactgttacaatcgttctattttattattagctattatcattaatctcatactgtgcctaatgtataaatcaaactttatcgtaggtatgtatatataggaaaaaaacatagcgtacatagggtttggtactatccagtgggtttcaggaacccactgggggtcttggaacctattcctcatggataaggcggggactattgtactgaaatctgacaataactctgccatgatgcttcttttgagccacaaagggagccctcgatgtgccttgctgtggtcatttcctttaaattcccttgctgtgatcatttccttccatccagcccagcctgagatgtggagactaccagacagagcctcgtgtgatgctctgtcggcttgagtgtgaggaagcttgtaaatccatgcgttttgttaaaacattatcttctacagtgtcattgagggaagtttcaaatcagctgtgaaagaaaacaaaacccacccatctaaggcattactcatgcctggctgttcctggcttgcattagactccctggctggtcccttcaggctctccgttgagagctttctgtgaagttctttgtatattttcccaaatatgtttattatgggttcattttatcttctacgttggaaacgttatagattgagactcagtcactgccttattgctgcttttcatcatcccacccaccatcccttgggttaaccagagcaaaatagaagcaaactatattattcgcgaaactatagcagggaaaaagatccaagtttctggaacgtgtcctgatgaaaaaataagagtgcatcagatgtggagataaaatgtctcaatgttgaagggatgcatttatctacttaacactcagatgtttttctgatggaagcctctgcttatttatattttagcaaaggccaaactaacctgttctaagaaataatctcatactgaaagagagacctcacttcccatttcccaatccaaagtaaatgctgtgaaagaccaggaatgtagtaccgtcagcacacatctgggactgtttgtagcctacgttctgaaatcaggggatgctgacaggctcaagctgcgatactgaaaggaggcctggtttcccttctgttggaattacattacaaggagaaatattgatccagcatactcaagaatgggctgggtgtggtagctcatgcctgttatcccaacactttgggaggctgagacaggcagatctcttgagcccaagagttcaagacaagcctggacaacatggtgaaaccccgtctctacaaaaactacaaaaattagctgggcgtggtggcatgcgcctgtagtcccagcaactcaagaggcagaggtgggtggatggcttgagcctgggaggtcgaagctacagtgagccaagattgggccactgcactccagcctgtatgacagagtgagaccttgtttcaaaaaaaaaaaaaaaccctgaaattaaaaaaacattcactgggggaaaaattggtttcttagtagaagaataccagcaaaactcaaaatgaaaatggaaatgctctgctgccaatcaggaaaagactgaaaatcttggcagaattctgctggaatcctctgcccatttccttcatgttctcataattataaaagaaaaagaaatgaacattgataaagttcctgctgaataagagaagttttttctacctcacatttgttgaatgcatctcatttagtcatcaccctaaccctgtagggtacgtgttattatctccattttctttattttttgagacagggtcttgttctgtctcccaggttggagtgcagtgccgcgatctcagctcaatgcagctttgatctcccaggctaggctcaagcaatcctcccacctcagcctcccaagttgctgggactgcaagcatgcaccaccacacctgcctaaatttttttattattttgtagagacaggcctcactttgttacccaggctggtctcgaattcctggcctcacatagtcctcctgcctcggcctcctgaagtgctgggattacaggtgtgagccaccacacccagccaattcccattttaaaatgaggaaaccaaggcttgggttcggtgatttgctgtgactgaaaatccttccctccccacaaatagggacaccactatcagatatcacatagatcatttcccaggagccaagggcaaagggcagacccgtctttggccaaagccaaattctttcctacacagtaaatatgggaaaaagagagacttcaagcttcaccccaagagttgagacattttgaagaaagactgacacaattaggggagtcgctggatataggagtgaagtgcgagagaggtatcaaatatcaggctctggcctatgcttggagaaatggtgcaaaaccgttagcagaaatatggaaccggagtgcatgctgatttgagaggggtggtaagcatccaagtggaaattcctcacagactcttgagctgagactgaagttcaggaagaagaacacacctggattttttttcttatgctaggcattatagttgcttttatttcatctcaacaatcttttgaaaacgtattatcatcattcacatattccagatgaggaaactgaggcttacagaggttaactgcatcttccacgtccacagtgctagtatagaaaatgagctttgttgtaaacaggagactgccttactttttttgcatttccgcttgtccattaaatattttattgcctgtttagattacagtcattggtgcctacagcagcattatttatctttcattgggaattagggccttaaattaaatcgttagtcatattttatgtttttataatgttgtagagattctagttagggcatggtattctaaaaaggaaaagcattgatttaatttataatgaataattgtatctaaacagtgtactatgtgttctgcgttcaaataagccagaaagcttctatttataccaaaggaataaacagcaaacaacagacatacttaaattgaaaacatgagcacatttgaattttatttttgaatgtagatgtaattgaccatttgttctgcaaacaaggctttggtccagtttagggggaaaaaaaaatcagtgcactagtgtggagtattttctaaaagaagacaattttagagacttagtaaactttctgaaccggtaagacttgaaatgcctcatgaagggaagtgaggcagggaaacttttaatgagagattattccattcaccatctttgctggagctgactggtgtctatgatgcaggaagtaacctgagaaagaattctagggaggaaaatgtgttttttttttttctttctttcttttttgagacacagtctcgctctgtcaccaggctggagtgcagtggcatgatctcagctcactgcaacctctgcctcccgggttcaagtgattcttctgcctcagcctcccgagtagctggaactacaggcacgtgccaccatgcccagctaatttttgtatttttagtagaaacaagatgtcaccatgttggccaggatggtctcgatctcttcatctcgtgatccaccagcctcagcctcccaaagtgctgggattacaggcgtgagccaccatgcccagcctgaaaatgtgatttttttatgcagatgaaaataggaccacagtgaaggaggtagagaagagggcctttcttagaaaataatcggaacaaccacagccagtaattgtaggtcttgagtacgccaggccctcatctaaattcttcttatgtgtgaactcacagcaagcctgtggggtaggaactagtattattcccactttggagatgagcaaactgaggcacagagaaatgaattagttaggcctggttagtacttagatcagagaaattaattaacttgcatcagatatacacagctgaggagtaaggccaccaggattccaaatcaggtggcctagatcccaggcctgtgctgtttgctgcagcagtcataggaggtagtttgaactggaaagcagttcatcatgagaggtagcattttttgaggcactactgcctgcttgcatgctaggcactgaattgtcccatgcaattctcataacaacttcatgaaataaggcgtattactatcttcatttttttttttctaaggcagagtttcactcctgtcgcccaggctagagtgcaatggtacaatcttggttcgctgcaacctccacctcgcgggttcaagtgattcttctgcctcagcctccctggaattacaggcactcaccaccaagcccggctaattttttttgtatttttagtagagacggggctttgccacattgaccaggctggtctcgaactctggatctcacatgatctgccccccctcggcctctgaaagtgctgggattatatgtgtgagccaccgtgcctcgccatactatcttcattttcttaaagaggaaatcaaagcttagaaagttgaatgggcccggtgctgtggctcatatctgtaattctaacactatggaaagccaaaatgggaggatcgcttaagcccaggagtttgagaccagcctgcacagcgtgatgaaaccctatctgaataaaaaagtttaaaatgtagctagatgtggcggcacaagtctgtaatcccagctactaaggaagctgaggatcacttgagcacagggaggtcgaggctacagtaaactatggttgtgctactgtgtccagaattaggtgcgttcttggtctcactgacttcaagaattaagccgtggacccttgcggtgagtgttacagttcttaaagcggcatgtctggagttgttcattcctccctgtgggttcatggtctcactggcttcaggaatgaagctgcagacctttccggtgagtgttatagctcatacaggcagtatagatccaaagagtgaacagcagcagcaagatttattgcaaagacaaaaagaacaaagcttccacagtgtggaaagggatcggagaaggttaccactgctggctcgggcagcctgcttttattctcttatctggccctacccatgttctgctgattggtccattttacagagagcccagtggtctgttttgacagggtactgattggtgcatttacaatccctgagctagacacaaaggttctccagggccccactagattagctaaataaagagtgtcgacacaaaggttctccaagtccccaccagagtagctagatacagagtgtggattggtgcattcacaaaccctgagctagacacagggtgctgattggtgtgtttacaaaccttgagctagatacagagtgccgattggtgtatttacaatcccttagctagacataaaggttctccaagtccccaccagagtagctagttacagagtgtggattggtgcattcacaaaccctgagctagacacagggtgctgattggtgtgtttacaaaccttgagctagatatagagtgctgattggtgtatttaaaatcccttagctagacataaaggttctccaaggccccaccagactcaggagcccagctggcttcacctagtggatcttcacagaggcagtaggtggagctgcctgccagtgccgtgcgcccgcactcctcagtccttgggtggtcgatgggactgggcgctgtggagcagggggcggcgctcgtcggggaggctctggctgcacaggagcccacggaggggcagggggaggttcaggcatggcgggctgcaggtcccgagccctgcccgccagaaggcagctaaggcctggcgagaaattgagcacagcggctgctggcccaactgctaagcccctcactgccctagggccggcggggtccgccgctgctccgagtgcggggcccacggagcccacagccacctggaacgcgcgctggcccacaagcaacgcgcgcagcccgggttcccacccacgcctctccttccacacctccgcgcaagctgagggagccggctctggccttggccagcccagaaagaggtcccacagtgcagcggcggggtgaagggctcctcaagagccgccaaagtgggagcccaggcagaggaggcgcagagagcaagtgagggctgtgagggctgccagtatgctgtcacctctcactacactccagcctgggtgacagagtgagacccggcgacaaaaaagagggagagaaaattgaaagactttcctaaagtcacgagttatcaaatgccagttagcccggtctaacatgacactgaatcaactatgtgcttcctgctcaggagtcagaacgatattatcaagtgttaatgcttctaaatgcaaagagggagcaaggtgtttcttctctttagtctgtgaccagcagctgctcactataacctctcttccactgcatgtccaaggattactgcatagaggaggattcccatcttcccagcccctaaatttaaaaataaattaaataggctgagcgtggtggctcagggctgtaatcccaagcggtggctcactcccactttgggaggccgagatgggcggatcacctgaggtcaggagtttgagaccagcctggccaacatgatataaccctgtctgaaaaaagtacaaaaactagccaggcatggtggcaggcgcctgtaatcccagctactcaggaggctgaggcatgagaatcgcttgaacccaggaggcggaggttgcagtgagctgggatcacgtgactgcgctccagctctggctactgtctcaaaataaataaataaataaataattaaaagaatatagaaccgccctcacacttcctgccggatgcagtcaatttgacagtgtgcctcattcagagggtgttgcctacatccagggagtgtcaatttttttttattgaatgaatacctgattaagttaatgacgctgagctgggggaggaggagcagtttggcagcccaatgctgaagggcttctggcagctcattcagtgtccttaatgttccattggctttgtgctgggccgcatgtgagccccaggagaggctgctgtaattactcagcttttttattgaaaacagctgcaggtagcgagtcatcccattgtccatcttgctagtgactggaaacaactcggggccatcttgggctccactacactgcagcctcattctgaagtcagtggaggtagaaagtaggcttcccacttgctgggcttttcaaaatgagccattcatcttttgagggtcagaagtcagccacccattcaccgagtgtgagtcatacccctaattttaaaacaaacatttattgcagagagaattcttatcttggccgatgtgtacagctgatctccttgtccttcctacgattgatttaggctggtttcaacaaaattgttgtctttgtaaatacacacctcttccagtaaatccagagactaccgaggtgtttccttgagattgagcctaagacaatctttaattagttttggataattggatatgaatgtttagaggccttcccatatagcaagtgtctttaacatctcacacaatatattatacttgtacttcctgacccgagaagtaacaggagttaataatctcacgtgagaaagtatgtttgaaatggaatctcaaggggcagattctttgcagataccacaacattattttatgtccctccgtaatgagttcagttttttatcatcacatccaaaatctagaaaatgatccagaaatcctttgccttttaataaccagcttgtaaggaagacaaactgcaagagatggacacaagataagaacagtaaccaaccaaggacggacagcaccctagaaacccaaggggttgtgaacttcagtctctaagcagcatcggagtttacggtctaatgacgaaaacacgtgaaaacaaggattgcagcagccggaagtggctttgctgagagtttaggaatgattgcctaaggaagtagcagttaggggacccactgtattagtcagggttctctagacagacaggactaataggatagatgtatatatgaaggggagtttattaaggaatattgactcacatgatcaaaaggtcaagtcctacaataggccacctgcaagctgaggagcaaggaagccagtggttgaccagtctgagtcccaagacctcaaaagtagggaagccgacagtgcagccttcagcctgtggccaaaggcccaagagccctggccaaccattagtgtaggtccaagagtccaaaagctgaagaacttcaagtcgggtgttcgagggcaggaagcatccagcacgagaaaaagatgaaggccagaagactcagccagtctagtccttctacgttcttctgcctgctttcattctagcctcactggcagctgattagattgtgcccacccagattgagggtgggtcttcctctccaagcccatgacccaaatgtttatctcctttggcaacaccctcacagacacaaccaagaataatactttgcatccttcaatccaatcaagttgacactcagtattaaccatcatgcccaccatggtgaaggcatgcgggggtggctggtgttagactaattggagccttggaggatagtcgaggaaacggttcctgaacggtgtgtggatgagaatgttggagcagggtgctaaggaggcacagaggagaggcagagggtatggggttggagtggggagagccttaaggaggtgacatggaaggagagacctgaaagatgggtgaggccagtgcttctggaagtgtggttcctggaccagcagcatcagcagcatctgggaactccgggtgaatgtgatgcgcacgctcgagtataagaaccactgcattagaaaacaggtgacagtgccttgcggaggagcggtggctggtgtggaaagtactctaacagagcagagggaacacatacccagaggcctgcagcaggcatatttgaggcttgatcaggacacagccacccacacccactggttacaaattatctgtggttgctttcagcctgcagaggtagagctgagtaatggccacagaggtgtatggcccgcaaagccacacgatttactaggtggccgcgcatcgtcaaggttttccagtccctgattcagagggtggaactgacataacctgatgacagaatcaggggagaagaggcatacagggatatcggccagctttcagtcttcagtgagcaatgacatgatagagcagtgacactaagatactgctgcctcactttttacagctcacagtcccctttgcggatgtgagaaagggcatacagctttaagggcttaaaggatgccctgacgtccagtcctggaatacaggctaatgccagcaggtatctcagagatccttgtagctccaagcagatgagggagcggggcgctgtgtggtttcaaaacagaaatgcagtttgttcacaaacttttaagatcatgacatatttatttatttatttatttgagacagagtctcgctctgtcacccaggctggagtgcagtggtgcgatctcagctcactgcaagcctgcctcccaggttcacgccattctcctgtctcagcctctcgagtagctgggactacacgtgcccaccaccacgcccggctaattttttctattttttagtagagacagggtttcaccgtgttagccaggatggtcttgatctcctgaccttgtgatctgcgcgcctcagcctcccaaagtgctgggattacaggcgtgagccaacgcgcccagccatgacatacttatttttaaaaatttttgactggtgacaaaatatgcataatatgaaatttaccatcttaatcatttttacgtgcacggttaagtggcacattcttgttcaaccatcaccaccatctgtctccagaatgtttccatcataccaaactgaaattctggaaccgttaaacaactcccattgccccgtcctcccagctcctgctaacgcctgttctacgctctctccaaatttgactattctagattcctcatagaaggggaatcatatgatattgttcttttgtgtctggcttctttcacttagcataatgtttgaagatttatcaatgtcatagcatgtaacagaatgtcattcctttgtaaggagagggggatgaataatagctcgtcataaggatataccacatttttaaagtttattcatctgttgatgatcattgggttgttgacaccttttggctcgtgtgcacaatgctgctatgaacacgggtgtggaatatctgagtccctgctttcagtgctttgtggtagatatccagacgtggaattgctgagtcatgtggtaattctgtatttcacattttgaggaactgccaaaatgttttccatgcagctgcatcattttacgttcccaccaacgatgcacataggttctcgtttccccatctccaccaacacttgctattttccatttttgttttgtttttttttttaaaaaaaagaatataatgtccatcttaatgagtgtgaagtggtgtctcattgtggacatagcatataattttaagtatgattaaaggaggttagaacacgacttttgtgttggcaaagtggggaaaaggattggctgctgtaattaaaatcactgagacaggccgggctcagtggctcacgcctgtaatcccagcacgttgggaggccaaggtaggtggatcgctcaggtcaggagtttgagaccagcctggccaacatggtaaaaccccgtctctaccaaaaataaaaataaaaataacatagccaggtgtggtggcaggcacctgtaatcccaactacttgggaggctgaggcaggagaatcacttgaacctgggaggtgcagtgagccgagactgcacccattgcacaccagcctgggtgacagagcgagactccgtctcaaaaaaaaaaaaaaaaaaaaaatcactgagacatactgccaaggacagatggagttagggggcttaaagatcctctataccagccgggtgcggtggctcacgcctataatcccagtactttgggaggccgaggcaggcagatcaagaggtcaggagatcaagaccatcctggctaacacggtgaaaccccatctctactaaaaatacaaaaaaattagccaggcgtggtggtgggtgcctgtagtcccagccactcgggaggctgaggcaggagaatggtgtgaacccgggaggtggagcttgcagtgagccgagatcacgccactgcattccagcctgggggacagagcgagactctgtctcaaaaaaaaaaaaaaaaaaaaaatcctctataccagaggttctcacctctggctgcaaattagaatcccctggtgcatttcctaaaatgccagtggtggtcccaacatctagggattcttattcagttggtctggggtagatctggacattatgtttttaaaagctccctgggtgagtctgatgtgccgtcagcattgatttcttattctgcaggtgagagagtatggccctagtactaaggctgcaagggttctggtctctcagccagagctgctgccactgatacaccattattcagcatgaccacaaacacagtgaaaccagtagtgtcccaggtacatgtgcatcctcctttgtattgtggaggaaatatgtccccaaaatctgcagagccaagtgcgggagccaactcctccatttggtctgttgggatgttcagtattctatggtagatttctagtaagtcaatttcactcagtgggctgaggatattaagacaccggaagttagctgatgtgttcccccattgctccaacactttgaactctgtaccccaaaaattgatccactcagtgcttcttacatgtatgtgccattggggagatttccacagggaggctttctctgagcctttggccctggtgacattacactgagtaatatatatccctgttcctttctgtaccacccatctgcctgttccctggccacagtttggggtataccaatttagattaacctaattattgtttcacaaggcattcttatcactgaacgctgatggatgttacttcaacgttgttatattttattacttggcctatttaagtgtataaccatcactagctataagaaggtgaccaactacaacgttagagagagcagtgcctgcaccacgaattgcaagttcagggggtttcccagaccaccctccgttttgataattcagtaaaaggactcacagaactcactgaaagctgttctactcatacttattacagggaaaggatacaagttaaacttagccagggtaagaggcatataggagaggtctagaggggtccagacatggggcttctgttgccctctgcccatgaagtgatgaacagcattacctcctcccagccatgatgtgaagaatcaccaaccagggaagctcacgcgaacctcagcatctagagtttttattggagctcaattgctactgtcctcatgactgacctctagtccctaggccctcctggagatcaggcaaatatctttcattattagttcctctgaggttggaacgtatacctcatggcccaaagcccccatcataaatcacattgttactccatccagtggccaataaacatacttctgtgaggcaggacattccagaggccgagagatcacctccccacaggtgggggcaaaggccagacctgagtttgggtgaggttaaattcttcatggtcaggcgcggtggctcatacctgtaatcccagcactttgggaggccgaggtgggcagaccgcgaagtcaagagatcgagaccatcctggccaacatggtgaaaccctgtctctactaaaaatacaaaaattagctgggcatggtggcatgcgcctgtagtcccagcttcttggaaggctgaggcaggagaatcgcttgaacccaggaggcagaggttgcagtgagccgagatcacgccactgcactacagcatggtgacagagtgagactccgtctcaaaaaagaaaaaaaattcttcactacacactaatgacccactacacaacccaagaactagatcccaagttttcatattaggattttttgtgtgttgtttctgcccttttttagccatgtaatcttaggcaagtgacttacactctgagcttcaatgtccttgtctttgaaatggggtgatcatatgctagttgttatttatatgtaaagcattgctgtagcctgcacaaattaagcatcgtgacttgtcctgcctgctgtgccttagagagcctgggtcccgggaggtcttggggtctttgcagttgagagcattgaattgtgcagtgtctcagtgactgaaaccaccatagaaggtaagccagtgtgtgacacctggaggaacagctggttagtttatgaattatctggaggcattggctttgctttcattcagccacaccaaggacagtgaatagttttaagactctcccagagtacctcagttcccacgagacctttttcctgacttgatggagagttttatgttctctgttgtagactggggctgtctaatgtcctggaaacccagccccctggtggctggcaggatccagcctaggcctcctggagcagttgctggcgctttgcatcgtgttgtgtggtgaagctcgtgagtgtgtgtgcgggtagacagctggcagccttccctgcgggatgtggaaggaggattctgcatttccccaccatgcgtcttgggaattactcatccaaaaagtattgtggaaaagcaggcagagtgaaacacggaggcattgcacttaacccttccctggaaatgccatccttgagtttagcgtctgagctttctgtttattctgcttgtgtgctgaattgccttccttcttgttggtgtgcataggggtctgcacattgggcacttataaatattatcccacctatcaagtgaagaaaaaaatgaactctcaaacacccatcacttcctctttttctatcacagatgtgaggaaaaaacagatgtttgaaagaattgatagtttgaaggtgttgtattgattacatcatggccaggagagatgagcaacagataagtgtgggtgatcactgagaattcatgaggaaatgtttattgaattataactacgatggcgaccatgtactgagtgtgtgttatactaggcactgtgcatgttaattcttccccattttaaaggcagagattacaactttacacattgttgaaatgaaatttttgcctcattaaacttgggcacatgtataatcgcaagtaaaattaaaattattattttgagatggagtctcgctctgtcgcccaggctggagtgcagtggtgtgatctcggctcactgcaacctccgcctcctgggttcaagcgattctcctgccttagcctccctcgtagctgggactacaggcgcctgccaccacgcctggctcattttttgtatttttagtagagacaggatttcactgtgttatccaggatggtctcaatctcctgacctcgcaatccgcccgcctcagcctcctaaagtgctgggtttgcaggcatgagccaccacgcccggccaaaattatatttttaaaaatggataacataggtggtttggggtaaagccaaggtttgaacctgttctctaccttacggcgtagcccactctaactacaattctgtgtgtccttagtagtaatagcagtggaatattattgatctattatcatcattgttagtaataataatattaatatttatcttgatattctaaataggacagtggatgtgaatgcttcatgcatcgggtagtgagatctatcacagtggtggtaagaaacattcaagtgagagtcaaagtgacaggttctcatcctcctgaccccagttcttactgtgttaccttggccaatacttttcatcttcttgcatcagtccttgaaataagataatgaagagggctcacttcctctcactttgaaacaagttagtctggactgggatgagaaccactaactccaggcagcgtggaaagcatctgtgtaactgttcccagccttcaaccagagtggtggataaacagaaacgtgggtgcccccgggtagctaacctggaatgcactacgctttaaagcaaaaaagtatttgcttctgtattgaatcaggaaaggtcttgacagaaaggcatttccagcttttcttaaaaactccaactcaacctctgtcagacaattcatttgggaccagcttggatccagatggttatttttccatcttgagcctttccaggaattccggcatgggcaggccgccagagacactggctacacagccactgcagcgcgttttccatgtgagccggcttctagggatggcccagccaagctgtggccccgcccctcctccttcctcatccaggctgatcctccagctctcacggacatgtgccatgagccacgcagggggaccccagccacatggccgatgtcctgatgtttccaggggtggcagagctcactaactgcacccccagaactgtcatctgctcactacgaatagcaatggcagaagccaggaatctaagaattgatgaagcctggccctccattatgtggacaggtagtagcaaatcactcagccccacttagggataagggagacagcaacttaaccacgtgccaagcagacaagttcagcagaatggcagccagtgcagctgtgtgtcttgaggaattctttccagcctccccttcaaggcccttaatcaaagaacaactccccactggacgcagagctacccaagccagcgaccacccgaatgagactattattttgggtggatttaaattttttaatcattgcttcaagtatagtcgtatccattgcccaaaaagtctatagatgcatggggtcaaaaaacactactattcgtggtgctgataatataagtagtggggctgcttttctcctgcctttgcttgacccactgcagtcccagctggcagtggtagtggcagattcccctgacccaaccacccccaggaaggtcttgcctcaaagaaaaggaaaatgtggtgtgtgctgctggctgccacggactcaggggagcctgtgccaggttgcaggcttgaacttgcttcttgtgacactagagggagagagcttgtttcaaaagcatgttagtgctctcagttcctcacgtccgacctgtgccagaggctccttctgcagtctcaccactcctatggcctggatcacaattgggtgggtggtcttgaacttggctgctgagcctgaggtcccctgcttgcttgcctgggaaatacaaacatcctgacctctcttccttggtcactgatcagtctcttccttactgaacgtctcaccagctgcagttcttgattagtcaacatggtgcagaggtcccctagacatcttttcccctacttatccctgtgcattctgtcccttttctacatgaaaaataaataggcatatttgctatgaggctgccatcgccatagccaggaggtgagtgtaacccgcatcatggttgggtagactaagaaagtgatttccagtgctagttctacctctgactgtatggccttgggaaaacctcagtgtccttatctggaaaatggagataataatacaaacctcacaaatttgttatgaagagtaaatgagatatttaagtaaggttcttggcatgtataataagtaatcaataaatggaagatatttggattggtttcttagggctgccataataaattaccaaaacatatcgtggcttaaaacaacagaaaagtattctctaacactcctggaggcttgaagtctaaaattaaggtgctggtggagccatgttcccttcataggctctaggggataatctttccttgcttcttgctgcttctagtagcttcgggtgatccttggcttgggactgcgtcattccagtctctctgcctctgcctccacagggcctttgcctctgtacatctcacatctttctctgcctttctcttataaggacatttgtctttgaattgagggcccacctggatcatccagcatgatctcatttccaaatccataattacatctgcaaagaccctttttccaaataaagccattcccaggttctgagtgggcataacttttagggatctaccattcaacccactgtccttccttattcatgataaaaattaagatacataaaattatttattttttatgtccttaggccctcgtgtggactccttctagcttggattacgagctttcatttcttgctttttctcttctcactcactacacttccgtgaagagcaagatcccatgtcccaggggtgcagagccgagaagggaaacccgagcgcgttggggcgaggctctcagacagcatcttctacaaagttgtgccaggtcccagctcgcctctctggtggtttctggcctggatgtctctagacagggccttcagtccccttcaggagcctcctcattttgggccaagaggcctgccccatgaagctccacgcttagatagacatggaagagaaggtcaatagtcagtttccactgaggacacagcaagaagaaattgtgacagtagactgggatgacaagccagccaccttgacacagagtggaatcacagtctcagaatgttcctaatggcaaaaaaatgtagagtaagtagttcgaacacccaaccagggcagggacccctaccccatatccctgagtttctatcctgacccttggggtgacccagagatccctgactcatgaggcagcccagtccatttttaaccattctcattgcttcctaatgctgcagctttttctgttcttccccagggcactcattcccagttgtctcagctgttactcatctgcttgcctccagacctcttgcgcaactgatcactccccctagacatgccccatccttcccacgtgcctttgcagcaggatttcaactgtggctttacccgtgccatctatggttgcagtatttattcccttattctgaacattgttttctttctcttttcttgagacagggtcttgctttatcacctaggctggagtgcagtggagcaatcatggctcactgcagcctcaacctcctgggctcaagcaatcctcctgccttagcctcctgggtagctaggaccacagatgcaaaccaccatgcctagctaattttttttattttttgtagagacaggatctcgatatgttgtccaggctggccttgagctcctgggctcccaaagtgctgggattacaggtgtgagccactgaacccagcctgaacattatattttttttaatgaaggttataattactatactttttaagaaccctaccaaatggttgttcatattgagtgtatagtcaaacaaaaactttctgggctctttcattgaaaccattattaaaccagatctcttcaaccctgctagtaggctaattgagctgttgaaaccaagggcaggcatttacatttattctcattgatcttaattttcctggtttggtaccatcacttccggcttcttaagatatatttgaatcttattcgcaacatatatcccttctagccttctgttacttcgaaatatgataaccaaaacactgtattagtattgaatagaacagaactaaaaatagagttctggcataccatttgcttcacactgacattgaacaattgaggtccccgtcatacatactagaaacggaatgagtgtttgatgaatgaatgtgtgatccactttgggggcatgcctgttcagtcaaccataaaggcatctaattatagctatcatccaatccacctttctccattctagatactccaagcatgtcgggtttggacctgtttttaatgcttggccaaaatgaagtgctttctgccagtgcaccacacaggccttccagtttagtgatgtaataaagctggaaggagattggtgagtcagcactttgagaatccttgacatgcccaagtaacctctgtcctcacacccaggtattctgccctcttcagtgtttgcatacgtagtttttccagtcctggcacaagctcatcagcctgctcttcctcttctttaaagctgaaaccgtgccctgtttgtccatagatatacaggccaggcagccatgggttcattcaaactgagaagcacaggattgggggtgtaggaaaagcaacccattttcttgccctaggtttaagatgtatttttaggagtttatatatcaaattctaagagcatcttccattctgagcagttggctgctatttactggacttgcagtcagtgggcatatattccccacatccctagcacagaagcatctcattttcctatcacttcccaagcagtctgaatccatggtaatagcaaaaaatttctcgaaatgaaattatagcaaagaaagaagtgtggagcttcctttgttaaatttcatttttcttcctgggaatgattgagttgtgtataaaatttatgataatagcctttttaaagtatatttctctgcagttgtgtaaagaaccagaagaaaagcagcatttgttatttgcagccgtattaggtttagatgaccccagaggaagcagtggagcatcacctaaatattagatgtttatctccgaggctccatcaactctgtgtttacgtacaacacctagtttggtttcccagtgcctgctccattaggaagaggctagagatgtttaatttgcttaagagtttagcagtagaaaatttaatcggatagctgctagggtttctcaaaccttactgtgcatagaatcatctggatatcttgttaaaatgcaggactgggtggggcctgagagtctgcatttccagcaaacttgcagaggatgctgatgtcacgggtcggaggaccacacttcgactagcaaagccttataccactgggctaaatttagaaattatgatagagagatagttaatgtagctctaaagcggcttaagatgaatgtattcagaacagtgattatcaggcaaaccatgggtagcaaactctaaatacatttgtcttgattcatctattaactctccctccaatttcccttttccaataggaatgtttaaacagtgcgatctgcatatgtggctctctggtaatttggcattgatataattgtgcatggccccatgtttggaagaaatctttttgttgtggcaggtgcttccagagataaactcctcgggggtcccctgggagggcaattcaggacacagaggccagttgtctgcaactagagactctaagagcagaaatcccactctccttttttcttttttcttctttcgtttctttttctctcttccttattttccaaatctacttttccaccttcataagttacttctttgttgtttagtcccatgatcacccgatagaccaggaatgtggtgccatcctggggcgccctctggtggttcattgaaaatacagcaagacccaatctctacccgtgggtttccccttatcagtactgaaagcttacggggcccagagaagggacacatacctcagcgttagagagccctgtctgctccgtgctgcactggtaaatagccctaaatgtaggaggaggatgggtggaaacttttatcggtttggccccagctcgctgcaactgctgtcttaatcattgtgtccttgatttctcattggcaatctctggaaaagatgctgtttatcaatggataagttttcagaagaataaatttggatttgtgtgttaaggccaatatgtcttagcaatcatttcgcagaagaccagtccagtgagtcttcagggctgactaagccgatgtctctcaaataaacagtataattaaacctgagcactactgagaaccaagtcagcattctttttcaaatttacgaaagctggcttcctaaagaagtaccttcagaggagttttctagttttgtgtattgtgcattcaattgtacaggcaatgttacatttgcattgctaatagacccttcctgaatgtgtttgacattttacttggctttgaaaggacttttatgccgctgctttttcttccctagtgctgccttgggctaattaacctattcccttactggctgggcctactatatgcaaatgttctcattttgcattctgacacatcactcttgcataaatatccctcatgaaaccctgtggggttttattggatcagtgctgcaggagggccagcagggggcgcatggactggttctctctgagtaggtctcacgcatgagttttccttgctcgttggtatggaaatgtgggagcgtttggcattccctttcttaagagtgagtcttgaaatttaaagataaaagttcattattagaacttctttttacaagggaaggctgtacagaacacagttatttgtcacttacaaaaaccctaggtgggcagggcgcagtggctcacgcctgtaatcccagcactttgggaggtagaggctggtggatcatttgaggtcaggagttcgagaccagcctggccaacatggtgaaactccgcctctactaaaaatacaaaaattagccaggcatggcggcagccgcctataatcccagctactcaggaggctgaggcaggagaatcgcttgaacccgggaggcggaggttgcagtgagccgagattggcacattgccctccagcctgggcgacagagtgagactccatctcaaaaaaaaaacacctgggttgcgagagtaaataagtgacattactccttcaacacttcatttcttcagcataagtgttttagggtttttttaaccttatttttcatttccgtcccagtctttaagcgcctctcttgtcatatgagaaattctattcttactgaaatgtcctttgatatcgagacaccaaatttctaaacctgcaccttcctagatatctgatcaaaatcattaaggattgagaactttctgttgtatcatttgtcatttcattatgatgttcattgatgatgttggagcaaaaccaataagggccattaaatcattgccccttccaagctggctgcagtggctcatgcctgtaatcccagcaccgggaggccaagtgggtggatcactgaggcctgttcaagaccagcctggccaacatggcaaaaccccacctctacaaaaagtacaaaaattagccgggtgtggtggcgtgcacctgtagtcccagctacctgggaggctgaggtgggaggatcacttgagcccaggaggcacaggttgcagcaagccgagatcacgccactgcacttcagtctgagcaacgaagcaagaccttttcaaaaaaaaaaaaaaaaaaaggaaggaaggaaggaaaaaaatcattgccccctctaaaaaatagttacaaagtagggggcagagtagagaaagggggttatgtttcagtagggatttcagtgttgctccaacatggacaaggattgaatgctgaaggccgctactttattgtgtttgttttaaaatcggatcattggctacacacagtggctcatgcctggaatcctagcactttgggaggccaaggaaggaggatttcttgaggccaggatttcaagaccagcctggttaacatagcaagaccccatctctccaaagaaagaaagaaagaaagaaagaaaatcagatcattgaaaagagggtctggatgtgagataccaaaacccaagggtgtggaattcccaaagcccaatcccacagctctcagaatcacagcatgttgcactgtgcatacctacagctgctacctgtggaagcaatcacatccgctgcttgctagcctgggtcatgtcagttccactgatatttggcctcttgtctgttgggcattggtttgcccacacagcagcagtaactcagacttcagtggttagtaagagactgagatacttgaccataagaactggctccagggtcaccatttgtatgtccaggtttgaacacactgatctgatttgtctgaaagagctgtcgtctctagtgttaatggcgagttgttactttccaatgagaaaggggacggtgtgaaggggaacttcaatgacaacttgaaaaggaagagagagatggacaaaccaagcatgtaacccactgagaaaacattcagtgcactagccctatttttgtatggtatttgggttttttaaccataatcaaattcggtttttaacagtctcactccgtcatcatatgagtggctgtactgggaattcttttgaaacttgcagagaacaggattatttctggcggcctctgctgagttggcgtgtgtgtgtgtgtttgtgtgtgtgtgtattagggagaggaaatcgtaggtccagtgtggacccagagctaaggggaatcttggagagtagtggctctggcagatgaggattcagaaatcgagtgcaaggactgttctggactttcactgctaacctgctttttctcagtgcctggctctgagggcagggtccagctggtgtcatgctctccaagggcttcattttatgttccagccaggcaaaggagaggtgagaaatggaaccaacatttctgaaaaggaaatttaagaactgcatcatctgcccttgaagaagaaaaggagaaaaaaaaacaggagagagggtattgagaacatcttaggggagttgttaactccattaaaaaatatatgtgttacagtgttcacttgcccagtgtcttcataatcttcctttataatgtgcagctgccacggctagtgtttttgtttttgttgttgttgttttgtttcgtttttggagacagagtgtcgctctgttgcccaggctggagtacaatggtgcaatctcggctcactgcaacctctgcctcctgggttcaagcaattctcctgcctcagcctctcaagtagctgggactacagccgtgtgccagctaatgttacaccaggctaaatttgttttttattttttatttttggtagagacggggtttcaccatgttagccaggatggtcttaatctcctgacctcgtgatctgcctgcctcggcctcccaaagtgttggctagtgttttctctgcttcagtgcttggggtatgattgggttatgggagttcacaccgagtccagggcctagtcttaatcttgccaaagatgttctttccccggtgctcatgttctgatgtcctttccctccttccctttctcctccctttccttttccctttgtcactgccctcttccctttcccagcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtaacgttagccagggtggcacagggatgggacaccacaccgtgatgccatcatcatctcctggcaagacgaattgcttctatgaggcaggattaagggttctcgggtacacctagaccttagactcggcctttcccaactgcgttctctagaaaaaataagccccatttccccgtgatctctgctgtgtgtaatgaattaacctccatgcatggagagtggggctagttatggagtccttgagacaatccagaaactcaccactctagttattttttgaattctgtgattaagatgaggaaccctgattaggaaacgctgctggacttcaggtccttctagtggtcattcggcactttttcttaccaggaaaagacagaggatgccgttggagtgaggggattagatgctaaagcaatcatatcccattgcaacatccatgttttaaaatatgtcttattagctgggtacagtggtatatgccttcggtcccagctactccagagactgaggcaggaggatcacttgagcccaggagttcgaggctgtagtgagctatggctgaacctgtgactatcactgcactcaagcctgggcaacatagcaaggcccggtctccaacatatatataatgtcttattatttaggtatgataaggccaacagatagatcagcagacaactctctttgacgagataatttttatactctctgatcccaagaggaaagggcactctacaccaagaggtgtagaacaccgtaaagtggggggcacctggggaagccccaggtgggtcaggaggtggagggagtgaggggaaatgtggcaaacaacagcctttattgtggtttcatgggaggcagggtaaacgggtttaggattggttagagtggataattccagtgtgctctggggtgtaggggctgtccttagttgtctggctgctggtgctggggtgatcaatacaggtggaagggctgggcacagtggctcacacctgtaatcccagcactttgggaggctgaggcgggtggatcaccagaggtcaggagttcgagaccggcctggccaacatggtgaaaccctgtctctactaaaaatacaaaaattagccgggcatggtggtgtgtgcctgtaatcccagctactccagaggctgaggtaggagaattgcatgaacccgggaggtggggattgcagtgagccgagatcaggccactgcactccagccttggacacacagcaagactctgtctcagacaaaaaaaaaaaaacagatggaaggcagccctaagtgtgatggaccaatataggaggctgctggggagtgggctctggactggttagtttgcatatgaaagtcaggctcctaggaattagctctggactggttggtttgcatataaaagtcaggcctctaggaattagctaatcctaggagagactatacctctgggatccacaagacactaaaatatcaaagcatcagaaaataaaagcgtggttaatacaatctgagaagtcagggctgtcccaggtgacctgctgggcttggggtaaagtcagctgtagccaagatgagtcactggaagtatggttaacgctcttaatttccacaggctccttcaatctacccttttccaggttcttagatcgattacatgcatttattccacagcccatttctttcactgcccaagttgctgggagtccagcaggttcagcctgcagctgagagctttcctggctatcgagcgtactttctacaagtgtttccatctaggatttgaaaacattcaaatgggacagagcctccttccagcttgagttgaaaatagtcatgaaatagctgctatttgggacattcagataaaataaaacaagaaaaaaaagataaactaattaatggtttgaattgttttgggcatttttttttttcatttttgagacagtgtttcttgtctcctaggctggaatgcagtggtgcaatcatagctcactgtggccttgacctcctaggctccagcgatcctcccaccccaacctccctagtagctaggaccacaggtgcataccaccatgcccagctaatttaaaaataaaaaacattttagtagagatggggtcttgctgtgttgcctaggctggtctcaaactcctgggctccaagcagtccttccacctcggcctcccaaagccctgagattacagacacgagtccctatgtctggcttttttgagcatttcttaaatgcccaagtgaggaaaggaccaaatcagttttccagaaccactcgtgaatgactggatatgggggcttgcacaaagccggggccctgcattgccgagagcttttagccctgaatacttttctttgtattatgagatgtcactgtaggtttacagtctttggaagggcccaagaaagatttccccaaagatcttatttaaaaaaaaaagaaaatcaggatttttaaaataaatggcataataatacagctcactacccctctgtagtggctgttcacttcctgcatgaattaggggtgggtactaggagaaagaaaatgaactaccttgagcaaagttgactcttcacagaccccaggtgacacatggaaaataaacatgagtgaagagtcattgcttttcatggtacttagaatccttaacacatttttgtgaacagaggcaggtgtgaaaagaggttttgtttagaaatgcgactggttccttgccggccagcatcaacttcagcttgagaatgaaggcagccacttcagctgtgggccacacttcccaggcctggcagcctctgcagaaaccagactcttctattttttttttttttttttttttttttttttggagacagagtcttgctctgtcacccaggctggagtgcagagtgcagtggggtgatcttggctcactgcaacatctgcctcttggttcaagtgattcttctgcctcagcctcccaagtagccgagactacaggcacacgccatcaccccctgctaatttttgtatttttagtagagacagggtttcaccatgttggccaggctggtctcgaactcctgacctcaggtgattcacccgcctcagcctcctaaagctgggattgtaggcgtgagccactgcgcccagccccttacagccctcttctgttcttggggaggaagatctaggtgtgtttttccctactccaaactttgcaaaattaatgattaaatgaaagagaaattggcttccctgtgaagtcagagccctgttctcatgttttttcccatagtgagatcactaaatctctctactgacagccagggtgcagacgagcaggtagaagtgttgtcagggcctgttggcaggtctgtgaggttggcccccgcgtggctatgctgcatgccgggaagggcttcctcaaagaaaggcaagtgtgctgagacctgctgaaaaggcagctagggcttcacgctgtagaaacaaaagtgcaaggcctgacgcaaccaatgatttgtcactttaccgaggagcctatcagaaatcggctgacatcatcacagctaaaatactccaccagctgtgtttgccacaagtgacaggttcagagtcagtggagactcagacagagagcatgagagggggagatgggagggagagagagaactcatatctggacttaattgaggttccaaaggctacatccttctcccctctgcagtgccttcctgaggggttttctcccctagcctgaagaatcttcctggtcttctcaactggttaggcactgctgacactgcacccacagagaaattcagaaatgtgcaaattgttgagcttaataagcaaaatcacaaatttgattggggaagttgtggaagaagagatggttttctccaaaacagatggcattgtgactctaggcagaaatcctgcatgaacagactcttgaggatgcctgaactcataagacccccccaacatcacacccccagggaaagcagtgtgatatagtatggtggtgacagacccaggggtgcggatttgggtctctggcaggacaagttacttcacctctctgagctgcagcactctcctctctaaaccaggcaaatgagttttgtttttctgtgggtttttgtgttcgtttgtttgcttgttttgagacagggtcttgccctgtcacccaggctgaagtgcagtgatgggatcattggctcactgcagcctcaacctcctggactcaattgatcctcccacctcagcctccccagtagctgggactatgggtgtgtaccactacacccagctaattttctgtgtttttttgtagagacagggttttgctatcttgcccgtgctggtctggaactcctgggctcaagcgatccacccacctcggtctcccaaaatgctgggattataggcgtgagccacggcgcccggccacgtatgattcttcataggagataatctcttgagagggttccgttttttaatgcttcacttttatactttccagaacagcacagcccttgtaaaaatttattagcgtcggttaacaaaaaaccaagaagagcattaagatgaacatgtactgacctcatgctaagcggcacacagacctcatgggaactaaagccatggcatataaaactgaggggtgtttagtttggggatgatttttaaggggctgaattcctcattaagactgtggaaagatgcccccagcattgtcccagctgacgctccagacgaggcaatgtaggagaaaaatgcttttccgtgtttgtcactatccctgtggcattgccctgcccagtacagcttttctccactcgagcaaagcgtctatgcatcccccaggcccccacctaggtgctgtgggaggaaaggggaatgccaggtgttgtccattgttactgcgtgcaccaaaggaagcctccttcctcttcagtggagggtgatagcacgttccccaccctggaagagagttgctgctttgccatgccttgattctggttgagagtcccaaaggatgacagaatcacttcccttgggcctcactgccaaatataatccacttaatatcctccaagtttgaggccataagtctgtggcgcatccagatgcgacccccgaggcgatagcatcaacgtgggagccaatgcaactcaaaagaaggatggggcttcgcacctcctccttgggtaggaagtaggttagctgcttggaaaatgcaggaactggcactgaagagatctgagtctgaacatatccctcacccgtcagtagcactgggaccttgtgcaatgttagttttcccttccctgcttcaacttagatggctcgggccctgagaaagtgattcacagctgaaaaataaatcaaaggcctcgtgttctaaaaagagtttatggaaggagaggcagctgatgaaagtctagaaagaaggctgaacttttccaatgagcacaataagccatttttaccctgcctgtaatcctcggggtggaatcccgcgagtggccgaggcgagcacccttcccgccgttcctgtttctaaggctaaatgatgtcatgccagcctgcgtgagcatatcaatctgtatttctgagtatgaactggatttgaggggtgcattggtgctccagccctccagatcagtaagacaaccaatgcagaaacaagggctcccaggctcctcttctgcaagaggctgttagtgacgtgcccgctgggacagccctgcccaggatggccccagctggggagcctttggcttccatctggcggcgttctatattatcccatccttctgtctcacccttcctaggttcagcttctctgaagagtacacagcatttgctcagtggagttgtaaaatgtattggtaaagtgctctgggttgacacgttcctttgcttctttcctaaatgccaggctctgtgttattagggccgtctgtcgcttcccagcgcctcccgaggtgactgcttccctgactcggtggctgcttaatattcagtgccatttcctcctcccgactgtcctggcgtgggtgtgagtgtgcctgtgtgtgtgctcgtacagcagttgttatcatgatgtacttactggctgtctaccgatggctttcctttcattctactattttttggttgacttctgtgagctgtgagtcatcggtggtaacattatgcattgaatggattagctggtacctaaaaatagccgaggccctcatgcaggcggcacatgagcctgtagagtcagtccctttgcagccaaggcagacccacttgccaacattgaacatgccgagcttggtggcgatgaatcctaatgtatcaaaaaatagatagttggtgactgccctgtgtgcagagcccagccctggatttgtgccgcagttgttggtaatacacacttcctgtctgttctggtgctggaaaggctccaacagagaaactatgtcaaaccacatttttgtttgtgggtctttgtacctctctaaaaaaaaaaaaaaaggagaaaaatgctctcctttaaactgtatgtgctatatgtgcccccaactgggtcatcttatatgttttgattctctcagactgttgttgtttatagcatttagaaaaaaattaaagactattgtttaaagcagttttaggtgtacagcaagtagagagaggtctcacacacctaacagttttccctgttattaaaatcttgcattggtgtgatagattggttacaactgatgagccagtaccgataccttatttttaactaaagtccatagtttatactacagttcactctgtgttgtacatgctgtttttgatgaatttatgatgtcatgtatccagcattacattattatacagaacagctgtaccaccctaaaaatcccttatgcatcaactatttgtcccccacaccccacctgaaactcctggcacccactgatcattttactctctccatagttttgcctgttccagaatgccatgcagttggaatcatccggtatgtcgccttttcacattggcgtctctcacttagcgatatgcatttcaggttcttccatgtcttcttgttgctctgatagctcatttctttttagcactgaatattatgttgttctttaaggcacattttttttttttgagatagggtcttgctctgttgcccaggctggagtgcagtgacaccataatagctcactgcagctttgacctcctaggctcaagcaatcctcccacttcagcctccctaggaacagggaccacaagtacacaccaccacgcccagctaatttttctatttttttgtagagacggggtcttgccatgttgcccaggctgctcttgaactcctgagctcatgtgatcctcccgcctcaggcccccaaagtgctgggattacagggatgagccacccttccctgcctaaggcacacattttaaggccccagaaaaggaaggcaagtgagctagaacctgtgtgcctaagggcttccgtgtcacagctgctgtggtcactcactgggcagtgtccttcctggccatccctgagcctccccacagggccttcccacaagggagctctgtgagccacgctaccatgtgtaagaaaaacccagcttttaatgtgggatttgtgttaggaggcgtcccggtgctagggtgtgggtttactgaacaaccctgaaacacttccaccaaggactgagtcaggctttgcgtgaacatgattcagtgttttaaatagaacactcacagagattcttacactcagccaaagcgttttgactgtttttattaatgatttttaaacattgcagtaaatgggtctctcgcttacccccttcatctttgagacggggttttctgatttttttcatgctgagaacgtaaccatgcagacttagccttccaggaaagcagaccggcctttctctacaggtaaaacaagactgagaatttcacttgcagacaaagttaagaatgcccaatttaataatttcgccaaaaaacaagacatacttactgaaacctagcttatgagagaattcattgctcccagcaacaggcgaaatttgtatgtctgggatagtgtcatgaaaaaatgttttgtaaaacagatgcccttcgcaatttgtgaaaacagggactcttgtgaaggaaatgggagacatatttaaacaacagacgttttgttttctttctatcttgtttttggtgatatgtacatatgtgtgtatatagacatagcaccaatctaagattgaaatatacaatcaaacagcataaatatgcgtgtatgtgcatagtgtttagatatagtagttattgactaagtggtgaaaggaattttattgaattttcatacagaggagctaaaatttttcttaaaagccagtcattagtcagattaggaaggtgacatttaaaaaataattatgagcccagaagtgagtcggtgttgtctccctgtctaggttcgtccatccaaaatgggagttggaggtgacagttctagaggagtcgatttagggggatggatggaggaaggggtaggcagatctcttataaccacactgatgagcacatgggcttgctggcagcagtgggaggagggagggaaagagtggaggagggtgggaggcggtccacccccaaaagcaagaggtgctggcgacagggcatccagagatgaaagacagagggccctcaagcttacaaaagtataaaggccatccctgggcgcggtggctcacacctgtaatcccagcactttgggaggccgaggtgggtggatcatctgaggtcaagagttcaagaccagcctgactaacatggtgaaaacccgtctctactaaatacaaaaaaattagcctggtgtggtggcaggcgcctataatcccagctacttgggaggctgaggcaggagaattgcttgaacctgggaggcagaggttaccgtgaatcaagatggcaccactacactctagccttggcgacagagtgagactctgtctcaaaaaaaaagaaagaaagaaagaaagaaaagttataaaggctattctacttactgcttagggtgtttgaaacaggatatatttactggatgaaaaaatgggctatattgagctgtctggcgttatgtaacgtgctttggttatctgtggtactgctcccatgagtttattttcattgggatttaatcagaaaccattctggaaaatgtgtggaaccccagcaagatcataaaatgacttaatgattactaacacagctgcaagaacgagagtggagagaaaataactgaagtgtgattcaataaaatcatgacgacctcagcatctgacaaggtgaggtggctatggctccgctgagaaagctgcctgttaggcggtaaagccacaccctggagaaagcactgctcctctccctgggggaggtcacagcccactttagttctggctggttaaaaaaaaaaaaaaaaaaaaaaaaaaagacaggcagtctctctattgccccctgttgtccacttgtaccattgcaatgtttttccatacagaaggcaaacagaactattctttcagttttttttttgttttgtttttgttttttttaagacggagtcttgcactgtcacctgggctggggtgcaatggcgtgatcttggctcactgcaacctccgcctcccaggttcaagcaattctcctgcttcagccttcagagtagctgagattacaggcacctgctcccacgcctggctaatttttttgtatttttagtagagacagggtttcaccatgttggtcaggctggtcttgaactcctgacctcatgatcagcccgcctctgcctcccaaagtggtgggattacaggtgtgagccaccatgcccggcctcttctttcagattttaactgagcacctattacttgctaggaagtcttttagactctggagatagaacactgagtttggggaaagaggcaaaacagacaaatatacaagtaaataaaaaagaatgcataagaagataaccagtcccttttggcaccagggactggtttcatggaagaagattttttggcaggatgggaagagggagggggatggttttgggatgaaactgttccacctcagatcatcaggcattagttagattctcataaggagtgcacaacctggattccttgcatgcgcagtttacaatagggttcacgctcctatgagaatctaatgcttgcgactgatctgacaggaggcggagctcagtctggaatggttgctcacctccagctgtgcagcccagtacctaacaggccatggactgctactggtctgttgcctgggggttggggatccctggtataaagaggagaaggggccaggctaggtggctcatgcttgtaatctcagcactttgggaggctgaggcaagagggcacttgaggccaggagttttgaaaccagccaggccaacatagcaaggctccatctctacataatgatcatcattatcttcaccaacaaaacattagctggacatggtggtgcatgcatgtggtcccaactactcaggcggctgaggcaggaagatatcttgagcccacgaggtcaaggctgcagtgagccatgatcatgctactgtactccagcctgggcaacagaacaagaccctatctcaaaataaaaaaaggaagctatggaaactagagggttgttattttaaatagaactgtcaggggagttctctctgaaaaggacagtgggtggcaacagtacgtgaggcaaaaaagattccaaatgaatggagagagtagcaggtgcccagacggaaggcgcaagaggggttaaagaaccagcaaggagaccactgttgctacagtgtagggagtaaggggcacatgcagaccacatcaggcttgcatgtggtgaccgagcgagtgagatgcagcttggccaggacaaaggtggtggaggtagtaaaaaaatagtatcattctaggtgtatttggaaaaggaacccatacagtttgcttataattgggatgtttgtgatgtaagagaaagagcggaagaaagtatgattccaaggtgcttgattgaacagccggaagaatgggataccatttatggagatggggaagaacatgggatggccaccgggcaggggcacatcgggaggtctggtgtgttttaggtcactttaagtttgagttgcccattcgacatctgagtggacgtcatcggatagtgtggtcactggtgtccaaatgtacccgttttgcgtgtatgttctgtctcctggtgggaggcaagaaactaggtcttaaccaatagatactcttctaaggttcctaacacttagcaggtgctcggtgtatacttgttgaacttttattaaaactggaaagcctgaaatgtatcattaggaaccctcaataatattttgaggccgggcacggtggctcacacctgtaatcccagcactttaggaggccaaggcaggcagatcacttgaggtcaggagttcaagaccagcctggccaacatggtaaaaccccgtctctactaaacatacaaaaattagccaggtgtggtggcttatgcctcccagctactcgggaggctgaggcaggagaatcgcttgaacccaggaggtggagtttgcagtgagccgagatagtgccactacattccagcctgggcaacagagcaagactccatctcaaaaaaaaaaataataataataacaatattttgaagctatcagcatcatagagaatacccatatgggttttaaattcaaggaattcacagacttattgttccagttgaagatgacatcatcctacaaaatcacaccgtctctgtttcacatccaaaccagtccccgctggcattgacagcatgttttgagatggagaaggctcctctccaagggaatttcaagcaacagatttgatgatatatattctcactgagaaacccctcagtgagatttcttcattaacggttaatgatcagttaacctttaagaatgtttatatccttatgacaaacctaattataaaataaagatagatttgctatgaatgcttgagtgtacctatttgagatgtgtgcaacaagattttaactttcaccaaagaagggaaaaaaaccttattttacttctcatacattcagaccccaagggggaaaaagtacattgtctaggtagttcacactaattagtgaggagaaaactagcattgggctggcaagctatccgatctgtgcctacaatgatcagattatctgaataatcttccgctcccacctcagctttcatggacccagctgatatctggtcgtggcatcttttcgcagggtgacacagctcctttggtaggaagcaaaggcagaatttaggcaaaaagaaacaaagagaagcctttgaagtgattaaagaagaatctcccaagcctatctaggttaacataaatttcattaacaggccaggtgggcgcggtgactcacttctgtaatcctagcattttgggaggctgtggcgggcagatcgcctgagatcaggagttcaagactagcttggccaacatggtgaatgaaaccccgtgtctactaaaaatataaaaaattagccaggggtggtggtgggcacctgtaatccctgctacttgggaggctgaggcaggagaatcgctcgaatccaggaggcagagattgcagtgagctgagatggtgccactgcactccaacctgggtgacagagcgagactctgtctcaaaaaaaaaaaaaaaattccattaacgtcatcttgttttagtacgcatctcaaatattctctctctccatcacttttctctcgtgaatttttcggcaggctgttctagctatggttcacaccacagcatttaattctaaggcctgtctttggagatttggagtttggtttggtttggtttggtttttagagacagagtcttgctctggcacacaggctggagtggtgcagtagctcgagtgaccctcgcacctctgtaactgaacttaggtttggctgctcaccactcaaaagccaaatacgagagatgaggttggtgagaggaaaagcaggtttattgggaaagccagagaaattgagaagatgatgagctagccttctaaagtaccatctccaggccaggcatggtagctcacatctgtaatcccagcactttgggatgccaaggcaggcggatcacctaaggtcaggagtttgagaccagcctgacccacaatggccaaacaccatctctactaaaaaatacaaaaattagccaggtgtggtggcacatgcctgtagtcccagctactcaggaggctgagacaggagaatagcttgaacctaggaagcagaggttgcagtgagccgagattgtaccactgcactccagcctgggcaacagagaatccatctcaagaaataataattttgtaaaaattaagtaaaatctccaattttttaggctggttggagggtttttatgggaggggggtatggggggagacgaaggggttagtatcgaggagactgaggaccatagacatttgggcaccagtgagggttcaagaaggttgagaacttctttgtccttggtcaggtcataatgctccttcagtctttagtatttttaatagagggtttcaccatattggccagactggtctctaactcctgacctcaggtgatccgcccgcctcggcctcccaaagtgctgggattacaggcgtgagccaccgtgcccagccactcctatcagtctttaacaatatatagttagttgtttatatacttcccctttaatcccagagttagtttctaaaagtacatgattgttgtttgtgtatattatctcggtgccataaaattatcctagcctacgtgcaggaaagggtaaaaccctttaaacaaaaatggagttagttatgttcgttcttttgctatttcacaattgtacctcagcctcccaaagtgctgggattacaagagtggtgtctttggagttttgagatgcggaaataatgaaaggctttcaaaatgtccaataacattatgaagtctttagagggaaacacgtgtatctgtatcctgacttttgcactaatcaattatagtacctgttataaagggcttgtagacatttcttaatgagtctacagatacttggtaacgtggaaatcctcagataagtttacctatgagaacacagtagatgttattttcagaaaattaaatattgcctgccctgtgaagtgtgtataatgtggctcacacaccaagggcctctccatgggtaggtgtccggccatctgccagcaaggagacagggagttatccgggaacacgcagaaccagaaaagaggctgacatgtttggaactaaggcttctggtcttctgaatgtcacattacctctgcctggtgttgggcaagaataagcaaaccgcaactctggtagagagtcttacgagacagatgttaacacctgagagttttatttttatgacttggatttgcagcaaaacaatctccacttgatgtgggattggtttccttctgttcagtttatgttgttaatgactctaagaggtttgcaagaggatctatggagccagttccagattggtcctcctacttagaatacagtgggtatccccatctgatacagtcacttgtaagtatatttgtctatgtatatatgcacatatatgtttctgtgtgtgatgtaaatgtagttttgaaaccaaatagtgtcacacacttgtacagggtaactagaattgtatgagtggctataaggcaaacactgcatcacaattatctgtaccatggaacaagcccatgagctcatgcctttggatcctacttatttcagtcaatattcaccactgttggggggtagcaggaatgcttagttcatctcttttggtggcattgtaatgtctttgctcacaagggtagaggtcaggaggcacagaaaaaagaaaatgggtttgggggccaatgactgggataaaatcctaaacccattagctaatagctatgacattaggcaagtgacttaatctctctgtgactattcgtaaaatttacaaaattggaagagcaatactattccatactaatactattatgaacattaaacaaaatactttttgtaaagtttgtacctgagagcttgacagagagtaggcactcaaaaacttttagcttgcttcacattataaaaatagcccagaacaatgaaactttcccccagtaatacacacaggagaaggggttcatgcttacaagctgccatatgaatgtactcaagttgtctcttctaaaaatatgccttgtatggatccagtaaagtctgtcattctagaaatgtatcagaactagatcaatcagagttaacaaaggaaacaaagaagatgaagtagaaaagcaacaatctgtggaaatctactacttttaaagtttttttggtacttcaattatgcatgtgtgtttttgtgtgtctgaatgtgtataaaatccaatggaggcctgacacggtggctcacgcctgtaatcccagcactttgggagactgaggcgggtggatcatgaggtcaggatatcgagaccatcctggccaacatggtgaagcccccactctactaaaaatacaaaaagtagctgggcgtggtggtggtggtgcatacctgtagtcccagctacttgggagtctgaggcaggagactcgcttgaacccgggaggcggagattgcagtgagccgagatcgcgccactgcactccagcctgggcgacagagcaagactccctctcacaaaaagaaaaaaagaatccaacaatattttaaatattgttacatatagccaatattcattcagattcaccatgtatctaccattttcattcctcttcattcctccctgtacaaacttcaatctagatttgttttttctctacctaaagaataccttttagtattttctataatgcagatctgttgatggtgaattcttttaattactgtttgtctgaacatgtctctattttgccttcattctggaaggatctttttgctccatatagaattcgccattgacaattctttttctttagcactgtaaagatattccattgtctccattgtctactggcttccattatttttgttgagatgtaaactgtgagttccattgttgcttatttggagataatatgtattttgttctagaggctttttttttttaatggagtttctctattgtcgcccagtctagagtgtgatggaatgatcttggctcactgcaacgatcttggctcactgcaacgatcttggctcactgcaacctccgcctcccgggttcaagtgattctcctgcctcagccccccgagtagctgggattacaggttcctgccaccatgcccagctaatttttgcatttttagtagagatggggtttcaccatgttggccagactggtctcaaactcctgacctcaggtaatccacccacctcggcctcccaaagtgctgggattacaggcaggagccaccacacccagcctgttctagaggcttttaacgatattttttcctgtttagtttacaagatgtctttgatttatagcagtttaattctcatctgcctcagtgaggatttctttttgtttatttttcctgtttggggctaggccttcttgaaactgtcttattatccttcttcagtttgggaaaattcttagccattacctcctcaagtattaacttctgccctattatctccctctcttcctcctcctaggattcaaattatgtgtctgttagcccctctcaatgtatcctatgtgtctcttaccctctcctccatattgaccatctttttgtctctatgttcactctgtggagtctcttctaaagctctaattagagaatccagttcctgaattctttcttaatccatgtctattcaactggaaagctcattgcattcttgatttcagtggtgtatattttaattctacaattctcatagaccttttttaattaattaattattattattattattatttattttttttttttttagagacagagtctcactctgttgtccaggctggagtgcagtcttgtgatcatagctcactgcaacctctaactcctgggctcaagatcctcctgcctcagcctcctgagtagttgggactacaggcacgcatcaccacactaggctatttttttttaaatttctgtagaaacggggtctcattttgttgcccagactggtctgaaactcctggcctcaagtgatcctccctgtctcagcctcccaaagtactgagattacaggcatgagccaccatgcctggcttcatggatcttttaaaaacagattctagtttcctatcaaaattctcaagctgtctttaatcttcttaattattgtaagcatagtctttgtaaagtctatatgtatgactctatatgagaagccctggtgcatccttttttaagatctgatattttgctagtgcttatacaagctatctggtctcctcatgaccaccaccccccttttttaaattgaatgcttttatttgcaaaattgtgaaagtaattcaagaccttaatccagttttagggactcagatgagtcaatctgagcttcagaccttgaaaggcctgttggcttgtggttcactgtctcctctaagggacagtgctttggggtcacaactcaaaagaatggggctcaccagagaacaccctcccttggtgtatcctgaactccattacctgttccctatgctcttaacactatcaaaagcccacttggtttcccaactgctccactttggaatgttcaagtgccttcaggagaaaacaggcccccaacaccagcttcacctctctgggccatcatcttttcctgatccaacccaggaagtgtgtgtgtgtgtgtgtgtgtgtgtgtgtgtgtgtgtgtgtgtgtgacggagtttcactctgtcgcccaggctggagtgaagtggcatgatctcggttcactgcagcctccgcctcccgggttcaagcgattctcttgcctcagcctcctgagtagctgggattataggcgcctgccaccacacctggctaatttttgtatttttagtagggacagggtttcaccatgctggccaggctggtctcagagtaaagtggcacgatcttggctcactgcaaccttcgtcccccggactcaaacgattctcctgcctcagcctcctgagtagctgggattataggggcccaccaccacacctggctaagttttgtatttttagtagagatggggttttgccatggtagccaggctggtctcaaactcctgacctcaggtgatccacgcgccttggcctcccaaagtgctgggattacaggcatgagccaccgcgcctggcctttttactatcttatttgctgtccagtactataagaaaaaaagtttaaacattttgtccagagtttttaaatttatttgtttgcttatatttttgttcagagtttttagttgtcctcagaaggagggttggtccaaattacctagtctactacatctagaaaggacattggaaattgactttttttttttttttttgagacggagtctcactctgtggcccaggctggatcgcccagtggcacgatctcggctcgctgcaacatctgcctcctgggttcaagtgattctagtgtttcagcctcccaagtagctgggattacaggtgcccgccaccacgcatggctaattttttttttttatttttagtggagacggggtttccccatgttggccaggctggtcttgaactcctgacctcaaatgatccacccaccttggtgtcccaaagtgctgggattacaggcatgagccactgtgcccagccaccaagcatccttttaggggctggggactcagtgataaacacactgtgcctgcttcttggaactcacagtctcactctgatccatgtttagtcctgtcctgtatgataatagcagttgtccattgagctcataaaatctaagaccgcgctgggcttgtgagccacctgcagagcctagcttggtgctgaaagctaagtgggtgctctgtcattactggggttcgattgactggttctaacagagaccagctatagagctaacacttgatggaatattttgaatattgatgaccttttcactggcttctgcctatggcaagtagaggtacaacccaaagagaagagcctcatttatagtgtgtggctgggggagagggaggtttgcaaactgagtcattttcccccattcagcctgtgtgtgtctgtgtgagttcatacctgtgtgtgtgcataaaatcaaacaagaataaaatgttttcatttgttcccttccttcttcctctctctgtctctccctgtttccacaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 102 - DNA, 11936 bp, Homo sapiens
agacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtaagtacccccaagtccgctggaagcacccgtgcacctggtccccagctatgtggcttctcgacgtggctgcctgggcgcggcgggccccggtcctcgcagatccgatccctcccccacgcgcctgcagtggcagccctggaatccagtgcaaaccgcgcgtctggcccctcctgcttccttttcacattgctttgcagtcccgggcgtccccagttctcttgctgtcctccgctccactctgcagtcccggtgggcgaagggtgaggagtaagggacctagaggggtagggagttggagcggggggcgccgggttgtttcactgctgcgcccgtcgcctgctgacgtttaggtctcccagacctggtggccgacccctactacatccaggcgtccacgtacgtgcagaagatgtccatgtacaacctgagatgcgcggcggaggaaaactgtctggccaggtacgggctgatatgtctgaggccccgctccccggtctaccttcagggggcgctctggtgcctggttctgactgctactgcttcgcgcagacaagtgttaggaagtgggacaagagctgggaagtgggacgtgacctcctgggcatgctgacctggacggagagttaatatttttgaagatttctgtgggttctgtctcaaagtgcagcaggaatcacagaggtggaggaaacccttatcctggagactgaaagtctcatgctctttttccaagatacttaaacttgggagtcaattgttccaatcacttttcataaaacaactatacagtaattcaaaaaatttattgtaatggaagggtgtgttaatacccccttaaaagattcggggcaaatttgccatcgtagcctcattggtaaagactaagttttcctcttttgtttgagaccacgatgaacttggttgttttggtattacttcagccagaataagaccgtgagcaagagctttgtttttccactattctaaaataaaatagtaactctgggattggggttctctgggtttactgctgggaaacagcagagggagcaaaagatgttttaataaaaatttaaagtgtaaaataaggtcatcaataccacctgaacatatagacacactaaatatattagtaggaacacagtgatgtttatttgtacatttcttccactttgaccctttataattgtcaggctaaaggaagtgaagaaatccaagctcattttcattcctgagtcttgcatcactcacaccattgaactccctatgatgtttttacagtactgccattgttttgggatagtgaagttacaaaattattaatttaaatctgggtatgctcttttagagttatttcctcagtttgcagctcattaacttttttaaaagttttgttaagtttgaagtttgtaataaacatctatgaattattttttttattgggggattatttccacttcagtttcactcattcatatgatcaaacttgaattgattctaaagtttacttctgacatttagatttttaatgcttattatgtttttactgttaagatctgtggatttccataggtgttattcattcacttattcaccaaatattcattgagctctgactactccaagacggttctaggagctttggattcagcaatgaacaaaaagaaacaaaatgccttagactcttggaactgatagtctagttgggaaaggaggattgtcactactatataatggatgttttatttgtagttttgtctttagttaatattccatgaatataataatttttcttttttcaaaatcacagtacagcatacagggcagatgtcagagattatgatcacagggtgctgctcagatttccccaaagagtgaaaaaccaagggacatcagatttcttacccagccgaccaagatattcctgggaatggcacagttgtcatcagtaagtaaatgggcctcctgggtacttttgggttgcttttcatttctcaggtgatttttgatatcacaaatgcaagtcttatttcttacctgaagggagaaaattgctattacttatatttagaatttttctctatgtaatttcacataacccatctactacaagatcctgttatcttttgaaatggaaaatctgaagcccagcttattaaagctgttgataggatacagcaattgacttcaataaaatttactccaatgcattacagataggatttctttaaaagtccattacagccaagatcatctaaagttagttagcattaaatagcatttcataaagaccacacgttttttatcacaagcattcagaaaccattctcaaagaaagatgtagatgatacatcccatcagctcagaaggaccttcttccatcttttaaaagacctgtatcaagcccaaggtggttgccttttctatcctaaatttaaggatttttgcataaggtaattctatcatttgccttagtaacttgcctgggtgtttattttcaggaaatcctcatgtgtggccttaaacttacttcctgaaatccaagccagtcctcattgttttttccttatgtgggaagatgaacagctcagcaccttccatttaatgaaataacaaaagtagatataagtcccttaatttcctgataaaataggaatattttatttctaaataaaagtgtgtactatttaaataataatggtggataaaacatgccatgagttctcccttgcttttcactaatgattttaaatatgtgagaactcaattttttaaaatctcatagaaaccttgaaaaagtcatgtgctgcttttcggaatgaaacatcagcagtggcagccaaggggaatacactagagaacacagggcaagtttcacttaagcacagataatttattgtccatttctatttaatattcaaagacaaaatggggtacaataagaaagcaaaatactgaactaagtcttttgtcctagtagcaaagttaaaccttacaattttgatagacttatgtcctggggaaaaaaaaaccctagcatgaatctctcttttagaagataaatttggtctcaattttaatgtgaaaacaaatttgtgaagccatgggggaagtcatttaatatcttcattgctttctctgtatgtaactgaccaccatctttttgttttgtgggacatcagacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacaggtatgttggcaccctgaaatccagaacctcaagcctcagagagaaacgggtcatctaccgttagttagcattaaatagcatttcatgaagagcacacacatttttatcaaaaggatacagagactgttctcaaagaaaactgtagatgatataccccatgagtctagtattttctttcctctcacctctcttttataaagcattcaatttgaggtccatgttgttaagatgtaaaataattgggaaaaggcaaatgatggcttgatgatccaaattacttttgaagtatttccagttatgcatgtggcccctattcatgatcacaggtcagtgtgggtccttgttacagtccacaatgaagaacaaaaatttactctctgaaaaagtctgaatggttgacaacatatgcacccattctgtattccttaaccggcttagtaaataactgtaaaaaaagatatctctgttttttcacctgtgaaaccattccttccttctgttttatgctgaaaatagaatagtggttgcggttagcaaatggaggaaaaataagtttctttaaaagcactttaaaaagttgcctcttttaataatgcaaataagagcagaaggacaccatttctttctccacacatatatatttaaatctacagtataattgatgtcagatgttgtttggatggatttttttaaagtagtgctgaactaagcagtttgcatgttttatcattggaaaatgcgtgtcagttaaaatctatgtcagtatttccatatgaaaccctaatttgtaaaaggacattataatttgactcccgcccagatcttggcaaggggtagtgaatgtacataactgagggtatgaagggatcagcagttggcatcttgggaagcaaattccagggctgtggcaggaagctgtttggtgacctaaatgttaccattgcttttttctctgagcttagaacatcatagcaattggagggggaaaggttaacttctacatgccccaggacagtacttacttaagaaagaggagatgtaacttacccacacattattcatgtgtgcatatacagattcccttttcagtgatctgcaagtcctgtgcaagggacctagagtttatttgccccatttacaaaaagaggcactctggacagctcactctgaaatatttgaagctgggattgtagacattatagcacttctggttcccccccttctttggggtgaccccatttcattttatatggtagctttcttgttaatcatcttccatatatgttctttttaaccattattcaccaaatcttgcattgagcgatttatatatttgtttttttcattagatcaatgtctctttcacatggacttcatttaaaggaaaaaatagtctctcaatcacctaatgatgactcagattagtttattgtaatgctgcttaaatgtattcaagcataaaactaggtataacttctttagatttatacttttacatattaataactcttgtgttctgagacaaaaatttacatattaaatatatacgaaactaaaacagttgaattcaccttattaatttaatgtaacaaatagtatgtattgctaaaactcaaattgctgatttagagagcctcagctaacattcaacattgaatctgtttttatattttgactttgcctacatgaaatgcctatttgccttagtaactcgtttttgcttgcttgtgcaaataatcaaagcttatacttaagttctgccagcttatgaactcgagtgccaatttcagcatttttaaggctcttttgtctatttgaaggcaagataagcactgaagcattatgtaaacccatcttaaatgaatatctaatccagtgaatcctttacaatgtcatgaacattgtggtagtagtagaagtaataactagcacttattgagtatgtattatatgccagaatcagaattgtatgctggaatcagaccaaaaattcttcattttatatttactactcaacatactgttaagtgatgtatggatcaaggtaggaatctagataataacaacagaatatgagtctcactgctgtgacactgacccttctgagttgggcctgtctgtgctattgtgtgctctatgacagcacaattctcccctgctcttcccaaatcaagctacagctaaaccagcattggtagagcatgctaaggtgattttactgtctcttgggtgaccaaagtgatcttaaacagcaaagcaatattggttgctagaattgaatggcagtattgagttaaaatgaatctagcatgtactttgaatttaaattactattagaataaaaatacaagttaaaactttttgtgaagaactaatggaatcaagaatatacctacagactccaatctgaggaaacttctctagactataacattcttaaaagcaaggattgtatttgttatatttttctcctcccagcctgtagaaggcattcatttacttattgatgtgaatattttagcaagtggagtgatgtggcattcatcaatttagtcatgcatttaccccttcaacaaaatatgtcatatttcagtgactgtatgagagagagtatagtggggtagttaagaacagggactctggaccttgattacctaaactcaaaaccagcttagccacttactaggctggatacccttgggtaagttatttgatcttagtgtgccttagttttctcatctataaaatggagataatagcccctcatgtagttgtgaaaattgaatttttatacacacacacacacacacacacacacatataaatgtttacgattgttcctgccacatactatttaataaatgttagttattcaaagatacaacgtaaactctacccttagggaacttgcagcctctggttagctatattcttacatagcatgttataatgcagagcaaaaagggataaacactgtaaaagctatccacaataaaaagtatcatggacgttcaaagcacaagaaggtaatttccaaaaggggaaactggggaggatttcactgagaagaggacatttgagctaagataattattatgtggcctttattcctgaactgttaaaattctagaactttggtagaggcctattttgttccttcagattgcatttatctctggtgatatatgacacttttaagaagtgaggtgtactactacttatattagtcctgtatcttttttagctggaggtgctataaggctgagtaataaatacttctcaagggagatgaaatataagtatagttttatgtcagactcttgtaagtactaacttaaaatttaatttgcaaataatagcatattatttatcatagtctgaccacataccataattttaaattttttattttgtttatcttagggattgagtcctggctgttatgatacctatggtgcagacatagactgccagtggattgatattacagatgtaaaacctggaaactatatcctaaaggtaaagacctttgaaaatatatcatatattgatattgcagatcaataggccctcttctctggattcaaatgttaaataatcatggtattggaagcaattatacatcctcaaactatttataaacaatctaatctaatctaatctgtcttattttaaagaacttcaggggaaaatatgcagtctctttccataacgtctccagagtttaaccacttacttaagttaaaatcccttccctgcttgatttagctaagtcctcattaacaatttccttattgtagccctatggaaaaagaaatactgaggaactctttgtgttgcccaggtcagtgtaaaccccagctacctggttcctgaatctgactataccaacaatgttgtgcgctgtgacattcgctacacaggacatcatgcgtatgcctcaggctgcacaatttcaccgtaagtgttatttgcttagctaagtaattgttgtcacaaataatttttgttcatgccaaacattatacatagaatgtatctgtttctgctactacagcagctttcttgtaagcagaccaaaggcagaaaatggtatgcagtctgattttatttttttaaataatggaaggcaaaggagaatgtactaaggtttttagttttcaggagaagcttagttttcaggagaagacataaacagaccacagtgtttacccagaaggcatttgtgaaggcccaatatatcaaattgctcaatatgtagagtgggtgagcttgtagaagccccagtagttgcttcttggccccttcctcgcagtccctgaaagaattgctagggttcttcaaagtacattttgaaaaccactgccataaagtaagcaactgaagagttcagccccctctggtctgtacaaatcaagatgtcatatatttgagttctagaaccattgatactaggaaaatactctgcaaaagattgaggtgtgtggaggtttcttcataatattcctactcctgagactcttcttagaatgaaatactggaagatatctattcacagggaggtgctctgatgaaaataatgaaaaaaggttgggtaggtttgactgcatgcctgtctgtcctgccccatctccttaagcactacctccccaagtgttgctgggtgctagattataattacatatgccacttgagttatgccttcccaacaatgagaatactatttccattggaatgatactcaacactcatcagctttgctttgtcactggagaaccaccagtgccactggatcatacagacaggtatagcagagctatactagaatctcataattaatagaaatttctgcctgatacaaaaacccaggactttctacataaagaagcagagactgtgctttacaagtgttgtcacaacattagagatagatgaagcctgtgatagcaaaaggatagcactgaaaaaacagagtcacatacattcttctgaacatgcccacagcacagaaaacctggcaggttttatggcccatattgtgtggagttggttatagtagaaccaacccccgacccccaccgccagaacaccattataatttaagctaaaataatttgcacttaaataaacagattagttttttcttaatttttataattccttaatttattcatccattctccatttatttattcatttgcactctcatttttgtactgtttgttgatgccctgagctagatattactgaataatgcaaacataaataggactactaatctctatactgctgtagccttattacactattttcagttaattacttatgaatttctttgtttaatgtctgtctcctgctctactcagtgatggctgtgatttagtctcttgtccactgttgtatacccattgtcaggtacaggtctgccaccttgcagcctctcactcactgcttaatgaatttctttctcaaataatttgagtaaaggcattttgagtaggggaagtgagagaattacacatataactgtaatagagatacaatatgagaagtttcatgagggataaaataaaatgtggtgagatcagaaggacctttgctataagtttggtaactcccaactatgtcttactgacttcccactagaaataggtctggagaggtctgttgcatagaatgtctcttgcttttaatcagtagaatccattgaattgggtattgctagatatttagaagaaataaaaattgttgtattgctccagcaatatgactgtacaagagggattcctgatgtggtcactcatatagagttgaatttttttttttttttttttttttactagttattactgactgtaacaaacttcaagagtggttgaagctggaatgtttataactaatataaaccagatgaaaatatgaaaagtgaaattataattagtgatcataataaaatgtcatacttattctgagtggaaatattggggaaagtatagaatatttgagaaaaaaaccccacaccttcaggatagtaatacttgcttcttacattttgactttcacatcaggccttccttcctaggaatcagagttcagacagaggagaggtctctttgggctgagtttcaggagtgactttaggatacatttgaattgagccttgaagtctggggaatgcaccggggagcattaaggaaaggaagcccagggcaagtcaacgtcacaggcaacttgcatggcaggaggaaactgcagggcatgtttggaaaaacaagtcttctagtttggctaaagcatgaattttgtggagttacgagttggacaaaaaggatggaaaagtaagttgagccagatggaagacagccctgaagagcaggctaaaatttattctggaggcagtgggaggctgaagctttttgagcaggaagtgtaacttgcctaaggccatcaggtcagtctggtggctgtgtaagcagcagtgagtgtgactctgaagacatatcatgtatcagttcactgattgcttttcctgccagatatttaagagcattctgttgatgtgtaaaagccacccagtaaatagttgaataggtatgtgctgttaatgtaccctctctccttcattttcctcactgaaacaaaatgtacggaccaggtgactctgaggcttctttcagttataagatactatgtaagtttttttttttctcctcacagaatttactgtttggaaattggtagtttatgatttgaataagtgaattttcacttccttacatgaagatctatggtcacatttaaagacagtaatatttgattgattagctttggtccagtttctgcctattaatgtattattctacatccaaagccatgctggagaaggactaattcaagatggagcagaggccttgactctacttcttggtggacatgccacccttgttccatggaatgaattcccctggtcagggatgctggtcccagaagtcctgctgtactcttgagtgtttcagaagtggtttctttgcctctaaatgtgaagagtgtaggcatcaggcatctctgctgttgacatagtcactttcttcaaaccattattaaaatgatgtactactgcataatttcacaacatgattgctgcttaggtggagggaaactgttgcataaagtttttaaaaggttgactttaaatttgtctgttgtactcattcattatattatcaggttaataatttgtcttattttgtcttcttaatctaggtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttata

SEQ ID NO: 103 - DNA, 11936 bp, Homo sapiens; identical to SEQ ID NO: 102

SEQ ID NO: 104 - DNA, 12404 bp, Homo sapiens
gggccccgcggcccgccatataaacccgcgcgcccgccaggcgctgcggccgtcccgggccgtgactcctcctttcccccgccccgcctccgttcggagagccggcgggcgggcgcctctcggccaggtacgcggccggctgggataggggtcgcgggcgggctttggtcgcgcagcagccggtcctccccggaggtaggcgggcgcgggccctgttgggtctttgggacgcgggtcccgctggggccggggatgctgctcgctgtgagcgcgggtcccgtccgccgctggccccgggcgggcgcacgggggtctaaccttggggggcggcgctgccgcctggcccgggtgccggggttcgcgtcccgcggggccttcctcgctctttgtctcttctgagtgaacttgatgacccccttcttccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctggtgagtacccctcctggttcttctggaagtaaaaagggtgtcttttcggttgaaagtacttttcagcctataagaaacatgcatttgaaactggaactatccacagattgaaagtgtgcatctccagtcttgggatttagagaaatgaaggaggggtagagaggacctggcacccccgagggcgggttcgggccacagctctctgaagtttgaggaagcacagtgatggagatgaggcagggagataattggctgttcaagcaggtgctgtgccaagctgactgagggcccttccctcctggcgtccgggtacagccccagctgtcatcccgcgccagccgccccggattggccgcctggggaactggtgagcagcgggactgaaaggccattggtcgcggcagcaaacatgctaccctgctggataactgaaaacaaacccgtcacatgggttcaggaggcggttgccaggggagcaacttctcagcacttccttttgccgggtcgctgagtaaactgtggtctgaagccaaaccgcctacaccctgaactgttagagctctgtagattacgttcttaaggaaaagagtaacccccttacggcgtttagattttcgtacacccaagcagtagcatagatgctgtacaacgtaacactgagtcagtctgaactgtggacacggggactgctgggtgtgtgtactagactttcttggctatcattgaaccgcttttatagaaatgttgagttgatcttggctcagcagatcacttactgctcctgtagtcacacagcatttgtttatttaacgagcttgtcgggtgctttctgcaacctcaactctataagctgttgaaatgttaatccaaaagtgagcaccacaagcccctatccttaagcagcttagagtctggtggggaaaacaaaccagtatgtcagtgactccagtgcagtgcagggagcatcctgtttgctttgtggctgacgtttgtcagcttactgctgaccataggcttcagatgctttgctgtgttcattccttacagcaataccatgtgtagcttcatttatagatgtggcaactgaatcacaggtgaagtcacatccaagggtgcgcaggtagaaaggggccaagccatcgttggtaactgctcctgctgccttggtaggtgtgtctcctgcactgtggaaacacattgcctcagttgactcactgaaaacagcaagcagcagagaggtttgtagcagattaacagagggctccgtgttgaagaactaggacaggtgtctgtaattattaagtagtgggtagaatgttttcatatttgttctcggagggacgggatcctctttcgtttttcgaaacactttatgtggctgtactaattgaacattttttgagaactatatctagatttaaaattccatgtttcatatacatttggcagaatagtttctttcctttaaccaaaaacttgatcttagaaatgaaatagtttagccttcagtatttgtaattggatcctcaagggtttctaggaatatctggacaatttctcatactctcatattctacttttttttaaaccatcagccaagagcataagtaaaatttttcatagtatgttttttacctatttatttattaagctatagtgaagtaaagttaatttggggggtccatttttcagaactccaaaattagaacctgatgaagtataataaattgaaaacaacattttttatctgaatgtttgatgcaaactgtgtttcttgtttctcagttgaacctaaaaggtatatttctttcatactagactgaggtgaaacaattgcagggttctcaagagccctgggacacagtgacccttgtgtcccagcatccaaccccacgggccggcaccccactcccccctacagacattcattcctgccttcatctttgccattttacttctcttttggaatgccattccttcccacctgtccaaattccaagttcatgtctataaagaataactattccagaccacagtgatctctttctctgtgtcccagttacataatccttataattttacacatgagaaaacaaacatgcagagccacgtcccatcagagggcaagctgggatttgaggctgagttttctcttcttggtctggtgttctttccgcagcttgaggcttgaccatgcgggaaccagatggagaataagcgaagcctatgtggggctgtctcgccccgtacttgcccatgtgcatgtgtgcacagtaggtgctcagtgcctcgtacagaacatgctagaactcccgaaaatcaactccagggccactctaggagcatgtgacccagactgtcaaagtcacatcagcaaatatgtatctcatcacgtgcccagccccagtactgggtggtggcaggagtgtcagagctgtgatgtgacagggtgtggacagatgctaacctttttattgtaagatagaaatcacaccggatgaaaagacaaggtgaactacatagtcatttaagttctgtgtgctttaggcaaatgtggatattaaatataaggttacatattgctcatattaatatgaataatccctgcttgattccttcctgtgtttactgagatatgttcaactacactaaataatagtgatttttaaaaaacttttctaaacagtacaattttgtgggagtggtactcaaagagaacaagaatataaaatcactctgaagttatagctgataattttttctaggaaaaggactggtttgagtaatgtactgtgttactaatgaccacgttgaaattctggaacttgaatctgctgtattctaacattgtcaacttttttaaaacagctgttgttggcctactgtacccctgtatcgacagtcacctcggagaaccccacaaatttaagagagaatgggccagtgtcatgcgctgcatagcagtttttgttggcattaaccacgccagtgctgtatccttaattttctgtgctacgtccagagtatcttcttaggttatatattgaagcgttttgttttgttatatactcaaatgactccatgtcataatacagacatgatggtggtacctacccatttcagattactaaaaagagaaagaagaatggggctatcgatgacttcacagtaaaatatattgttttatggtcaaaataaatatatatttatttatatttttatatatattatatatatttttaaatatatatataatatacataataaatatatatttatataaatatatataagcactttatatatagctttcagcaagtttattcttatggttaagtttttgactcagtgatggcagggagatttcaggtgatcttaatgattactgtaacctgtatccaacaaatcctttctttagctcattacacagtttttatggacagtgaattatctgtggtacaataataaaatacccatgtttttaacccttgtggttttacgtttttttatcttaataagagtcagcaaacttttccttaacttttatatcaccagaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtaagtgtgtgttttcaaatattggctttggaaagcttacttaactttcattaaaacatccactaagcttagatattttcatattttatttgttttttatatagaatgatacagatttaggcatgaaattctcaaaaatgctgctatccataacttaatgtaacgcaaaggaaaaccaagtagtagcagttacaaccaaacaaatatgaacattcgtaacattggatggttgatatgcgttctgcatatccccactacagagaatctgtgatgtagaattgagccaggtgaaattgactgctaaggtacagtttcttttctcgctccaggtatacatccccagatttcctctatattcgttcttggctcccttgtatatttttctcaggaggcgtcacggtggggaacataggacgacagttagctatggtaagtgaaatgatcatattatcttctaaaacttgtgtctctttaccttgatagaatgactttacatgatacattcaaatttgcgttcatatattctggttcagacttgagtgacaactactgagaaaagcttatatttaaaaaaataggtaatgatacccaggtaattctttgctaaattataaaaattcataatatttgatctagaaaaggaactagagccctcgcactgcccctttgaattgcagatgtggtcagtgttctgaattcttgaaatttctgtagtaagcagtagagaaagtgactggtgtgtgagtgtcccctcctccttcaccatcggaagcagatctggatgacctcatgcagtgatactttgctccctgagcatcagtccaccagtgtttcttttcacaaaatcagagtggatgcagatgatgctggcctcttagtccacagtcaagcaaatcgagcctgaggctgcagagtctgtctcgggccagggcagggactaatgtgggcgggcaaggggacagcctggttcaggcaggcagcacctttctgtggggcaggtggccctgggcatggagaagtggtgatgagagcaccgctgcacgtggccgggtcaccatgtagacggactgtcctgcctgaacattgcatctgttctcagctgcaggagaaagcagtgctaccccgcagagcttctctcacagcccccctgagggagacggaaaggtagtgaactccaggatggctttagcagttctcattagttaaaaattgacatcttagcacttcaatttaaaaacatagaggtggacttttaaatgttattttgagttgactttggcaggctgaaagaaagtaaattaaaaaaaaaaacaaaaacctagagctgttgctctcggagataagctctgggaaaacttatcttagtacctcatgctatttttaaaacagtacatttatttttgccagctgatacccttctgtgaggagttgaatttgaagaccacttggctgtttcacaaaaccagaagtaattacaggtagaatttgcagtcttccactggttactgactctctgctgccaaatttctcatgatggagaagaaaggactttgcttgccttttttttttttttttttgagacagagctctggagtgcagtggtgccatcatagctcactgtaaccttgagctcccggactcaagcaatcctcccgcttcagcgtcccgagtagctgggattacaggcacatgccaccatacccggctaacttttttgctttttgtggagatgttatctccctgccttgtccaggccgggctcgaactcgtgggctcaagccatcctcccaccttggcctcccaaagcactgggattataggcgtgagcctggccttgctttttttaatattaaaaatctggtcggatggtcccacatggaaatagtatgttgttttcatgcattcgccatcatccccgttaatagtcttcaaaggagagctggcaactccatcattgctttcttgctgtgagatttttgtttcggtactctttgggagagaattcctaagaaggtttttagaataaaattgtcctcaaccagattgactaattacacattataactacaacttgaataacatttaaagagttggttatttctgtttgataggttggtgctgttatatgtcaaggctttttaaatcggttttaagaaataagcattattttggtggaggtagaaatttcacaacattcataagttctaaacatctagaaatggttggaggaaacattttcgttttgaagatagtttcattaagtaatccctgctgtgctcctttgcttacagaaaaaaatgttaaagataactcaaaataggatagttggtgtaattataattctccttacttcagctttctcttcatcctttttattctttaagcttgggggaaaatgtttggatgttctcgtatcttaaaactggaggagagaggctgggcgcggtggctcacgcctttaatcccagcactttgggaggctgaggcgggcggatcacgaggtcaggagatcgagaccatcctggctaacacagtgaaaccccgtctgtactaaaaatacaaaaaaaaaaaaaaaaaatagccaggcgtggtggtgggcacctgtagtcccagctgcttgggatgctgaggcaggagaatggcgtgaacccgggaggcagagcttgcaatgagccgagattgtgccactgcattccagcctgggtgacagagcaagactctgtctcaaaaaaaaaaaaaaaaactggagaagagagatcaccaccttaatccccttccctactgggctatcacatgaaactgacctctgaggttctaagcctaacccgcctaccactgtttttattcataaatacttaaatccttacctctggatcccaactgttactctttttttcacttcaaaatttgcaaactcatttctatccatcaaaccccggaaatggcccaggggcttcacagtgcagtcccctccctcctgctgcatccgttcctcaggctgtgccccaggttgcattcgtggtgcgtgttttctcccagggcagccttccccacattccactcttgtcatactgttgactcacaaaatggaagtggctgaatgttccagggatagtgtctaagagctattggtttaaggttgaaacctacaccaagtaaggctttgtgaagggagatgacgagagtgaagttgttgacagtctgaaggtgaagagattccgaggctcagttcagcaccgggaccagacccgcccagatccagggtaatttgaggtctgtgtttggtgctgatggttttgcccagtgcactccacaccctctccttcttagctgtctcagttctcttcagatgcctttgttctaacttatgcttccctcccttaagaagaaacatagttacttgcaagaataaccatgctcaaaagttacaagttggctttgcttcaagttatatggtctcctagctttttctatgtggtatttccccccacacatgccgttgtcctttgtgtccgaaaatacagcagaaacatttgttatcagcctgttacggtttttttgtttgctttttgtttgtttttatttttactttttttgagacggagtcttgctttgtcacccagactaaagtgcagtggcacaatcttggctcactgcatttgaaccgtctcccaggttcaaatgattatcctgcctcagcctcccaagtagctgggatcacaggcgcccaccaccgcacctggctaatttttctgtttttagtagagacggggtttcgccacgttggccaggctggtctcgaactcctgacctcaggtgatccacctgcctctgcctcccaaagtgctgggattacaggcatgagccaccgcgcccggcccagcctgtatgtttaaaagaaaatgagtctgtaaccatcatttatagaacttgtagttgttgctgtttgtagcttcaagtcctttctcaagagtaagctgcaaactgccaacagcaatcaagcctgtcctgctgccactgcccggccccactgggccacctggaggcagagtcccgcccacctcagtgtcagcttgggatttgatttgccgttcctgtttttgattgacccaattcagctgctaatgataataatactattattgttattgagggtttacatttgttgggctcttactgctgcacaggaggcattgtgctgagcgtttccattgttagccagtttagtcctcataacacaagtctttgaagtagaaactattattagcccatttttaaaaggggaaattgcagcttaggaagattaaacaacttggccaagtgggtggcagaggtcgacgtggcaccgtgcttctcattagcataccacactgccctttcaacacatagctcgcacctgccttcaccctggaagcaggtttacagcagcctgtgttggtgtctgggttgccatttacaatgtgccaccattaggcaacactgctggaagtccctgtgccacgtgtcagttccgcccgggctggctgtcgttcgtctctggcgtctttgccaggcctcactgtggcctctgtcgaccagggattctaaaagtccacttcccatttatttatcagcacattagtgaacagggagtcaaatgtgatgaccagttttctttccaggttgctgccaagagtttgctcttttgttttctcaccgcagtttgtatagaaccctcccagtgttcatatctaaaaattggcagtgctttcacatgatcaattcctaaaagcatgtatgtttcctagaaggtcttattgtgtgtgtccccagggtagtaactggcatacctgggtgactcaacccagactcatgactttcttacctgtctgttcagatgagaggctcttgctgttttctggatgagtaatctccgtcattgctgaaggtgaggagctcagctccttcctcttaaagtgagtggagggcaattaagtaacgtgggaagtcacgattctgagggaaaaaaattctgtatggaggtttctcttttgccctttagcagaagctccgtggcctcaggaaggtcatttaatctctctggctttgcttcttcatcagtgaaatactgttctccattaagaatttaccctgaggtgcctggtcatagtagtaactgtagtgtctacctctcagaagctctgtgagggtcagatgaggaagaacatgtagaaaggatttcccaactgtgaagctctgtgtgaattgagggcacacagagcttcagtattacaaagcatgacctatttccaatgtctgtttcaacaaactgctggtaaggtgggttataacacaggcatcagatactaataaaggtttgtggcagaaacctcccttctgataaaggttcaatcccttaaattgcagttagaactttcaggaacctatcataccctaagcatcaccatgctttgataaaattgggtgtttcctttatatagatattaatttagttaaactttcaccaatatcttacacttatataacaggctttatataagggcctcagcagcgtaatttcacctgaggcagagaattatcctaattttgcaggtgagagctgtggctcacggggccagagccatgaagacggtgcaggggagctgggagagctggcctcggtctccagttctctgcacatgtcccacctctcaatcttgttgcttcagtcaaagaaagtgtcaatctttcccatgttaggacctacttaattggtaattaaaatatttatacatttagtgctaattttctctttccttttttttttcctttctacacatagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaa

SEQ ID NO: 105 - DNA, 10079 bp, Homo sapiens
accaggccccgcccagcggccgcagccagccaggccgcgcccgggacgactgcagagcgcggtgagtgaacgcggccagagggagggactcaggcgtcccaggtccccgccctgcccctccccgggggcccgacatcccgaccctcagctccctctttttcttttggctccggcagtccgttttagggccgcagagccgccttttaaaaacacaccctgcatcccttccctgccctggggcttcgggcccaccagccccttggatcccttcccctcttgcaggatccgtgaatccagagccccaagccccagccccagccccatcctcattaaaattctgagtccctccctccatccaggagtcaggaatgtaggccaaaaatatcgctgccttccagacccaggcggctaggcttgcaacacctgctcggaaaacccgagtctgagctttaatggttctattatgatgatcatgatgatttatttttaatagagcagagtctccttatgttgcccaggctggtctcgaactcctgggctcaagggatcctccctcctcagcctcccgaaatgctgggattacaggcgtgagccaccgcgcccaggcctgattgttcttttgagccaagaatctgggcctcagcctaggcatcctgtggagcccaggaatccgggcccccaactgctaccgcgctagctcccaggaattttgcccccaacacaccccacccctatccactgtgatatctgagacctgcgtccagcccgagtcccttaccctgcggcgcccggtgccagtgggtactaggggagcattttgccgccccttcaagtccttaaatacaggaatctagcctctgtttcttggggagacccatcagtcagggatcgtagcccagaaccacctaaagcccaggaatactgctctcaattctgctctccctcagggctccaagagacagagatcctagcccccccattgaactgaggggcctggtcccccaatccgctgcgacccaggtgtctaaggtttcatccggcaaggaaggggtgggggcggaacagaccaggaaggagggggtaggaagggagcggaagaaaggagtgaggtgagacgggggcggggacctgagctggggggctctgcactaaacaaaccctaaacatgcggggtttctatggtaacggtcttccctggcctacccgggagactcctctagggctgtgtcgaggagggcagcccccaggagtctccacgccgccagctgttgtgtcttcctgttttgtcaccacggcaaccgtgacctcagccctccaccctgctcactggggtggggcgggagctccacgctacttttactctggggggcgtggtctgctcttggccccgcctcggggcggggctgggatagcccagactcggggaagtccctgtccaccgccctagccggagctgcgccccgccccggccccgcccccgtcccgcccgcgctggctccccagccctccaaccccacccagccctcagacccttccagctgccgctgtcgtctttgcttcagccgcagtcgccactggctgcctgaggtgaggttgtggggaccccagagggcataagcaacagtctagggtctttatggccagagagaggaatgggctgggtctcagaatgtctgggtccctagaaagactggggctgggccaggattcttggggttctgcagaggagagggctgaggacctggactgtggaggtcatacgtctggaagagtggggaaggggacctggactccggggtctgagggaggaggggctgggggtctggactcccgggtccgaggcaggaggggctggggggtctggactcctgggtccgagggaggaggggctgagggcctggactcctgggtctgagggaggaggagctgggcctggactcctgagtctgagggaggaggggctgggtctgcgggagtagagagatggggactcgtaggtgccctagttggaggctggaatctggtacgtggaggtcctttaggaggggaagcgcttagggttaggtgtcctgggtttgggaatgagaatggaaggaattcagaattactgacccctccccatccaggggacagacagaatcggaactttgggctcctgaaaggccgagggaggggggtgttaagatccagccccgtgcttccgaagtgcagaaggagctgggaaaggaggagaagacagggctgcgtcccgcacctctgggtgccgagagccgaagctggggttccggggcccgattctcagcgtgagcgatgggtgtggcgtctggagtggacgagggaggacactgaggggctgggtgtggcccggagagtcgggtgcgctgcgaggaatcccggaggggtgtttcctcaccctccagggtctggctgcgcattcctgagctctgatctcgggcgatggctggaggccctaagggcggggtggacccctcccctcccctcccctcggcgcgcccccctcccctgcgcgcccccctccgcggctagcccaccttccgcgggggacagaatgagtgacgccctcgctcgtcctcctcccctgcttgggacggggcagtagcccgccttctagagcacgggacgctgggccagtcccgatttccttctccttcgagggtcctggaggggcgtgggggcaggcagtgtctggctccgggtggagcctcccaggtgctcccgcaagccccgaatggcgattagggaggccgtgggaggcgtagctgggcctcgggcctgacgccagcaccgcgtgcagtttccggcctggagcctgagcccctcagaggcccgggtccctgcccactccggtcttagagatgctcttgggggggctctcagcccatgtttatagggatccagaaatgcaggcctccaaccctgagagtcggggtccccaccccccggaaatccgggagagggcgggcagccccggaggcgggcgggggtccgggcaccgcctcctggtccctgacacattccagatgcctgggccgactcgaagcccttataaggcgcggagacaccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagttaactgaacggggaggggagggggcggggcttacccggggtcaccgccagggccctgctgggttccacgccacgttcctgtctccgcagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctggtgagtaggcagcgggcctggactccggggtccgagggaggaggggctgggggcctggactccggggtccgagggaggaggggctgggggcctgggctcctcggtccgagggaggaggggctgggggcctgggggcctgggctcctgggtccgagggaggaggggctgggggcctgggctcctgggtccgagggaggaggggctgggggtctggactccggggtccgagggaggaggggctggggtctggactcctgggtccgaggaaggaggggctggggtctggactcctgggtccgaggaaggaggggctgggggcctgggctcctgggtccgagggaggaggggctggggtctggactcctgggtccgagggaggaggggctggggtctggactcctgggtccgagggaggaggggctgggggcctggactccggggtccgagggaggaggggctgggggcctggactccggggtccgagggaggaggggctggggtctggactcctgggtccgagggaggaggggctgggggcctgggctcctgggtctgagggaggaggggctgggggcctgggctcctgggtctgagggaggaggggctggggtctggactcgtgggtctgaaggaggaaggattaggtcctgggctcctagatcctgggagaaggaccaggaagcttgggctccaaggaatagggtcccagacactgaggtatctgaggaagaagcgagtccaggccctggctcctttgtctcagggagctgctgtcctgcgactgccacgaagaggttaaggcctgtgctactgccctgcaaagtgcctgaagctgaaaggaggaagttactttcctgtggctaggagaggccttgggtttagtcctgtggctgcgttgagacagtttacagcctaaggaaagaactgggcacctggtttctaagaggacgggcacttgattcctgggggccattaggacaaggaggtggaagctgtaggttttgcaaggactaaagaagcaaattggttttctggagtctggggcatctgggatccttcaggctaagggtccagggccagaggtctgaccccttataacaggacggtgatggccaggcgcagtggctcatgcctgtaatcccagcactttgggaggccaaggcgggcggatcacttgaggtcaggagtttgagaccagcctggccaacatggcgaaaccccatctctactgaaaatacaaaaattagccgagcatggtggcacacacctgtaatcccagctactcaggaggctgaggcaggagaatcgcttgaatccgggaggcggaggttgccgtgagtcaagatcgcaccattgcactgcagcctgggtgacagagcgactccatgtaaaaaaaacaacaaccaaaaaacaggattgtgaggcctagagagagttcagtggaagggcctggggttcctactggacagttggaaatctggggagctgagtttcccagaagctgggggaccagctggctgggttttggggagagaaggtggaggtagatggactcagtatgcaggagtgtggagggggaggctcaaactagcttttttgggttgcagtactccagtcctaaatctcaggtgggagttagactgagagtgaaggttgctaatctccaaggtggggggtagggagaggaggaggccgctaagagtttaggctccttgtcagaagggaggggagatctcttggttttccacggctgggatctctatgagaagatatcctttatcgggaggtcggagctcttattagatgtgggtccctgagagtggaagcctggggaggttgggccgtttagaggctgcaaatgtctaggtcactgttcgatggaagaaggaagtttgctcacagggtctggggtgcagagctctgaatactgaaagaaaaggaagttgagagatggggttttcagagcctgtggaagacaagcgttttgttctgacacttgggttgtggcaggaggcagaaggaggatgctttattttttatttattttatttatttttattattttattttattttttgagatggagtttcactcatgtcacccgggctggagtgcagtggcgcaatctcggctcactgcaacctccacctctagggttcaagcgattctcctgcctcagcctcccaagtagctgcgattacaagcgcccaccaccacacccagctgatttttgtatttttagtagagacggggtttcaccatgttggtcaggctggtcttgaacttctgacctcaagtgatctgccagcctcggcttccgaaagtgctgggattacaggcatgagccactgcgcccagattattttattttttttgaggcggagtgtggctctgtggctcaggctggagtgcaggggttctatcttggctcactgcaacctctgcctcctgggttcaagtgattctcctgcctcagtctcccgagtagctgggattgcaggtgcatgccaccacgcccagataatttttgtattattagtagagaccgagtgtcgccacgttggccaggctggtctccaactcctgacctcaagtgatccacccaccttggcctccgaagtgctgggattacaagtgtgagccaccacacccggcctatttgtaattaaaaaaaattttttttttttgagtcagggtctcactctgtctcccaggctggagtgcactggtgcatcacagctcactgcagccctgaccccacaggctcaagcaatcctcccacctcagcatcccgagtagctgggaccacacgcacacaccaccacacccagctaattaaaaaatttttttttggtaaatgaggtctccctaaggttgcccaggctggtctccaactcctgggctcaagcaatcctcctgcctcagcctcttggagtgctgggattacaggcatcagccacacctgtgcctggccagaggggtggtgctatagagtacagagtgctaaatggctgagctactgagtcccttggggagggagggaaagagggaagcacggtatctggagtgggaagcaaacagtgtagttgtacagtagttaggtcttgaaagagagaagaatctcttgagaaggaggaaaataggggcctagactcctggattctgatacgagtaggggaggagtgagccttgaaccggaggggacaggctcatccctgtatgcccaggactgtccccatttgaaaacccaaggctgggcccggtggctcacgcctataatcccagcactttgggaggccaaggccagcggatcatgaggtcaggagatcgagaccatcctggctaacacagtgaaaccccgtctctactaaaaatacaaaaaaattagccgggcgtggtggcacatgcctgtaatctcagctactcgggaggctgaggcaggagaatcacttgaacctgagtagcagaggttgtagtgagctgagattgtgccaatgcactccagcctgggccacagagcaagactctgtctcaaaaaaaaaaaaagaaaagaaaaccgaaagccccacatcttgggaactccctaattagagctcatattaatttgtccctggggtaggcaatggctaagggacctggattcttatgtttgtgactgtataaggacactgtctttcccctttttgcagccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttcttttttttttttttttttttttaagacggattctcactctgtggcccaggctggagtgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggctttaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatcaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatatataaatgtataaatatatattttatttttttttaaatccctggagcttctggttcctatcagttcctgttgttaatcgtagaaccgttgtcccttcccccattcccgtatccatcatgttctttttcttttaaatatcaatataaaggtaaaagaa

SEQ ID NO: 106 - DNA, 11936 bp, Homo sapiens; identical to SEQ ID NO: 102

SEQ ID NO: 107 - DNA, 2121 bp, Homo sapiens
agggcgcagcaggccaagggggaggtgcgagcgtggacctgggacgggtctgggcggctctcggtggttggcacgggttcgcacacccattcaagcggcaggacgcacttgtcttagcagttctcgctgaccgcgctagctggtgagtgtcccttctgtgtgtgggtcctagagctcgcggtctggtctggtctggtccccagactgacgcctggtcggtccccctcttgtcttacagcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaaggtgagcggtgggcgggtgccgacgcgactcgaggggccgggaaggtggggaagccccggtgctggaaggggtcagagccgccttggcttcctatcccatcgggacccagattgcttgggggcagggggaattggagtataaggtgagtgaggcggaaactgaggcacggagtgggaaggagcgttggtttcttaaggaaacagcacctcccccgcctgtgcgtttcgttttgaagccgctctaataccccttcctgtgtgctctcctttccagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaacagtt

SEQ ID NO: 108 - DNA, 17259 bp, Homo sapiens
ctttccgccctctccccgcctccttttcgggcgtcccgaggccgctccccaaccgacaaccaagaccccgcaggccacgcagccctggagccgaggccccccgacggcggaggcgcccgcgggtcccctacagccaaggtaaggcaggaatctcctggactgggtcgcggtcccccggcttcccggaagcgcagtgcgcgggtggcatcactgtgcccggagcccctgcgcgccccggccatccccaccccgagggaccccctacggaggcgacctgggggctgaggtgagcgcttgggcagcagcgacggggaggggtgtccaccccacccctggtgcgggccggggcgcgcaggcctggaactcggggttcagactccccgcgactcggaccacgcggctaagcgcgctcagggtcgcgtgcccccgccccgccgccatgctgggcgccgtggtggccgcgcagctgggcgacagcaggcgtgggcgggggtggggagcggcccctcagcggtccctaccgcctgaggccagggcccggggacttttattgtgacacggcgggcgcccggctctgcttagtcatggtgacctgcgcgcgctccgcgcctcccccacgcgcagcgatggaggcgccggggctcgggcggtggaggcggagccggagcgcggccatggcggggtgagtgaggcgggatgtgcccgggctgcgggcatcgcgggccgcgagcgcccctgcggccgtgcccggagaccaggaaaacgggcgccacggcccagggcgcctccgagttccccgccaggactcggagggccaggagggcgcgacctgggtggatatttttgttggacggcgcaactcttggggtggcccgggagcggcggaaaccgagcgagagaaccaggaggcgctgcgcagaaggaggcccgggggctccgaggcgttgaggggctcgatctgcgttctggggttggcagccgagaggccgcggtggggtcacttcctcgcctcactgggcctggtggaggctcaggaggggcatgcgcagtcgcccacttgccgctttgtagggtgggggaagtgcccggtgcccaaggggcattgttgaccgattggccaaagaccaagaggcaaacccagggccttggcaccagagtgggggccgagtggcacccagggagggtggaggaggccgctctggcaggcacggtggcagggcagttagccaaccacccgtttattgacccctgcgcagtgccaggccccaggcgagaggcacaggagagggttggcccgacgccgacctacataggtctccctgccatttgaggcgctggggccggggacgagagacagtcgatcaacagacaagcaaaggaggtcatttcagttcctgacaagcgcagtgatgacaataaaacagggaagaggagactttgagttgagtcccagaaagaggggagtgagaacttgcagatccacttgtggggagccacttggagatcccccactccttttgaaacgtaactcacgtctgggcacagcagcctatgcctgtaatcccagcattttgggaggtcgaggagggggatcacttgaggccaggaggttgagaccaccctggccaacatggtgaaatcccatctctactaaaaatacaaaaaattagcccatcgtggtggctggtgcctgtaatcccagctactcaggaggccgaagtatgagaatatcttttttttgttttatttgagatggagtcttgttctgtcacccaggctggaatgcagtggtgcgatctcggctcactgcaagctctgcttcctgggttcacgcctttctcccgcctcagcctcccatgtagctgggactacaggcgcccgccgccacacccggctaatttttttgtatttttagtagagatggggtttcaccatgttagccaggatggtctcgatcttctgaccttgtgatccgcctgcctcggcctcccaaagtgctgggattacaggcgtgagccaccacgcccggtcgagaatatcttgaactcgggaggcagaggttgcagtgagccaagatcgcaccactgtactccagcctgggcaacagagcgagactctgtctcgaaaaacaaaacacaaaacacataactcatctcctggccctccaggatccaggggtttccatgaaacccttccttaagtccttagctctcactgcactccttcccaattctccagattgactgtctcagcctctgagccactgcacttactgtttcctctgcctggaaaactactccccagcctcccactttataataattttcatccttgtctcagctccaacctcaccttctcaaagaggcttggtctgccagattttaaaaaactgcaccccgggtcaggcatggtggcttacgcctgtaatcccagcacttcgggatgccaaggcgggcggctcacttgaggtcaggagtttgagaccagcctggccaacatggcgaaacccagtctctgctaaaaatacaaaaactagccgggtgtggtggcggacgcctgtagtcccagctactcgggaggctgaggcaggaggatcgcttgaacccgggaggcggaggttgcagtgagccaagatcgagccattgcactccagcctgggtgacagagagactccatctgaaaaaaaaaaaaaaaaaagcaaacaaactgcacccgattctcacgttgtcacaatgctgttgtaattttcttcatgaagctgtttttccaggtcttgcttattttagtttatgattgctcctccctgcagttgtcagctctggcagggtaggatttttgtattttgctcactgctgtgtcttcagcacccagatcagtgcctggcatacagtaggtgcccagtaaatggtgaggcaaatgaaggaatgagctcaacatgctctagaaagggaaaggccgccagattgctgaagcagagtgatcaaagggaagaggtggcaggggctaattgcgtagggctttgcaggctgttgaggagttcagttttactaggtactgtgggaggcattggaggatccagagcaggggagagacatgacttcatgtatgttttaagatgggctcttgggccaatcaggttgatcaggtcggggaagtttgcaagtttgcaaatggattctgcttcacctactttgcaggaaaactgacctaggaattgctttatcttgcaaaacgaggcccggcaggtgctggcccagtcccaacccctgccctctgccctgtgctctctcccctccaggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggggaggtgagcggggaagtggggctgggggcagtgtcaggagaaggaccagggatggacgagtgctcatcactgtctccccttgagatgtcaaggcaggaaactggagaaaaaggaggttctgggctgggtatggtggtgtagtctccacagtttgaggggctgaggcggggggattgcttcaggccaagagttcaagaccagcccaggcaacataatgacaccctgtctctaaacaaacaaacacacaaacaaaaaacaactggggccgggcgtggtggctcatgcctgtaatcccaacactttgggaggccgaggcaggtggatcacctgaggtaaggagttcaagaccagcctggcccacatagctaaaacccatctctactaaaaatataaaaattagccaggcctggtggcgggcgcctgtagtcccagctgctcaggaggctgaggcaggagaatcgcttgaaccaagaggtggaggttgcagtgagtggagatcgagccactgcactccagcttgcgcaacagagcaagactcagtttcaaaaaaaaaaaaaattaaaaaacaactggggttctgagttccttgtctacacatgtggggagactggtgaacagctggggaaggtgaggtcttcatatgtctctgggctccctggtttctctggggtcaaagtggggcagagtgcagtgaacagcagccaaatcctagggtagcccagcctttcgggcagtcagcaaatgtttattggacacccgtgacaggctgcaagctgtaagtctgaaccttagtcatgttttctttggtccacacaatgtccttatactgtttttggtttcgttttcacatttctcagtgaaggaaattatctatagaaattgacaagagagggcagggcccagtggctcacgcctgtaatcccagcactttgggaggctgaggcgggtggctcacctgaggtcaggagtttgagaccagcctgaccaatatggtgaaaccccatctctaataaaaatacaaaaaaagaaaactagccgggtgtagtggcatgtgactatagtccctgctactcgagaggctgagacaggagaatcgcttgaaccggggaggtggaggttgcagtgagccgagatcgcaccattgcactccagcctgggcgacagagcaagactctgtctcaaaaaaaaaaaaaaaaaagcctgggcgcggtggctcatgcctataatcccagcactttggaaggccaaggtgggcagatcacctgcggtcgggagttcaagaccagcctgaccaacatggagaaaccacgtctctattaaaaatgcaaaattagcctggcatggtggctcatgcttgtaatcccagctactcaggaggctgaggcaggagaatcgcttgaacccgggaggcggaggttgcagtgagctgagattgcgccattgcactccagcctgggcaataagagcgaaactctgtctcaaaaaaaaaagaaaaagtttttgaagagatgaggtcttgctctgtccccaggctggaatacagtggtgccatcatagctcactgtagcctccaactcttgggctcaaggaggcctcctatctcagcctcctgagtagctgggactataggtatgcagcaccacgcatggctaattttttagtttttaaatttttttgtagagacagggtcttgctatgttgctgagactggtctcgaacctcctggctttgaacaatcctctggctttggcctcccgtagtgttgggattacaggtatgaagcaccataccaacaccaggccaagaagtgtttattgagcacttgctgtgggccagcccctgttctaagtgatttatgtcctttgcatcattgactgttcccaactgtcctatgaggcagtactacccttcagcctaggcaagcagggcagtgccccaggccctaagccttcgggagtcccatgtcttggtgttccttcctggaaattttctaagtcccccactggctggtaccagctgggatggatgttacactgatctctatttctctccttcagggatagattctttcctaccctctatgttacatgtggggttgatcagacgccccagggttctctggcgttagtcctagggcctgcagcttctaggaaagtggtctatacagtaggagaaacatatacagtgtttctttcttgtgtttgtatgaacatggggtactagattaaaactgattacatagacgagtgcctgacaacttttttttttttttttgagacggagtctcactctgtcacccaggctggcatgcagtggcactgtatcggctcactgcaacctccatctcctgggttcaagcaattctcctgcctcagcctcccaagtagctgggattacaggtgcctaccactatgcccagctaatttttaaaaaatatttttagtacagatggggtttcaccatgttggccaggctggtctcgaacccctgagctcaggtgatctgcctgccttggcctccctaactgtgctgggattacaggcatgagacactgcgcccacgcccgccccccaccgcccagtccttttttgtttttgagactgagtctggctctatcgcccaggctgaagtgcagtggcaagatttcggctcactgcaagcctccatgtcctgggttcaagcgattctcatgcctcagcctccgaagtagctgggattacaggggtgcaccaccacgctggctaatttttgtatttttagtagagacagggtttcaccatgttggccaggctggtctggaactccttacctcacgtgatccgcccacctcagcctcccaaagtgttgggattacaggcttgagccaccacgccaagcccccttttttttttttttgggggtgggggacagagtctcactctgtcatcaggctggagtatagtggcatgatctcggctcactgcaacctccgcctctcgggttcaagtgattctcattcctcagcctcccaagtagctgggattataggcatgtgtcaccatgcccagataatttttgtattttttgtagagatggggtttcaccatgttggtcaggctggtcttgaactcctgacctcaagtgatccgcccgacttggcatcccaaagtgctgggattacgtgtgtgagccaccgcacctggccttttttttttttttttctttttttagagacagggtctcactctgtcacccaggctggacttcagtggcacgatctctgcttatcacaaactccagctcctgggctcaagtgatcctcccacctcagtctcctgagtagctgagactacaggcgtgagctaccatgcttggctaatttttatatcttttcttggtagagatgaggtctcgctatgttgcccaggctggtcttaaactcctgggctcaagcaatcttcccgccttggtctcccaaagtaccaggattacaggcgtgagccaccacacctggctacaagaaatatttatccagggctctgtataccctagaagtagccttactttgaggtggccattaatataatcccattttacagaggaggaaaaccaagacatggagcatttcagagatttgcccaagttacacacctacgaagtggtcggatcaaaattccaactcatgctggtttcttcggagcttccactttttttttttttggagatggagtctcactctgttgctcaggctggagtacagtggcacaatctcagctcactgcaatctctgcctcctggattcaagcgattttcctgcctcagcctcctcagtaactgggattacaggtgcccaccaccacagctggctaatttttttgtttttagtagagacggggtttcaccgtgttggccaggctggtctcggacttctgacctcaggtgatccgcctgctttggcctcccaaagtgctgggattacaggtgggaaccactgtgctggcccagagctgtcacttgtttttttccacaacattctattgtgattgcttattttttccttttttagtctatttgccattttagaaaatgatttcattttaaaaaacaagatgggtgagttggctcgtgcgtataatctcagtgctttgggaggctgaggcaggagaatcacatgagcccaggaatttgaggttacagtggcacctctgcactccaccataggtgacagagcaagaccctgtctcttaaaaaataaactcagacatcccatctctactaaaaatacaaaaattagccgggtgtggttgtgcgtgcctgtagtcccagctactcaggaggctgaggctgaggcagaagaatcatttgaacccggagacagaggttgcagtgagccgagatcacgccactgtatccagcctgacgacagagtgagactctgtctcaaaaaaaaaaaagaaacaaaagaggccgggcgcgttggctcacgcctgtaatcccagcactttgggaggctgaggcaggcggatcacgaggtcaggagatcgagaccatcctagctaacatggtgaaaccccgtctctactaaaaatacaaaaaattagctggatatggtggtgggcacctgtagtcccagctactcggaggctgaggcaggagaatcgcatgaacctggatggcagagcttgcagtgaggcaagatcgtgccactgcactccagcctgggcgacagagcgagactccatctcaaaaaaaaaaaaaaaagaaacaaacagaaaactcagaggccaggcgcggtggctcaggcctgtaatcccagcactttgggaggccgaggcaggcagatcacctgaggtcaggagttcaagaccagcctggttaacacggtgaaatcccgtctctactaaaaatacaaaaacaaaaattagccgggtgtggtggtgggcgcctgtagtcccagctactcgggaggctgaggcaggagaatggcgtgaacccgggaggtggagcttgcagtgagccgagattgcacccctgcactccagcctgggcgacagagcgagactccatctcaaaaaaaaaaaaaaaaaaaaagccaagccaggtatggtgatgcacacctgtaatcctcaggaggctgaagtaggagaatcatttgagctcaagagtttaagaccaacggccggacacggtggctcatgcctgtaatcccagcactttggaaggcaagggggtgggccacttgaggtcaggagttccagaccaacctggccaacatggtgaaaccccgtctctaccataaaaatatgaaaattagctgtgcgtggtggcacacacctgtagtcccagcgactcaggaggctgaggtgggaagatcgtttgagcccaggagttcaaggctacagtgagctatgattgtgccactgcactacagcctaggtgacagagcaaaactgtgtctcaaaagcaaaaacaggccaggtccggtggctcacgcctgtaatcctagcacttagggaggctgagatgggcagatcacctaaggtcaagagttcaagactggccaggcgaggtggctcacgcttgtaatcccagcactttgggaggccgaggcgggcggatcacgaggtcaggagatcaagatcatcctggctaacacagtcaccccgtctctactaaaaatacaaaaaatattagccaggcacggtggtgggcccctgtagtcccagctactcgggaggctgaggcaggagaatggcgtgaacccgggaggtggagcttgcagtgagccgagatagcgccactgcagtccggcctgggcaaaagagcgagactccatctcaaaaaaaaaaaaaaaaaaaaaagagtttgagaccagcctggccaacatgaagaaatgccatctctactaaaaatacatagtgaaactccgtctctactaaaaataaatacaaaaaaatggccgggcgcggtggctcacgcctgtaatcccagcactttgggaggctaaggcgggtggatcacaaggtcaggagatcgagaccatcctggctaacacggtgaaaccccatctctactaaaaaaatacaaaaaaacttagctgggcgtggtcgcgggcgcctgtagtcccagctaatcgggaggctgaggcaggagaatggcgtgaacccaggaggcggaggttgcagcaagcggagatcgctccactgcactccagcctgggcgacagagcaagactgtctccaaaaaaaaaaaaaaaattagctgctctggaggcacactcctgtaatcctagctacttgggaggctgaggcaggagaatcacttgaacctgggtggcggaggttgcagtgaagcaagatcacaccactgcactccagcttgggcaacagagtaagaatccatatcaaaataaaataaaataaaataaaaattaacggggcatggtggtaggtgcctgtaatgtcagctacttgagaggctgaggcaggagaattgcttgaacctgggaggcagaggttgcagtgagcctagatcatgccactgcactccagcctgggtgacagagtgagactctgtctcaaaaaccaaagccaaatgataccccagggtacacgatctactgagtctttgcccattttcctgagtcctgatgacatacttggcacatagtattaactcttttttttttttctttgagacagagtcttgctctgtcgcccaggctggagtgcagtggcgcaatatcggctcactgcaacctccgcctcccgcctcccgggttcaagcgattcttctgcttcagcctcccgagtagctgggactagaggcgtgtgccaccacacccgggtaatttttgtatttttagtagagatggggtttcaccatattggccaggcttgtctctcaactcctgacctcgtgatccgccagcctcggcctcccaaagtgctggcattacaggcgtgagccaccgcgcccggcaggattaactcatttagtcatcacaatgtacgcggttcctattatttgaatccccatttagcagataaggaagctgagactgtcagcggcagtgataagttacttgtcccggtcctgcttggtgaggtgtgggggtgactggagagtcagcccgtcccactgtcgccctctgcaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtgagtggcagggcctgggggtgggctcggagggtcctgctcctggcaagtcccaagacactgagatccgggtattcttcctgaggctgtttcctcttcctgtcttcagggagtggaggcctcaggatgaagctaagctccttggagagttctagtcagtgacctttgattctgtgcctggggctgggaaatgcttaggggactgtcacaaacccatatggttcctttgtgcggagttggaaaatgttccatcagtttgaaattgttgggctaggcactgtggcccatacctataatcagggactttgggaggctgaggtgggaggattgcttgagtccaggagactagcctgggcaatagagtaagaccctgtctctcttgctctgttgcccaggctggagtgcatcttgggtcactgcaacctcgcctcccaggttcaagtgattctcctgcctcagaccctggggtagctgggactacaagtacccaccaccacgcctggttaatttttgtattttttgtagagatggggtttcaccatgttggccaggctggtcttgaactcctgtcctcaagggattctcccacctcaacctcccaaagtgctgcgattacaggtgtgagccactgtgccggacctaaaggactctttgagcatcaaagagtgatgctgaatgtgtgatttctcctttctgagatgttatcttgttatctgtgaagtgggggatctggctgagccactaggggtttatcagatgtgtttttgaacttgagcaattgatggctaggaggctcagttttgtcatttggaaaatggagttgctgatacctcaatccttggagaacaactgcaagcactagagttcgagtggaggtgggcacggtggtgtgcacctgtagtcccagctactcaggaggctgagccaggagggttccttgagcccaagagttgatagctgcaggctgggtgtggtggctcatgcctataatcccagccctttggaaagctgaggcaggcagatcacttgaggtcaggtgtttgagaccagcctggccaacatggcgaaacccaatttctactaaaaatacaaaaattagccgggcgtggtggtgggtgcctgttatcccagctacttgtgaggctgaggctgaataactgcttgaacccaggaggtggaggttgcagtgagccatgctctcaccattgcactccatctcaaaaaaaaaaaaaaaaaaaaagtttgaagcttcagtgattgcaccactgcactccagcctggacaacggagcaagaccctgtctctttttttctttttttttttttgagatggagtctcgctctgttgcccaggttggagtgcagtggcatgatctcagctcgctgcaacctccgcctcccaggttcaagtgattatctcgcctcagcctcccgagtagctgggattacaggcatctgccatcacacccagctaatttttgtacttttagtagagacaggtttttaccatgttggccaggctggtctcaaactcctgagctcaggtgatccgccctcctcggcctcccaaagtgctgggattacaggcatgagccatcgcgccggatgaacctgtctctttaagggggaaaaaaaaaaggaaaaaaaagagtatctggcccttaagtattccacgaaggtcagctataatggccattgtccccatttttcttacgcccttgcaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggtgggtggggacggtagggaggggagcacccaggaacaccccctaccatcctggggtgaaactgagccaggcctgggagagaccccctgttgcaaccctcatgctggggtaaccacagaagccctggattctgatagagtccaagcttctctctctccccgcttcatttctgagggtgagaagggagaggagagaggaaaggtctccctcaaggaggtgatggctggggttcccaaagccagacccccagagtcaccttctctgcatggtgccctttaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggtgaggccctgggggcggggaagagtcctgactagcccatcttttgtggactgcttttgcttttgctttccttttttttttttttttttttttttttagaaacaaggtctcgctctgttgcccagctggagtgcagtggtgtgatcacagctcgctggagcctcaacagcctgggctccagccatcctcctgcctcagcctcccaagtagcagggaccacaggcgcgcaccaccacacccggctaatgttttttttcttttgagatggtgtctcacagtgttgcccaggctggagtgcaatggcatgatctcagctcactgcaacctccacctcctgggttcaagcgattctcctgtctcagcctcctgagtagctgcgactacaggcacatgccaccacaccaggctaattttttgtattttagtagagacagggtttcaccatgttggccaggatggtctcgaactcctgacctcgtgatccacctgcctcggcctcccaaagtgctaggattagaggcatgagccaccgcgcccggcctgttttgttttttgttttgttttgttttgttttgttttttgagacagagtctcagtctgttgccaggctggagtgcaatggcacgatctcagctcactgcaacctccgcctcctggtttcaagtgattctcccccatcagcctcccaagtagctgagattacaggcgcctgccactatgcccagctaatttttgtattttagtagagatggggtttcaccatgttggtcaggctggtcttgaacgcctgacctcaggtgatctgcccacctcagcctcccaaagtgctgggattacaggtgtgagccaccgcgcccagcttaatgtttttgtttatttttattttattttattttatttttttgagacagagttttgctcatgttgcccaggctggagtgcaatggcgcaatcttggctcactgcaacctctgcttcccaggttcaagtgattctcctgtctcagcctcctgagtagctgggaatacaggcacgtgccaccacgcctagctaatttttttttgagatggagtttcactttcgttgcccatgctggagtgcaatggctcgatctcggctcactgcaacctccacctggcaggttcaagcgattttcctccctcagcctcccgagtagctgaggttacaggcatgcgccaccacgcccggctaattttgtatttttagtagagaagggttttctccatgttggtcaggctggtctcgaactcctgacctcaggtgatctgcccgcctcggcctcccagagggatgggattacaggtgtgagccaccatgcccggccaattttgatttttagtagagacggggtttcacaatgttagccaggctggtcttgaactcctgacctcaggtgatccacctgcctcagcctccgaaagtcctgggattacaggcatgagccactgtgcccggcctttattttattttatttttatttttttattttttgtttatttatttatttatttattttgaggtggagtcttgctctgtcaccaggctggagtgcagtggcacaatctcagctcactgcaacctccgcctcccgggttcaagcgattctcctacctcagtctcccaggtagctgagattacaggcgtgcatcaccaatcgcatctaattttgtatttttagtagatacagggtttcactctgttggcgaggctggcctcgaactcctgatctcaggtgatctgcccgcctcggcctcccaaagtgctgggattgcaggcatgagccaccgcgagtggcctattttcctatttttatttatttattttgagatagggtctcactctgttgcctaggctagagtacagtggtgcagcctctgctcactgcaacctctgcctcccagactcaactgatcctccccacctcagcctccctaatagctaggactacaggcgcgcaccaccaagcctggctaaatttttatgtttttttgtagagatggggcttcaccatgttgcccaggctggtctcaaactcctggactcaagtgatccacccacctcagtctcccaaagtgctgggattataggcgtgagctaccaagcctggccattttttttttttttttttttttttagtaagagactaaggttttgctatgttgcccaggctggcttcgaactcctggcctcaagcaatcctcctgcctcagccctgcaaagtgctaggattataggcgtgagccaccacgcccggcctgcttttgcatctcacagctgcatctctctctttctgtcccctgctcttggatgtggtgtgacaggtggtgaccatcccttctgttcttcccgcaggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttcaccctg

SEQ ID NO: 109 - DNA, 520 bp, Homo sapiens
tttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatgtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtat

SEQ ID NO: 110 - DNA, 71540 bp, Homo sapiens
ggcgcatgcgccacggtggccgacttgaaccgaggcttttattgctgtagtttatttccacccccttccctcctgtttctctctctccttctctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacggtgagtttggtacttgggaaatctgcggtcggccagccaccttttgtagcacagaaggtctaaggaatttttaaaaaggaggggaaaggagagggaccgaactttttttttcctttctgttgctaacggaggcgatggtgatggtggtggtggttgtgggagatgcagtgatccaggattagaagtcgcatcgtttgcaaggcattaaacaggagcgcgagtgcacgaaggtagccttaggtaacgcgccagacccggtctatcttttattgtcagtgagagatgctgcagcgtcggcccgcggggtgcaagcaaatggatgccagattgaatatgcatgcctggagctcggatattgttctctgggctgcgtgctgcgaggctggactcctccagcagcgatggggagatggggacttggatcctccccgggtcttccgcccccacccaaaaagggctttctggagccttctccgggtccttggaaaaaggagcgggtttgagccctaaggcgtaatgacagcagagggatgctgaaaagggcagggtgtaccggaatggtgtggaaacgggaaggaaaaacagggacgaggtgatgagcagaggaggaaggcggggggcaaggcgggggcttcttgttggccaggaaccggttttgggtgccccccccccggttttctcgccctgtagttcggggctggggccctggcggggattcgggctctttttcacgtctcttttccgccccttctgccgctcaggaggcgtccgtgttggtgcatacaaagcggactgcagggtgggcgcggggaccgcggcgagcggccgggcgctaatggcgctgcgcgacgcgggagcagatggcccggccccggccagacaatgatcgcggcggccggagggctcggcgcagtgctggggcctggacttgttggtttgcaaaccacggggaaaacgtctgtgccgtgaattagcgatgcctcagagatcagcaccagtcttgctcccacctctcccctgctccctccctctccccatcttttcctggaaaaattcgttcgtcctattctttccatccccagtgaaatcccagggaggggggaacaccagggaaattcattgttatataaggatgtgcaattgcaaccggccagctgattcccgggtagaacctaggactgaggcagagatcgaaagagccttttaaagcagtcaggatgtgtttttagggctggatataaggacgctctttggttctggttttccctttagccatgggcaccccggcttcctctccgtgcacaagggcacacccatccgcgggagagagaaggggagcaaatgcataggggagggggcgtgtgctcggaggattttctaggatgatctgaagaagggcgctagcttcttcttgaaggcaaaagacccaagatcccaaagggccgggcacggggcacccacccttgtgtgttcactgtgcaggaggaaggagtggtgactctggggagggaggatggaaagcagatttgcagcaagcctcaaataatttgctgtcttcgtgaatgaacaaggcagcttcattttgacagtgtggggagaaaaaaaaattaaaagcaaacgatcaacaagacttttttttttttttttttttttaaagagcgcccccccccccacaccctttaaaaaatctggttgcattatcataggacctatagcatggtattcctccctccctcaccactggcagcctcttatgtaagagccttctggaaggcactagagtgaacgggggtgtggtgtttcactttttttcatggcatcatgttggctcgggatattcgcggtgatggctggggcaggtaccacagtgactgtggaggcaggaggtgaagggggaggcctctccttgccttccaggtgatatttattccatggaagcttagagatctgggagagaagtggaggtcattgtagacagaggacaagtgcactgatttgagtgacctgggcaagtggcctaacctctctgagcctcagtttccttatgtgtcatgggaatagaacctggcctcatctacctcacagatttctttcgaggctctgatgtcatgatgtgcacggctttgtaaaggtctttacacttaccttatacaggtgcaggaattattgttggctattctcctttgactttccaaagtctacgtgaggatcagggaccctgcagtgtacaaaattaaaatgatcttattggttttcagtatgttagagagacaataaatactttctgaaccaaggtgtgtgtatttatgtgtaaaattatcttttttccttgctctctagtagcttatctcttttttaaagattttctatgatttccttttcttggtagctgctaaagagaggtagcacttgctgagaatattgttttgtaactgaattttgagttaactattgccaaaagaatgtcattctttgaaatgtgttgcatattaaaagggcaatgtatggttcagcttgccaggtttaagcccattctgtataatacaggtgcatatttactgaacactcgatgccagcattccttccatcagcagcatttgcaataacgatgagtcataatgtagcatttctgtcacattctcagactttatctgctgcttgtcctttattttttagcataaatatcaccggttaaaatataagtgcatcagcaatctgtagtgcattgcatcttagaatttgctatctcagatacttattcgtgggagtttacctttttcttaacagcctagttaaaatggcatcaatggcgtattttttgtagtctttttgctatacttgctgtgatttacctcaaagataaatgcaaatataaaggacatattgaatggaaaccttgctatggttgaacccagtgtatttgtgtggtatatcccgtgacagcagactttttggtcaattgtgcttgcttgacacagtctttccaagacatggctttcctatatgtaggtggttttttttgttgttgtttgtttgtttttaaattgaggtttagccaaaagccattttaaaaagtactatcttctttttttttttttgagttggagtcttgctgtgtaacccaggctggggtgcagtgacgtgatctcggttcactacaacctccgcctgctgcttcaagcaattctcctgcctcagcctcccgagtagctgggattacaggcgcccaccaccatgcccagcccattttttgtattttttatagagatggggtttcaccatgttggccaggctggtctcaaactcctgacctcaggtgatccgcccatcttggcctcccaaagtgctgggattacaggcatgagccaccgtgcccggccctatcttctttatatgaaataattttcactgctttttttttttctttggagtccaaggtctaattgaaagagatggttcgtttatctaggataagctgtccctgtgtgttctgactcatcaggtgatgaataggttgccacatacaggcttacctttgtcactgaacctttccaaaatgggcttattttgaacatcacttttgaacagtgaaaatgtatccttagctcacatatcttagcacctgtttctcataggtcagttacgcgttgtgaccttactgcctctttgtttcagagcgatcgtcttctgatcaaaggaggtaaaattgttaatgatgaccagtcgttctatgcagacatatacatggaagatgggttgatcaagtaagtgtaactcatgatatacagatgtatttgaacactttccagacttcccaagtattagataccattcgcatccaaagtatcaaacttcaggaacatcagagagtgaccaacttagtatctgttttaaactggttttgattggtggtaattagtgaatttgaaaactcaaatttagggaattcaaagcaacaattaatgtacacccgttgcattaggtattatgtaatttactatttttaactgaggtgatatgatatctttctgttgccagctcaaatacttggtttgtgatatgttgaatatattaaagttttgcctagaatgtcattgtttgggttggattgcccaaaggacgcaaacgtgaaagacagtctcctctattgagacagcacatctgctttcttcatcaagaatccaagttggaggggccaaagaaagataccaagttaattactaagtaatacagacaaattactgcctaaatcctgagggaattttaggttttattctaagtggcaactagtgcaaataagactgcccttgtgtttattgtgttaatgttacaaaggagaagcaacagggcagttcctgagtttgggtatttttggacgccagagggttaaggaagctgagttcatcccagtatctgcctgccctttctactggggtagctcccggggctctggagaaatagcacatctgtttgaagacaaacactgcagccagtgacagcttttaaataagcagcattcatcaagggatagctgtaaaccggtccagaggagtggaaaactggagtggctgtgactgttgcctgggagctcacacccagatttatgaacctaaaatagattttaacatttccacgtttaatgttttctccatgtgtgtttgctgtgacagtctcagctccaggctctcaaatgccatgactttgatgttccattttcccccaattataagatggcacgatctggtctggtagaatgacactggcccagaagtgtgcaggcctgtgtgctgtttttactcatcactgatttgttctagaactttatcaacttctcctagattaatattccttttaaaaaattggtagaaagatataaaaatattttttaaaagttggaaatgaatcatgtctcccaacataatgaatattcatttttctgccttttaaaattatatttcagctgttagctttttcattatctgaataactaaacacacgcttccaaaattttaaatcattgcaatcatagtgttcactttttttttttttttgctttgatttgttctacctcacccttccacccctattttccttctggtgaaaaggatatgataaaaataaatgtttggaaagtacggccaggtctggagaaaattgctataggataattagctcaattgcaagtgctgtaaagaaagtttaatgacagttcttagaaatatcttggggccttgttatcatttgatcttagggggtttcttgggaacaaaacgtctttgagtggggcctctggtgccttatttaacttttgctttctagtatactctgcattgcctcttgctggggggtaggagtatatagtgttttattatgaatcgtaacaatgatctgaaaagcccacggcacagagcggaggatagtttataggttagtgaaagtagctgtcagatcccatttgagtccacatttcatttacaacccttatcaccaaccctgtttatttaggcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcagtaagaagcttaaaaatcatcattgtagtgcttaggaagtgtgagagtttgcaaataagtctattgtttgattctctccttctaaaacttgctgtcctgagccacagttcaatctaccaaataagggggtgaggatgtgttaaccatttgtcttatttatttatgctcattttctgtcaaattttaagttctcccattgaactagagaatatggttctaaggagtttggtaagatgaatgacttcttgctttctctccatgtggacttttgtcttccttgaccctagaatgtgatttggttttgaaaacacggcatttgaagtcatcttcaatgccaccaactttaagccattgagcataagtatttgattgagattttcagaaaaattcctaagagtgcttctttttagaatgaggatgggctgcaacaaatgaaatgctgaagcaggaactcctgttcctctgatatgaaaatcaaatggagacgatactctctaggctgagtttaacataaaaggaattgggcagccctgtctggagggggacccacaggtaattgtcttttagatatgaaaattgctgacacccacagctgggtgccccttacgtattgctccaagggctttgtgctttttttttttttttttttttttgagacagagtttctctcttgttgcccaggctggagtgcaatggtgcaatctgggctcactgcaacctctgcctccccggttcaagtgattctcctggctcagccacccgagtagccgggactacaggcatgcacccccacgcttggctaattttgtatttttagtagagacgggggtcttccatgttagtcaggctggtctcgaactccccacctcaggtgatctgcctgcctcggcctcccaaagtgctgggattacaggcatgagccaccgtgcctggccgctttgtgctttttgtttaactaaatctgaactgtattcacagcactgtgacacagcacacataatattaagagtttgcttgtgaactgctagattccagcatgcccactgattgtccttttgaaaaatgtcattttgtttttgaggaggtgggcaagctgcatagtggcccgtcagatacatattttaaaaaacagattgcatccaagagtgacagtcaacgtggagtctgtcatatatgaaaagatagcagttcagttcagaagagggtctaagtagaaagaacttagctgtttctgctatagaaaaacctttcttactggttatttttccgagtggtggtctttttgcttgtggctttggggtctatctggaagcttcttttctatcttgcctgagctagaggaatgttgccctgccatcccctcctagtctgagttgccccgcattttaaatcacaactcatcctctggcgttctctctgtcctggccctcagggtctgaagcatcaggaacagctctctcctgtttcagctttcttggcaccactgagaaaagcctccaagtgtaagccttgcgacttgtgtcttgctgtacatgttgccctttaacctagtgggtgccattttccagggatgtcggggggagatttcatgcacacctagggagagcagagcctgcaccttgtcatttgctggggaatcactggcacctgtgggcgtttctgcctctcctccagggcggactgtggagaaacacttgaacttggagaagcttagactattcgggtgtcagccgggaaggccaagtcagggtgatcatctgcctcagtttggagttcacagggagaccctgcaggcccctggattggtcacagacagtcaataagccattaaaaacaatatttctctggctgggcaccatggttcatgcctgtaattccagcactttgggagcctgaggtgggtggatcacttgaggtcaggaatttgagactagcctggccaatatggcgaatctactacaaatacaaaaattagctaggcatggtggcatgctcctggagtcccagctacttgggaggctgaggcaggagaatctttgaacctgggaggcggaggttgcagggagctgagattgcaccactgcactctatcctgagcaatagagtgagactccgtctcaaaaaaaaacaaacaaaaaaattctcgagtgaatggtcagtgtcatctatcattggagagggaaatgcccccagccaggagttaggagtctggagtgctggcccccttctgacactgacttgccgtgtgaccttgagtcactaccctactctgtgttctagctgtgtgtctccagtgagggatttgtgctacatgaccctggaagtcctttccagccccctacatttggccattcactgaaactcattcactgaaactcagagagattttgcctctcatcaagtacatgttgctcagcagatacagaaagtccctgttttctctcacacttgctggaaagaatccctcagcccaccatctcctgtcctgcattcctgggtctgcctcttccctccacacgctcgccccgtgcttaggcccccactcttgttcttgtttttgactctttcctgccttcccttccccaccacaggagcatcaccttcttgccaccaccccgaatttctctttcgtcttccccctcagaggctgtggccttttttccattcatccagatgggttccttctgtttagggacgagggacatccccctctgagtgcagcacctggcccagggagctcagaagagtcagcagatggccttatgggcaggtggtccggaaaggggagtgaggagtctgaccgcctgctctgcttccttggccagaatgctatggcatttgcacggaggctgtgtgatgcgatctggctatagagtggggcatccaatgagcgaacctcaaggaataaaagtcatcagagggggcagtgtatggttagcattgtgacccccaaatgccattgcttttatagcctgagaaaagtactaactacttttgcaaataaccacctatgtttactgacctctgtagaatttctactagcctgcctttccccgggggagggaatggtaataatacaggtgaggaactgaggaatttttatcctttttctgtttgctgaccagacgttctgcattgctttaagtgagtgagtggctgggatttgctttacagagaaggaggccttgcaaagagaaatagcttaatgccacttcattggcacctaagacctgctactttctttgacttaatatattgagtccagaaagaaatgcctggggcactttgaaaacttcacaggcccactgctgcttgctgaaataaaaaattgaagtgaattggtacaaaaatctccctcttcctcccaactccccgccaccccgcccctgggcactccaccctcctggctttctggccttctccagaccatgtcaccatgtcacctgccctcacgggtaaatcctcgcctgcctccctgctggctctgcgtttcccaggtcacaggccctggagactcctttctgtctgaaatggcgccgcatgtagaggaaaacacagccaaatattctcggtttaaaaaaggagatggcatgtcagcagcagaagataatattattgccattaaacagagcctgctattgagaatcacacaatgagatctttatgaggcggactcagtgtggagcagggggaacgccctttgccctttccacccagtggtgggtgggcagagactgcagacataccctgcaggcggcatccagaccggctgaggggttgcgggggcggccgcattgctgcttggggaaaaccctacggacttcccagggccttcatggtcatttgagttcaggatctcagagtttctaggaagcagctgggaacagttacctctattttatagaggggaagactgaggccggaaggacagacacgacttgccaacacttaccctgtgcgtcggtgcaggtggccaggtgtggaacatacacctgtagctctggcctcaccgcttgccctggggccacctttgctctcagcctcagtggcctcatctgcaaaatggggcaagttttgacaaaggtggactgtggtggcatcacaacagcatctgcccagtagtgagcactcccatgtggtagctattgtcattccatccttgctgggtactgacaccctcccatctcttgtacactgagctctactctcccccgcatggccggagaaacaggctgagctgccgtagggcttgacctgagtattcactgagagcaggcgctgtctaggcgtggctggcggactgtgtgctttgtgtgttgcttctgggggcggcatcttgaaacattacacttcctgggtcccaccttacctggttaaagtagcaaatctgctggtggggtctgtgactctgtattcgaatctggtgcttggggagctttttgaaagcatgactttcaggggtgcatgccggatctgcacactctggatctccagggcttgggaaccactgctctgaatgtcatttctgctcacctgaactccaggctctctctagaggaggtgcaccctcaggcacaacatacccagcaggcttcctggtccctgggtagcaccgcacagcagagatggggactggactctagcagggaggaggaggggaggtgctgctgccgcagggctggaaggggccctccctcctgagtaccagccttgtcacttctcccctggctgtggctccctggatgtgcatcaggcacctccatccaactgtccccagttggactccctgtctgctccttgctgcttttccggtgcccagtcctggagagggctcgctggaggttgtgctggcggtatctgcagagtcatcctagcatcttcatgtcctcgtgctgccttgagttgctttcatctctgtgttacctcttgcactcattcccttacccacacagatttgacttttgtcacctcttcctggattttggccctgtcctctgaggagtcttactgtctgtcccccacctcctgcctctcgccaggctgtttttctggtgcagctttcattgtgccgccttcttcctctgaagccttcagtgactccctcttgctcagagaatcagcccaagtgtcagaaccctccacgacgcggcctattcctgctgccccagcccagacttgcattgtcatctcagccagggatgccctccctttctttccctgcttctagaagcttcatcacccttggtggcccagcctgggtgcttcccattcactgatctcctgtgatctgtggctgctgtgtggcctcttcgcaaacgttgggcttttatcccacagcccaggtggcattcagccttgcgtgtggttcaatcaaggcccctctgtctcttacattttcctatttcctgccgcctgggcagcctcactcctcagaggcactctgttaatgcccatgggtgaatgaatgagtgagtgaatgaatgaatgactgaatacactgacgatacttgatatcctgcttcctctgagtgatgccaagagacttagtgtcacaaggagggaggagggtttaggtatccgacgtggactgtgttcaccctgatggaagctgtcgcttgctcagcagtggctccctctgcagccccagctccctgagtccctgtggtcagatctggtcatggtgggggagggtggcagaaagaggaagccgagagcccaggcatggcctgtggttgtggatgggacagctccctctgtctgggctgttcttcagaagagggtgggaacagcagctctctcattggtcctcttgcgagaaagcctgctctccaagtacagagggtcacaacatggagaaatcacatggtcccagcaccacagtggacccagcagtcattcccccagtgccttgggcttgtcccggctcttcctactgagcctccccatggaggcaggagggctgggaggaaggtgaggtggcttcctgaagggacgtggctcctgaatgtcactgcggtacatccacggcttgtcatttgttcatccatgtggcatgtgggttgctccctccttatggcgagtacacacgtgtgaacgcatgcacacactgtaatatggatgtgtctgtaattgatactttgattattccctttgcagcactcatttgactcgggttagaaagtgtttacaaaaacgcccgaccacatcagacccaagtttcaaagtccaggaccaaagttgttgccacaaaatctgcctgtggcctggcgattagaaagccacgttatccaatgggccattggtgtgggctggttctctgtgctcctccccttgtcccctcagtctccacatggttgaggtcacacatttctcctaaggacacgggtgccctctgcaagcagatgccgggagcctgggtccactcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccacccccttggcatagtttgggccgatctaatgcctggcactgagcagagcggagggatctcctaatgcctggtgcggtacaggggaaggatggcggagcatcctcagagacagcacagctcttcccaaaggtccagcacgcacactttaccgaatgcttttcttgtgaagggagtcattgggttgggctagccaggtaggctgggtaggcctgtgggggttaggaacttctaggcccttccagaagcaagggcatccccaagtgggtgtctagactctgtttcgtggacattgtggcagttatcatactgtcccagggtttcttgcccccacctggccctgggagctggcagttacagtgctggaaatgagcctgactcactggggtggtgatcttccaccccttcaggtgccctcatcccagttcctactctgcctatgggtgttttacatggagagtcacagcactgggggtttcccagagcctagactctgacttgccctaaagctgggtcacacagactattgggaacttcctgtcgatcctgctggcctgattgacagctggaaccgggagtggaggtggggcccatgggaatgctaggctccagcaagttctgcctgacctttggatgtgagggtcaggcattcagtggtcgggtctcagggttccttattgctagatgaaagcttccacgacacacatgtgtctaagtgtgcccttgtcctatgtcctggctgagtgagttgggcagagacttctgaggacagcgatcgtggcctctccattttcctaaggcccctgcatgcctggagctggctgtgggggcagccagagaagctgcccaatgagtctgatgggagccagacccgttactccttctactcatgatagctttagcattgttgtcccggggcaaccctttctcatgtgaaaccttgcgtggaaccccctccacctgagatatgagactgatgaatgcagaactgctctggttggaatggtgggtggcaggtgggctgtgggggagtccagatcctctccgctttctctttgtcatccccccatggcagcccctctgcctctggagaatcccagagcttggggaagcacaggatggaaaccaacccatcctggcactgcctccccctctgcccacctcccctgcaaagcttgcaatgcgattggtcctggtgtagcctccgtgttgagttgtaggggaaagggtgtttagtaagcaggcatatacccacggagtcgcttaagaaaacacctaaccacactgtaagtttttagtagtttcgtttaatatccctctctctgttcaagacaggaaccagggtagagcacctgtttcattttccctgcctaggtttgggttggttttcttagctttttatgacagcccataataggtgagcattctgccctttttaaaaaaattaatggtgcagagagttttatttatttattttttagaaacggtgtctcactctatcacccaggctgtagtgcagtgttgcgatcatagctcactgcggctttgaacttctaggttgaaacaatcctcttgtcccagtagttgggactgtaggtgtgcaccactacacccggctaattttttacttgttagtagagatggggtcttgctatgttgcccaggctggtcatgaactcttggcctccgttgatcctcctgccttggcctcccaaagtgctgggattacaggcgtgagccactgtgcctgtttggtacattagtttttttttttttgtttttttttttttattaagacggagttttgctcttgttgcccaggctagagtgcaatggcgcagtcttggctcactgcaacctccacctcccaggtacaagccattctcctgtctcagcctctcaagtagcttggattacaggcatgcaccaacatgcccagctaattttttttgtatttagtagagatggggtttcaccatgttagtcaggctggtcacgaactcctgacctcaggtgatccacccgcctcggcctcccaaagtgctgggattacaggcatgtcccactgtgcccggccggtacattagttttaaagggaagattgactgtgggtggccaagggatttgtgttttctgacttaaccatccatggctctgaccccaagtcacccattaagggctgtttctccctttttttttcctcttcctccccaagctgacctttctctcttcttaagaagtgattactgatttctttaggttttgagggttctgtctttgactctccgtgattgttgggtgaagccatttgcttaaattccttgcttttagagcgtcttaactgccatggtaatgataaaggggagtgacagtgagtagaaattagagttctttctggttaacccatttgggaggtagctttctttgaatatgactaagtgttccccctaatgacagagaggatgttgctgggggttgggtcgcggtggctgaggctgctgtccagttaagagaattttgcaatgaactagggcagtggtttaaaaaccttgactgcacattagaatcccctggggagttgtaacaaaatgcagagaccagaccttctgacttaattgttctaggtgggcctggcattggtcgttttgaaagcctcaaggtgatagctgggattaagaatcatggatcccagtgcttgttctgatagttggacttctgttgaaaccgaatgaatgtctgccaagattttccgaaacccagagctgccctctgctccctgctttgtcctgtcctcttcacgaagggagtgggatcacactgttgctatctggccagggtggagtctacagccagatgctccccagaagcttaaccatggaggggctgagctaattgtcaccagaaagagcctcctccttcagttgctgtccttggtgttcgggaaggttttacttggctaattccctaaaagggcactggttaggacttggagtaagtggtgatgagcaagagcagggctggctggtgggacagggtgggtgccgggggcagaggggaactggaatgtggactgctgtccccagcctgtggccacctgctgtgctggtttccctgagaaaaccctactgtctttaggttgaatctgtagtgtttatgacctaatcactctctaatgataggtcaggactggaatctttccttgtggggagcctgtgagacaaaaatcaaaagggcctgataataacatagaatcatggactcttaaggcagccattcacctccttcccagccccgctcccacagctgggcacggtttattggaccaggcttcagaggatgggattgtaagtaactcaacaggacaggatgggagcgctccaagaatcagatctaagtttaacttccctttctagtgctttctgtctgagcgtgatcatcctaatgtgtttctagatggctatttccacatgtgtaaagtggagacaatcaattcttatgtcttacgactatggaaaaagtgagtttttttgtgccatactatttgaaagtaatcattgtgacacctttggaacaagtgtgaaaagatctccctctctctctctctcacacctgtctgtatccatctttatctttttatcatctatctctatctatctattaatatatatttatctatctagcatgacctgggataggtgaattctatagccaggtggcctccagaagcttacgaaatgatcgtctaccaaatctaccatctatctatttccctacctacctatcatttatctaatctatctatatattgatatatatctatctggtctatatctatcttgatatgacatctgtctgtacctatggtctatcatctctatttaatccatcgtctctatatctattgattatcacttatctgttttacttatcctaatctatcattaatctatcatctttctaatctatctgtatatatctattgtttatctaatctatcaattgaccattcatctgttcatctttcatataccaaagatgcagttgcatgccacctgattccagatgggttatctcacttcactgtcacttagtgagatcaggaagaagtctcaaggattgtttcaacttcaagcctatgtacatgagtttgcgttttgaacatagcaggaaaaacaacgatgtataagaagctttcttattggctgggcatggtgacttatgcctgtaatcccagcactttgggagattgaggtgggaggatcacttgaaggcgccaggagttcaagaccagcctgggcagcaaagtgaagccttgtctctaccaaaatcaatcaatcaatcaatcaatcaataactaaaaataaaaataaaaaattagctgggcgtggtgacacatacctgtagtcctagctgcttgggaggctgaggtaggaggattgcttgagccccagagtttgagggtgcagtgagctatgattgtgccactgcacttcagtctgggagacagtgagaccccatcttaaaaaaaaaggtataatgtagcttatagggcttataatcctgtaagaagacttcttatgcaagaaaataaaaattttacttttcgctattttttttttcctcctccaaataatctctggagaatttggagcctgattttcttgacaacacatctggccctgcagatgtaaagcagtgttcccagaaaacagcccgtcaaatcaataactcttgctatctttgaattttcagccttttttggcattcaaatgaggccaactttataagtggccattgctgtgctgttgaattcaagcccctccgtttttcatggtggattccttgcattgtctgctaggggggttgcattcctcgctgaaccagacctctgccctcttccccgctgccttgcagtttgctgagcttccaggcagggctgcagggtcgtgctgctggaagtattggtgacaaattcttccccagtgggtgtttcggctaaggaagcatttagtcatgtagggcctaccatgcccagcagtgcagcgtgggagaggcctggcagagggcagagctctcttctctccagccgggtgtggctggtggctccttcctcttttgtagtgtcaaaccaagggatagtatggacccagcagaactgaaagcaaagggaggacccattattagccagttctggcagaggcgagcagcttctttgtgtggacaggcatatctcatgcctttttgcttcagctgggagtttgttttttttttaattactgttatttatttatttagtaccttagctcattagctgcagaaatcacaggggatgaaaaagcaggtaggatgggtccatccttaaagcaaggagagagttgaatgaggaaactgtccctgaggccttgacagatattttggagctaactctgagcccagtgagggaggacctaatcttttggaggaagtgcaactttagcttcagagttttaaatggaaactgggcagaaagccacagcttgggcacagcattggtggcgtgttgttgtgtcactttgcacagttagatggggcttcagccctctttgtaggatgaacgtttaggttcttgtccaaacgaatacacttctatatcctactaaaaatgattgcaggacagcagtgcaaaccagggctgtcctaggcaaacccaggcatctgtcactctaaaggacacaaggacacgtgttgagtcctcttgtcctccagtgagctcgggaaggggatgaccctagcagttgctctctggacctctccacagacctgccgggagtcatgggtaggagttgtgtgattctgtccttttcacaagagatggttagaagaaagtgaggagtttggagggagcagataattgatatcatttatcgggaatctgtgggacgcaagccctgcatacaccatttctaatccttccatcaaccccgaagatagataggcttatcctcctgttataaatgaagtaatgagcagtccagagaagtgaaatgacttgcctgaagccacagagcctgcaagtgcgagggctgggattccaatccaagctctgggccaatggcccttgcatatcctagaatgcgagaggaacgtttgttttgtagcagttagacagcctgctcatgaaagctgctttgtgcccagccttgtgacaggtgctttacaacaatcccagacacagcacccaccttgagtttgccctcaggtacagggctcctatccatcctggaagaacagaaagattttggtgttcaagttttatcctgcccttccatccacctgttatttaaaagtactttttctgtaatatataggcagaaaatgatcagatatcatacgtctcctactaagtgggaggctgcacccagcatggaagatgctcaccaagacggtggtatattgggtgtctcttctctcctacagaagccctgggttgatgccctagatctccccttgcatcccagagggggatttggagagcaatcaagaggagtaactgatgccatgcattcatcaactgaacttaatccttcttctgggaggcccgggagccttcttccatgcggggccagattgagctgatttctgtcacgtaggctgctccgaggttgccttgcccttgcctggcactcatcttttgcatttctctgaatcgctttggcgtgggcttttatgaggttcattaggctcagcacctcccatgtctgcttgggaaacaccacgggcagatggcatttttcttttcttttctttttttttggatacagagtctccctccgttgcctaggctggaatgcagtggcttgatctcagctcactgcaagctccgcctcccaggttcacgccattctcctgcctcagcctcccaagtagctgggactacaggcgcccgccaccacgcccaactaatattttgtatttttagtagagatggggtttcactgttttagccaggatggtctcgatctcctgaccttgtgatccacccgcctcggcctcccaaagtgctgggattacaggcaagagccaccgcacctggcctcttttttttttttttttttttgaggggcagagacaaggaggaagatcagacaatttctcagagttggaattgtgttctgggtattgtttttctcctttatggagataatccagggagaaacatgaagtgtaatggaaagaatttgaggcccaaccttcttgatgatgcatcttcatggagctgggagaccttcgtgccagggtcgactctgctgcttattagctcaggctcggtgccccacggcttggtcctggttttctgaatcgtcagatgcacctggatcagcatgtcttgcataatagggttgctttgaggatccagggaggtggtggctatggcagggcttggacaaattacatgtatgggggagtagccccttcaccccagttttgctcctgaccgttgaagctttttatattgacccgtggctactgtggtattcgaagggctaaatttgttttgtgacttttgccttcagcagccatcgcattacatcatctaccttttcttgtgttcttctgtcgtcgagaatcaattaaaatggtcagcattgctatgaaatggtttatttttttgtggatgttttagagctcctcctctccatctcctgaatttcttttcttgctaagcctattcagctctgttttttagagagttcttttccctcctgctctatgaaaacgtattttccatgttaaaaaaggaagatccatgttgctgtacttaatgcttcatgttttagaatgttagtgccagcagaaagcaccaggagacacccgatgtgcccccaccttggtgagcacctttccccccaggcacagtccctgcttacgggagatttgaggcatttgatcattttttcccgttagcttacagcacaaagtactttgaaataaagattggctcgcagggcaggttgaagcttcaacaccaaaatctctctgttccttgtgggtggatgggagcctgacacctgattacaagctccaggtgaagagcaggtttgagacttacaccttgtttattgcaatctttctttcattttgcaggcggtgggggtgggggaatgaaagcccagaaagggatgtggcactcgggcaggacgggggctgcttctgtgccttttccccactgtgcgtattcttagctgcgcaagtgtcgtgcatgtgcgtttggctcacacccagcgggagtgcccttcttgtgaaggaagctcgttctctaccgaaaagctcacttttcagagaagagctggagaaggcctgttgtccatcttagtcctgaaatatgagttttcattccatggcaagtccttttaatgaaagatggactggagaagctgatgcatagaaaagaaataggttcttttatgtagagggggaaagtgtccactctgcggtatttcctgggtcctgtggcttgtaggcatttgaactgttttgtcttggttctgagagagtcagatgattcagaagctgtgttctgctgaacattcctgccttcttgacagaaatcccctatttttgtggtccccctggcaggtaaaggtggcccctactgacttgtaggatttctgtccatgattgtgtctgaaatgtcattttttctggttgttttccctcttcatgtattagcttggctctttcttctcctctttgtctttaaggtaatttgcaaaggtcacactattcttgcttcttcttagaaatgtcataagggattttcaaagaaagaaaatttctgagtaagagtatctccctcccctcccctcccctccctccactcctctcccctcttttccccttcccacttcctcctttcctttctttctctcgctctctctctttctcatttatgttagcttacatgagtatactgactctaaaaatttttgattctactactgcactccagcatgggtaatagagcaagaccctgtctcaaaaaaataaataaataaaaataaaaaatcttaaaaaaatttagatatgatttgtataccctcagattcactctctgaaagtgtataactcagtgctttttagtatattcacagaattgtggaagcatcactaccatctaatatcagaacattcttaccaccccaaaaagaaaccctaccaattatcagctgctccccattccccacctctccccttgcacccctagcccatggcaaccactacatttctatagcgttgcctgttctggacatttcatataaatggaataatacaatatgtggccttttatagctggcttctttcccttagcataatgttttcaaggtttatccaagttgtaatatgtatcaatacttcatgactttttatggtcgaataatattacatttatgagtagaccacattttgtttgcccattcatcgatggatggcatttgggttgtgtccactgttttggctattgtgcatgaataatgtacatttgtgggcaagcatttgcgtgggcgtgtgttttctgttctcttgggtatataccgaggagtggaattgtggggtcatgtggtcattctatgtttaattttttttttggccatgttactggcaaatatatttaactttctgagcaacagtcagactgtttcccaaagtggttgtgctattttacactcccaccagcagtgtgggagggccccggtttcttcgcatccttgccaacacttgctattgtctgtcgttttgattatagccatgcgagtgggtgttaggtgctgtgtcattgtggctttaattttaggctttattttgaggcccgtgtactcattcactgacccctagtcacatttatcttgacctgtgatgtgagaacttggtttgggtgtgttttccctactctgcactggctcatctggtgtggcaagtgcaaagatgtttgcagagatgagaatgagtacctgcaaccaggggtccccagaaaggcagccctcttagctctccccactgaggacccttgagccctccctctagggctcaccatttgtggctggctggaatggctacctccattcccttgagcctggcaccgctcctcgagatttgctctgatctcaccgcatggctgagagtaaatcctgttttgctcccttttgtgagccttcttctttctgcttcctgatggggtgggcagataggtggttccatgctggggagggaacttggcagaggccctgttagcctcttcctccagtgtcacccttctgacagcacacagcctgcggggtccaggcactctcagccatgatatggaccatctccagggccagtccattcctgccgctgatggagattccctcctgatctccagagggcagaggaatcagaatagtttccttctacatttgtagtttgcaggaaccattgctcacagctgctccctccttggatgctataccctcactctgtaagatagggtgggaaatgtcgcctactttacccatgagagcatcgcagaagggagaggctgagggacttacccaactagtatgaggctgaatgaggactcagatgatggtcatctggctccggggccagcacttaatcctgctgggtatgttcctgggccctctctttttttgtttttgtttttgtttttttttgttttgagacagagtctcgctctgtcccccaggctggagtgcggtggcgccatctcagctcactgcaagctccgcctcctgggttcacgccattctcctgcctcagcctcccaagtagctgggactacaggtgcccgccaacatgcccggctaattttttgtatttttagtagagatggggtttcaccgttttagccaggatggtctccatctcctgaccttgtgatccgcccgtcttggcctcccaaagtgctgggattataggcgtgagccacagcgcctgggccctctcttataggaacttcaggtgctaatgttgcaggatttaggaggacgagagagaccttgggttgaaacaggagaatttttactgagtgtactcaggcccagctgacttacgtttaaaagactgggcctggaacaaagacagtacttgacatttatatatattttataaaagggggtgggctagcttgaaataagctcatagtggtgcgaaagcagggatattgaggcaggacaaagacaggattgtatatgactgttgccaagcaacctagatgtttgttatttaggtttgcctgggcaaaggcttattttataacctttattatggtgcccaggcagctgtagtttaggcttatttaggctttttatgacttttgttgtattttttagataaaacagaatacttgaagttactagttatagagaacaggaatttataaattttataaaacaaaggaaatttttttttttttttttttttatgttgagggagtgctgcgagagtttttaggagcgtattagataatattattaagacttttttgggtctgggccatgcctttgctgcctttgggacaagttagcttaatacaggaaaacttatttttttttaattttatataaaaattctcctgtttcaacccgagatctctctcgtcctcctaaatcccgcaacactaagtgtggttcccttaagtgcactggattcaaggtgactttgtccttgcttttggatgttttggatgtaacagcgatgagatggcccctcccagagctgagaatggagagtattatgctagacacctgaggctgcagtgatgtgggctgatggaggggtgtcaaggagaaagcatgtggtcaccttcatggcaccatcacagcctttggtttgtttaaacaaagtgaattagtgttgtggtttctgctgctaagaaaaccctgttcgtttattcattcacctattcattccttcatccgttcatttattcatttattcatccattcatccattcagctgacatttattggccatctggcaggtgctgatctgggcattagaagtacagataaggtcctctttgcaaaaaacttcttgtctattgggaagacctacaaagaaaagatgaaaatgaaatgtgaagattgctgtactaaggttccagtggaacagagaagagaaatctttaaaatctgcctgggagagccaagagaggcttcagccaataggtcctatgtgagctgacccttgaaagccggctcaaattttaccctggggtggatttcacccatggggtgggcaggagaagggagtgtccacccaagagagagatgtgtgcagaagaatttggtagatgagtctggtgtattttagaatttagactccggatttgaccataggatgtttgagttctatcttcatggcttgctagctgggcaagtgacttttcatttctcggagccacagttttctttcttctttatttatttgtttttatttttattattttttttgagacagggtctcgctctatctcccaggctggagtgcagtggcccgatcttggctcactacaacctccacctcccgggttcaagcgattctcctgcctcagccttctgagtagctgagactacaggtgtccaccaccacacccggctaatttttgtatttttagtagagacggggtttcaccatattggccaggctggtctcgaactcctgaccttgtgatctgcctgccttggcctcccagagtgctgggattacaggcgtgagccaccgcgcccggctctttcttctttattttatagtggtagcatacataacacaaattttaccactcgaactattattaagtgggcagttcagtggcattgtgtattcgcattgttgtacagtcatcaccgtggtccacttccagaactttatcatcatccctaactgatcatcatccctaaactgttgccattaaacactaactccccattcccacctttctctagcccctggtggcccctattctattatagttgtttctatggatttgactgttctaggaacctcatgtaaatatatatgcttatgacattgcagaatggccccaagttcacctatgtgatagcctgtgtcagaatttccttttttttatggataatatttcatcgtatatatagaccatattctgtttatccattcatccattgattgatagatacatgggctgcttccaccttttggctattgtaaataatgctgctatgaacatgagtgtgcaaatatctattcaagtccctgccttcaactcttgggtgtgtgcccgtaaatggaattgccgcatcatacggtaattctgcaccacagttttctgatttgtcatataatttcagggttactgtgcagcttaaatttgattgaaggtacaaagtactgagcattgcctggcacataatcagtattaagtcccatcctgaagggccccttctagcctctcctgaaaagtgaaccctttaaagcaaaaggacttttaactatttggatgaaaaaatacctcttcaaatgtagtttatggttcttaaatggaggtcctttttggcacttttgtggagtttgggtgaggagtcagatggccacatttgcatagtgaggtgtgattgggtcctggaatgtcatgccagggagcaggtgaaagccaatgagtattctgccaggtccaaaggcccagtggccagtttccatctggatgggcctggaaggcttcctggaggagggggtagtggccccagctggggaaagaggaggtaaaggaatgggtgagaacctgcctgcctcatcttgagagaggctgaggaagcacagagctgggaaggtagccactggtctccatggccactatgctttgaacatacctttgctgcagggccgatgaaaagttggacgttagctatcttcatctcaacctactccctgtcaagtcttgctttttttttttttgagacaagagtcttgctctgtcacgtaggctggagtgcattggtgctatctcggctcactgcaacctccacctctcctcctccggggttcaagtgattctcctgcctcagcctcccaagtagctgggattgcaggcacatgccaccacacctggctaatttttgcatttttttttagtagagacggggtttcaccatgttggccaggctggtctcctgacctcaagttattcacccacctcggcctcccaaagtgctgggattacaggcttgagccactgtgcctggccacgtcttgcatttaccatgggaaattgttagcgtggtcatcatttggtctgctttagtagagagtatcttttatgtttctcaaaggcgttatgttctgcattgtaaatgtgcggaaatcagtcacccagtcacctgaacttccatttaacatcaggtccctggccatgggacttgggcaggagcaccagggctggcccatcaagtacctcaatatattgctccctgatgagggaggggccagaatacatgttatcactactgtttaacatggttccggatatgttagccagtgtaataagatacgaaaaataagaagtaataataatggggagaaaatataagattattactatttttttttattgcccaggctggagtgcagtggtgtgaactcggctcactgcaacctccagctcccgggttcaagtgattctcttgcctcagcctctcaagtagagtagccaggattacatgcacccactaccacacccagctaatttttatatttttagtagagatgggatttcaccatgttggccaggctggtcttgaaatcctgacctcaagtgcctgcctcagcctccctaagtgattattactatttttagatggtttactttagccattcaaaggaattaaatgaagaaatatttgatctaagaagaaagtttatgaagatgactgacttaaaaataatgtattaaaaattaatagcttccctgtatgtcataaataaccaatcagaaaacataatttaaaaaatccatacacaatagcaacataaaatataaaattactaggaattataagaatacattcttatatatggaatccaagaagagtcttaaataaattaaaagaaatgctatgttagtgaacagaaaaacccaatactgtaaagaagtgtatactttagattaattttaaaattgaaaacctcaaaaggtggttgagtttttgttttgttttccatttgaccaaatgattcttaagtacaggtgaaagattaaacaggtgataagaaccaaaaaatattcaaaaaggtcataatgaataaggctgggagaccactactggctagatattaaaacaaactgtaaaaatataataattaaagctgtgtggtactagctccagaagagacagctatataagcaggttaaagtagaaaatctgcaaatgtgactaactgtatctaggtatttagtatataaaaaaggctacatttcacactcatggtaaaattgtaaaatattcatagtattatattagaagttaactattttgaaaaccaaagtaaacatcttaccttagttcgtataccaaaatatatcccagatggattaaagaattacatttaaacagtaaagtcagaagagaccagaagaaaatacagatgaaaagccatataatttagatatttcagcaaaggcagaaatcagaaaagatggagatgcttgactacatagtaattaaaaacattactaacagtttaataataaaaggataacgaagtaggacattcgacttgcaatatatgataaagggttgatgcatttaaaatatgaaattttaacattttaataaaaaaagcatgctttaatagaaaaggtaaatggtatgagcaaggtattcacaaaaaggaaataattccaccattgaactataaaaaatattcaactgaatgagtaataaaagaaatacaaattgaagtttcactgagctaagtttttatctactaaactttcaaatattaaaaggggttaagtaagctgaaaaaaatgaaactatgttggaggattcacttttatctgttttatttaatttcttttatataaataatacttcaggcaaatatgataaacttaataaatgtcaattctgaggggggaagaataaaggagttaaataagtagaagttgtaatacccagtgttggctaggttgtggttaaatgaacactcaaactgcggataggtatttacattggcatggccctttctggagggtaataagacagacagtatctaacaagagctgtaaaaatgtgtaaacaaaaaaattcatacgccttgacctagagtaatctatatgtaaacatttagctctaaggatgttcattgtagcattatttataatgaggaaaacaggaaatgagctgaatgatgaaaattggtgactggtatagtaaattaaggccatccctagaaaatagtagtatatagtcattaaaatttattttgggggccgggtggtgcctcacgcctgttatcccagcactttgggaggctgaggtgggtgaattgcctgacatcaggagttcgagaccagcctggccaatatggtgaaaccccatctctactaaaaatacaaaaattaaccgggcatggttgcacgcctgtagttccagctacttgggaggctgaggcaggagaatcacttgaacctgagaggtggaggttacagtgagctgagattgcgccactgcactgtagcctgggcaacagagtgagactctgtctcaaaaaaaaaaaaaaaatcattgtggggctgggcgtgatggctcacacctgttatcccagcactttgggaggctgagatggaaggattgcttgagcccagaaattcaagaccagcctgggaagcgtagggagaccctgtctctacaaaaaatttgaaaattacctggacatggttttgtgtgcctgtagtcccagctacttaggaggctgaggtgggaggattgcttgagcctggcaggttgaggctgcagtgagctatgatcctgccacgaacttcacaaagcaagaccctgtgtcaaaaagaaaaaaaaaaatcggctgggtgtggtggctaatgcctgtaatccccacactttgggaggctgaggtgggcggatcacaaggtcaggagatcgagaccatcctggctaacacggtgaaaccctgtccctactaaaaacaaaaaattagccgggcatagtggcacgcacctgtagtcctagctactcaagaggctgaggcaggagaatcgcttgaacctgggaggcggaggttgcagtgagcctagatcacgccactgcactccaacctgggtgacagagcaagactccatctcaaaaaaaaaaaaaaaaaaattgtggaaaatatttattaatatgaccatgttcacagtatattgatggaaataagcagaccatgatttcattatgtctgatttgatacttttttaaaaaacagctttttgaaacataaaaacattatgatgctacttttgtaaaaagtgtatatgtgtataataagtagataggaaaaagattgtctagacatacatcaacatagtaatagtgactttttttggatgattggatgagtcatggaagattttattttttttctccattctttctggtgttccagggttttggcattgaagtacttttgtacttagaggagttttataaaaaacaaaagttccctttgagggatactttgcatctggactgttatctcttacccacatcattcttgaggacgaagagaaaatacctgtgaggaagtatttacatttgttacggtggtgctgggctgagtttgtgtggaccctggactcccagctgtccacacagttataaagagtaattaaaagctccctgaacaacaggtcccttatcagccttaaaccttattgttcagatacattggcttttattcatagtcttactaatcaactggggacaaaaaagacccattgaaccattagccctcagcccgagatgagaagcgcatgatggtacaatggccgtggttcagactcagatgttatgctatgttttgaattcagtccaggttcctaggaggaaaacacccatcaaattatgttggctttagagcgatctcagtcaacagatgacatcaccgacttttccttccctgctggtctttatttggaggggatgcaagaattgtgcaaccttggaataaacagaatagagacccgactcctcactcattgtgtttctgagtttagtttcaatccaacagcggatctgtttttttactccatgtaatgggactgttgctgcagcttttgtacaagggtggagtgggtgtccatttgctgacgagcaccctgtgtacacgctagtttttatttgaacgaggtgctcttgtctttattatgtattgtctgcccataaatgatgtcttgaaatagaggggtgagcatcacctcatttatttcaacccatatttgtacagaaggatttttgtaatcaaatcatggggtttgtgtgtagaactcagtaagaagtaatcatgaccctgtccgttcatttgctctttgttctttcctgttattaacaatggctttggggcttttggggcgcatttagttctgcacgttgtgtatgtaagtagatgttcttctgtgggggctgcaagtccttaagttatagttggattcccttcccagcaaggaaccaacaggaaggaaaacgaagtcaaacccagtctttgcacgtggaagcttgtggcgtgactgttatttttttgtgatgttctgtacagccctgtaatctcttatttttggcaagccaactctgaatctgtggtcccgtagccccaggcaaccaaaagctgagacaaacagaggaagtgtcgttattcacatgtttctctggccacctcatcgggctggacgctgccggctgccacccgtcgctgagctggagctccccagagtgcagcctggccaggcagggactgttgaccctggcccctgtaggaagcacctctggcttgtcccccagcccccagggtccctgccactcattacttctctgcactctttctgtaatttgttcatcgcctggaatttatttctggcagactttgtggtcaaaactgggaagtgtctgtttccttaaaacagcctttcctcaaacccaggaagtgaagtagggagctatccttcctcacctcctccctgtcacatgcacatgggcatacacacacgtacacactcacccatgtgcacacacacaggcacacacatgagaaagggacggggaaagctagggtgtccaccccagcctgggctcctggtatccctaagggttttggaagaagagtttcagtttttcaaagcctgctggagatgtaactgtcgtgatgtttcgtgggatctgcaagagcctgtagcgtcaggtttctttccttttgattgggatgacatgaagtctgttaatgcgggatcgtttgtgttatctgctctgataggtggttttacttgcatttgatttttgatagaatgagagatgaattgatttgttcctgatacattctgttgggatacagtccatttgataggaaggttgtttacatcacagtgtcctgtatttgggggctgccctgggatgtgaaaagtctgtttatgtctgttgacagagggtctctatgcttcttccttttctagcatttactcttatgttacaattagtgcctgcttgctgtgtgaacaggacagatttgtcttgtttgtttgggtcgtatgcagtttcatgcagaagacttagctagatgagtgactcaaagttccatgcctggggccctccaccctccttccctcaatcacgcctttatccagtcccttcccacgccctgttcctcattggaatcctctgtcctagcctatcccccctgctctcccctggcatagaagggtgcatctcgtctccccacaacagcactggaaggtgctagaacacttggagaaaactagttctgtaccagggattatgttcagcaggtttatctcctcaaggcacccctaaagtatgtttttactatttaacacacgattttgtaggccctactgttgttagctgttcgtagatactatttcagaacaatgctgtgagtagatactattattaggtccatttcacagataagaaacctgaggccctgacagggtaaggagtcctaaggttctgtagctagccatggtagagctggggtgtaaactcaggctttctgactccaaagttcatatttttaatccctatacagtgaagtaggcactgttgccatttctattttgcagatggggaaactgaggcactgaggagttaagtactttgcccagggtcctagaactagtcagtggtagagccaggattctacccagacaggtgagctctggagccaaagccctgagcatctgtagtagattccttgtggctttctgtcctgtccttgttccgagaaagttcccaggggacagttacggaatcactgggtgcttgctgttctcacacgcacagtttctactggctctctagcatttctttcattagtgagagaatgtttcagcccagcttttcagatggtggagttgaggcccccttgtctgagctgggtatttgagagccagcaggcttgagggcctgtgaggtctctggaggacacggtggtggtggggccaggagaagtcacttcttgggactttggaaagcctagaggaattccagaaatgaaacaccacacacttactggaagccaagttcgtgtttctcccactggtggaagggatatgaggtgctgtaaacgtggccttttttcagatgcagaatgcctgtctaattacaggaaacagagatgtcgccccacactgagccaaggatttcaacatctcttggagaaattctgcatggacctgaagtttgaagctttgcattgtaaccaagttggctctccttgccttccccccaggccacgatttcgtcatcctgctttacggatggcatttcctattaagtgtctgtctgtgaacataaacatggagctgagacaaagcacagcttctccctggacccggaaagagggactcaggcgcctggggctggggcctggctccagacctgctgctgctgcctggcctggttcggggatgcctagcctaacaaggcagcctgggctgggaatcgcttaggcctcaggttgatgaagctgggagaagggttgagagggcaccagacctaagatggtggccagagccatttaatcatgtggttgtaaaattgtcagtaacttctttgtatggctagttgatctgatctctcatgtaggactcagtcccccagttggatcttggaaggtagacatttatttgaaacagacagcctggtagagtgaaaagagctttgtgttttaccccctcagatagtaagcaaagaaaatggaaaaagcagcgctgtctggggtgacatcctgatgcattgctggtgacagagtgaagaggtgacacatttggaacataatgtggccatctgtatgaagaaccatagttcatccagtcatcccaaccctaggactctccagagaaaaccgtttaaaatagggggaaagttatttgcatgaatatgttcataagaacattatgtataatagaggaaatttggaagaaacctataggttcttccacagggaaattgttaaggaaatgatggtagattctccgcaagaatggctcccattaaaaattgaattagtaagactctaagataatgtggtattaagaaaaaaactccatgattaaaaatgagcatgggccaggtgtggtggctcacgcctgtaatcccagcactttgggaggccgaggcgggtggatcacttgagctcattatctgatgccctgaattggctttttctcatgcacattaggttaaggtcagtagttactcacttaagttacccattgcatgtgtttccagtgacagaaaaggatttagggatggatcgttgaggtgactgctatgcatagaaatgcctagaaggaggcggtggtttaagctgtagaaggaggcaggtgccaagtgctcccagtttggggtttgagctcccacattctgtctgcacagcagcaggcaagtcccgtggcctccaggctctgcatctgtgatgtaagatcgtaaacctgtcctgcctaccttgtttgagcatcagatgagataaggtacgtgataacactttgtgaatcacttaaaaacactatgtctatgtgaggttgatattattgctattcaataaatgcaaacgtgtaggaaattataaaatgattcaactgttccattcctgtttttgaaactttctgaagagaggtggatatgtttccctgaggtggggagctagggttgtgcctgtgttcatccaggaaaatgggatgaaaagcccaagatacatctgcgacatcatcttcagaatgtgaaattacagtgggtttggaatctgggccttctctctgcctgctccctgcctctccttccctacccacagtctccagctctgactcctggcctcccagggtcctctcccagcagcctggaaggaagggacatcctcattccagggcccaggccatgaggaaggaagcagtgggcagggatgcaggctgcaggtgtgggcagctccaggtgcccactctaggcttcaggatgagtggctcccttcctgcagtgggtgcccatcctggcaggtacagtcaccagagaggcccgcctgcttcagctgcataccatggggtttttcctgagactaaagagggtcctgctccttatatccattgaccagtgagtgatgaggaagactgaatgctgacggacgggaggaaggaagtcaggagaaagggagaagggctggccaggaaggaggagagaggaaatgacagaggagagggagagatcaggagccccatgcctgccagccagggaaggccctgctgttgcactcttcagaaccccaacttgggacattttgaatagatgttaggagtgtgagtggaatctaatgagtgggacagacctcccaagtgagcattgaatatgagggcgggtggggcatggtagctcatgcctataaccccagcactttgggaggccaaggtaggaggatcatttgagcccaggagtttgagacctgcctgggcaacatgggagacactttctctacaaaaaattaaaaattaactgggcatggtggcacgtgcctgtggtcccagctactcgggaggttgaggtgggaggatcgcttgagtcctggaaatcaaggctgcggtcagccagattgcaccacagcattccggcttgggtgacagaaccagaccctgtctcaaaaaaataaataaaagataaaaaataaagaaaatgagggtggaggaagaagagccagcggaagattcttctgagacatgggaagtaaatttgcaagattgctgtctgggagctggacagacaggaagggaacagaactgggatgtggcagggacaggttccaggcactggcaggatgggggccagtgtgcagtgggccaagagggaatgggagcgagaaggtggggcgtcagcaacattcagctccctccatagctcgatgagaagagaggggtggggacaggcggtagctggagggtccttcaggatcattttatccgtatccctttcgtatcttttagtgagtttttgttttccctaactggattgttggcattttaagggcacagtttgtatcttctacctctttgtttcctccaaagttggccgatcaccagatcacttaaaggaggttgtttgttttataagcgttttaccagatcttggcttaacacttcccccagagttagtcataatcattctagcagggcttctagatgctgaacaatgaccgatggtgccacttgatttatatgaagatactggtttagttttaaaagcaaacttacattgaacaaagtgtaggaaagagaaaggagagggctactcaagtgcctgaaggtccgagcagtgaagaacatgtttccatatgcctgccacccttaggctaaggacacggttttcctatctgtttattgaattgggtcacttgctttagttataatatatgaagggataagactgaatttcacttctcaattaactagccctcttgctctcttttgatcacacgttctggggtcagattccagctctgccagtcagtggctgcactggccaaggccacgtggttgaccaccatccagagttctgccaagagccttacctgccagaggcacgggaggtgtggctgttgcgcagcttctgtggcccaggccctctgcctggcacattttaagtaatgtgagcggattacttaatcttactgtctgttcagctgaaaactagggccaaccctggctcagagctcagggggccgttgcgaggattaaatgagagaatccatggaagatgtttagagtcgtaccagacacataggaagtgctgaataaatcagaatggtttttactatgactctcacctttcaatgtttgtgacttaaacttatgttacagttagtcatttcactggcgtgtgctaaccaaaggtggcctggcccctccgcatccattaggagggcttgagtttaaaatccaggccctgtgagtctgcagggaggaccgacgggagagctgggtactcctgggacttcagtgtccagtggatgctggggttctcaggttggtatattgagtcacatagttccatgactcccttggaggaagaggctaaagttgtctagaggcaggtgtgatgtttggtctgtcctgtgtgcactgagcaccttctgtataccagtccccctgcttgcttcttccagacagaagaaaacacagatggcaattggtcatatttgaacagtgcctcttatagcttacaaataccatcttattgaacactcatgaaaaatgctgggatgtatgttatttttactgtttcaaagatgaaaaaactcaggcacagacattctaaatagttccagctcttaggaaaatgcttctttagcattgcgggagaaacagtatatttgtacaaggcaagtagttcaccctgtaaggcagcacgtgctttggaggcacctaaatactacacagtgttttatgcatgggcgtttttcttacaaaggaacatagctttatcttcctgggggtgtttatcaaaccacatctatgtagcagatgctcttcaagcatttcccatattccctcgtttacaacaccctggaaccctgagttaattattagtcccatttcatggctgaggaatctgaagctctgagagtttgaacttcttgtctaaagtcacatggtgaggaagtggtagaactgacctggaccccaggtatctggctctggtctttccaatagtgcctcttcagtgggtatcccttaaattctcaggggcaggtgctttctcctccttttatgccctttttttcagagcaaaaccacgttatcctaactgccaagcacaacccacaaaggctcttatctctccttcaaaaaaagccattccctgcctggttgatgaggtcacctggcattttgcagggcattttgcagggtagatgccagctcgggaaagccacatagataagccagtggatggcttgtgttactgcctccctgatggtttgcttttaattcaagtcgattcatttatctgagatgaaaaagggagaggctgattcacacacattgaaaagcagggaatggtgctggagaatgaggccgtgactatttggaataagatcctggagatgggcagtgctgatagagtaaatatccagggagcaggggaaggtgtgtgcactgacaacaggagttttagcatctgcccctccttgcttcaaggggctggcgggtacccgaggcggggtcggagggctgagtgatggctcccatcctccctcttccctcctgctccacgggtgtaaccttgaggtgggattggagggcttggtgacctctctcctccctcatgctccatgggtataaccccaaggtgggatcacaggctgagtgaaggctcctcatcctccctcctcccttctattccacgtgtgtaatcccaagatgggatcagagggcagggtggagggttacacatcctctcccctccctcctgctccacgtgcgtaacccccagctgacttacagactgtggtacctgctcaactgcttcaattccagaactggaactgcagggaagctgtttctgacatccctggttttaattacaaagggccccttgagaccttgtcagaaatactgccagcctagccctttaaaaactcatgatattgggttctctatcagtgtcgctccctggctgtaatattgtactataattaggcaagatgtttcctttgggggaaacggggtgaagggtatgaaggttctctctgtgtcatttcttaaaactccatgtgagtctatagtgagttttaaaaagaaaaagttccagcctgggcagcatagcgagacctattgtctctacacataataataataataaaattagacagtgtggtggcgcacgcctgtggtcctagctatttgggaggatgaggtgggaggattgcttgagcccaggagatcaggactgcagtgagctgtgattgcactactgcactccagcctgggtgccagagcgagacgccttctcaacaaaagaaaaaggataaaagaaaaaaaaattaaaagtagggtcatttaaatatggcaaactccaaacgggtcttctctttgaagttttagggagcagcttatttactttgtgtctcacactttgctaatatccaaaatgcagaacattagggaaccgcttgaggcaggaggggaaggaagcactgattctcgctgcagcatggatgaaccttgacgacatgatgccaagtgaaagcagacagacgcacaagactacatcttttatgattccattgataggaaatgtcctgaataaacaaatctatggagacgggaagtagattgatggtggccagggtttgggagtagcaggggtaggagggaatggggagtgactgtaagtgggtaccaggtttcttttttgagtcatgttctaaaattagattattgcaatggttgtaaagctctgtgagtgaactaaaagccaccgggttataccctttaaatgagtgattgcatagcatgtgaattatacctcaataaaactgttaaaaaaaacagtagggtcctttgatagttttaatagaagtcataataagaggaatagtcctttttcagagactgcttgtaacttgcaaattcaggccactgtcctggggcatgttcctggctctcataaaccagattcacaggcccaccacgcagaccatgagggtgtttccagtcactcatcttgagggaaggaacacccagtgtgtgccaggcattttgccaggtgcttttacctacgctttattatgtaaactttttgcagccctgcatggtatgtggttttacgccttttttttttttcttaatagacagtctttatctgttgcccaagctgaagtgcagtggtgcagtcatagctcactgcatccccaaactcctgggctcaagtgatcttccccacttagcctcccgagtagctgcgactacaggcacataacaccatgcccgggtaatgttttttttttttttttttgtagagttggggtctcactatgttacccaggctggtcttgaactcctggcctgaagcaatctgcccacctcagcctcccaaagtgctgagattacaggtgtgagtcactgaacccagctcatgcctatctttttatagatgagtaaatggaggttcctggctgggtgcggtggctcatgcctgtaatcccagcactttgggaggccgaggttgggaggaacatctgaggtcaggaattcgagatcagcctggccaacatggtgaaaccccatctctaccaaaaaaaaaaaaaaaaaaaaaatacaaaaattagccgggcatgatggcgcgcgcctgtgatcccagctactcaggacgctgaggcaggagaattgctcgaacccaggaggcggaggttgcagtgagctgagatcgcgccactgcactccagcctgggcaacaagagtgaaacgccatctcaaaagaaaaaaaagaaaagaaaaaagaaatggaggttccaaaaggctaaaccacagtaagggagtactgcagcaaaaactagaatttgggggctccttgacccccaagcctattctcttttcactgctggtatagtcgggttgccaaggctgccctcttggaggggccgatagctcagggaggtcaccagaggaaaggcctgtgagctctgtgcaagtcattttcaggcttgtgtcctcagtggggactctactccctccggaagtgagtatgacattctgccctattcccttggagcagctcttcccaggagagcttcagtggaaagaaaactgtgggaaaacatttggaggcatttcatggacacgtttctgagtgttatgagctcttgaaggaagcatgtttatttccccaaagtgctcagctgtgtccgggtcctgagtttttcaagggtttataacccccggagctgaatttggatatgcaaggaagccatgggattgcagccagggaacatgctattttttgtaagtgatgatgctgttgtgtagtaaacaggcccctcgtggtaaatggagagcagtgaatggaggtggagggagaagttttgggaaaagatttgcactcagttaatgatgctcaaggtagttcaaggcagactcagtagctcccgggttgcttagtagaaatgcagattactgggtcccagtctggacctgcagcgtcagaaactctggggtaaggtctgggaacctgtgttttatttttatgttatttttttgagacagggtcttgctgtgttgcccaggctggtcttgaactcctgggctctagtgttcctcttgcttcagccttccaaagtgctgggattataggcatgcgccactgcacctggccagaacctgtgttttaaggaacactggagatcattactgtgcaccctgaagtctgaggagtctagcaccagatgatctgacgacacatcattgggatgtggagtcatggttccagtcaccagcctgaagttgtccttgtctgtcaccctccccactttgtctaagggtgagtggaacagacagaaagtagactagtggttgccaggggctgggagtagcaggctaggagggaatggggagtgactgcaggtgggtacagcctttcttttttggtgatgttctaaatctagattgtggtgatggttgtaaggctttagatggcttgcttgagccttgcaatgggaatgagtgccttggcctaaggagaagggaagaaaatcttgtggaggaaatgagcttttatttttttcctttttttttgaggcagtctcttgctctgtcacccaagctggagtgcagtggtgcaatctcagctcactgcaacctccgcctcctgggttcaagtgattctcctgcctcagcctcctgagtagctgggattacaggcacctgccaccacacccagttaattttgtatttttagtagagacgaggtttcatcatgttgcccaggctggtctcgaactcctggcctcaagtgatcttttgccaccagatattaaaatgtatcaaaaagctgctctatttagtactgattgagatgaatggagcaaaatagcccaggaacagaacctggtattgtctctctgtaaagtatgagtgaatttaaaacattattagatatgttatctagtaataataatgataaagtattttttaaagtcatcatgaatcaatagaaggaaaggattattcagtaactatgagcatgtgggtcttagtgtcaccagtacttatccttcttcttaggagggatttgtttttttaatcttaaaggaaatagatatgttaaacctatcaggcttccttatttacattggctagagagcctaactctaaatttagccaatgtataagactaaatgtcaagtatttatctatacaaacacacacatatgtacacacttgcatccacatctacatacacatattttacatacacatatacacatataaatacacacgtacatacatacacatacatacatgcctctttcctgattttattttaccattatttttcttccgctttatcttgcattactctttctggtttatcacattttcttgtattttatgtatctctataaaccactttaaaactttttgggggaagaaagtggactatagataaagaaatagaataaggtataatatatagaaaaaaggcagtaaaaatacacccaaatttgaataggttgattttggggtggtggtggtaatgggattattaactttccctaaaattttctgtatttttgaaattttctactcaaagaatcatatcatcagaaaaaaattattatttctgctcattccctttgctggccagtgaaaggaatgcatttccataagtgagggtctggcagagcagtgttgaggggaggggtctttgccgcagcaaaagctggtccggttcccaggagagcccctcctttgctgcttgacctgattgcaagtggaatgtgagagccagaaggaaatattccatcacttatttagagcattcatttggctcttccctgatctaggcgttcagtacctgctcagagggagtttacattctagtcaggggtcagagagtaaatgagtgaaatggattcagaaacgatgccaccctgggatggtgacatatagccccagtgagaaggatgaggagatgcccaagtcaagagcgaggggaatgggtttccagagagagagagggctgcttgtgcacaggcttggagttgcccaggggttgggcaggtcaaagtgaagaatggccggggtggccattgtgggtgagcaggtcagggataaagagtaccttggagagatcaactaggaccggatctgactggccaagagaaagagtttgaattggactctaaggatggtagacagctactaaaggatttaataaggggaatggcagtgtttgatgaaaggtttaagatccttctagctgcttctgaagggtgatttgtagaaggacaagagatgaagccaggggagtgggtagggagattctgcccaaactgattgctacacagtgatatttttatgcttttcttttttttctttctttctttctttccttccttccttccttccttccttccttccttccttccttccttccttccttccttccttccttccctctctctctctttctttctttctttcttttatttttgttttgggtgttgatgaggggacatacaacttaagaagaaaaattggaattattttgtcaacttttctacatcagcattttactgatggaataagcttgcatttgaactggacatcatttttgtttttattagataacattatctgtattacagataccagatatgtgtgtacccatttatttactaatcactaatacttacaaaaaagtaaattttgtcaaaagaaaattcagcttagatggccatattgtatgtgtgtgtgtgtgtgtgtgtgtgtatatgtgtgtgtgtgtgtgtgtgtatatatatatttttttttttcttgagacaaggccttgctctgttgccctggctggagtgcagcggcacaatcttggctcactgcaacttctgcctcccgggctcaagcaattctcctgcctcagcctcccaagtagctgggactacaggcatgtgtcaccatggccagctaatttttgtatttttagtagatacagggtttcaccatgttggccaggctggtctcaaactcttgattcatgtgatctgtctgccttggcctcccaaagtgcaacggctatatttctgacatatacaaatccaagcccagttgatcagaatttagcagtatctgcaagatttgaaccatttcagaaatctgagctctctagcattacatggactgatgttttcttagctcagaactgcttacctgtgtgtagaaaatctaatatttaggaagaataattcattgctttaagtgttcagtcctggtttttatttctattgttgcacaagtttgatttgaccttggacaaatcatttcagtttgtattttagtgcttgtgtgcagaagatgggtagtaatagtcctggtaatcctcctgccatcatgttaactgggtgagagctcttcaagacctaggagagataatagcaggtgcaaagtccctgtggtgggaggcagcaggtagatattttaggagctgaaaaacggtctgtgtagctggagagcagggtacaagggagaggtggtccagggtcatgttatagaggtaggccagggccacactggttggggttttgcaaaccttactggggacttgaatctttatctgaagagcagggggaagtcattggaggatttaaatcagggaatgacataagattgatggatatgctatctcctttaatcctcataacaaatgtatgtgctaggtaatatccccgttttaaagcagcacagaaattagggcagtggagattaaggagtttaccccaggacaccatgcaggtgaatgatggagccaggaaaccaactcgggtcagcttgcatccaaagtcctcagtcttccagatcagcgtacctccatagtaatataacaatgactgcagttttaaaacactttgaactcttaagatgaaagatttcccttaaattacaaagtggtattatgctgcagaaatgtgagcggtaatgagagagcaggtaatgcccgggaacttttgaaaggcccggtccgtgtggctctgctccagcaccttcaagttccctgccgtctggcggggggcgtctcataagctgctttcaacacaaagaagggtttggctgctccccggccatttgacactgccattgtccataaggactcgttgtccgtgaaatgcacccaaagcttgagctttcaggggttttgggaaatcagatctgggcagtgcatgtgtggtttcgctggagacatcatccaatgccaagtttctgctttctgctttctccctcttggataatcagctgggttacatggattcttagaagctggttgtagagatcaccatctcgattttgaacccaagaagccttattcagggttcaagtgggaaaatacctgctggcccacggcccttgaggctcttggtgatgatgacatatgtctgtttctttctagttgaccacgttgttcctgagcctgggacaagcctgctcgctgcctttgaccagtggagggaatgggccgacagcaagtcctgctgtgactactctctgcatgtggacatcagtgagtggcataagggcatccaggaggagatggaagcgcttgtgaaggatcacggtaggttgcactgagtcaatgccctctgcagatgtttccgcttcagtccatcaactggcacagccctgggaagaaagtgataatgcttccagatcccatttgtgcctcatgcccatgcctgcccctgggaaggagagagggctttgggccgcagcttatgctgtttggaggtggccttacccagtgcagtaacatgagccttcattgatgataagagaagatgaggcttactgctgggacctgttcttaggtgacagctgctcacagcttattggtttgtgagcaccgtgctctctagccagggtggggagttgaggctgctgagagagagatttaccctcaaaagataacaaatacatatctcagtgaggatttgacagtctcaggagagtgttgggcagccccttcctacaaacctggatggatctaggatagatttgagggctatgagacacttcaaaactgagtgacaacctgagagggcttttcctttccctagaattattttggagaacaaatttccagggattgggaagattcacagagaggcaggaggaatctttaccacctcaaggtgcctctgggactcttgtcaacaagaacctcgggggtttgcggggaagagccaggccacatcatcttcctgggtctcgctgggcttggctagagaccagattaacttcactggatcttagtgttcagggaaacacctattgctttagggttctggggacttccaggcttagaaacaccatgtgctgtgagtgacatggcaagagggaaatctctaggtactagaatgatagaaaatgccccggaatgaaaagcaagagtcttgggtttatttctctgatcttccacagactaactgtgtgaccctgggtaatttgctgaaattttatgggtctcagttttttaaacatttctcatatatgagggtcttggactagatgtcctctaagattctttccagcacaaagcttccacataaaagaaaataggtaaactttgacttttctcacttttgatcatgcggagactccaagtggtttaactgtggatacttagactgaatctgctccaaaccaggcaggagggttaccatggtaactgttgcctggcaacgggagaagggccaggatgtccagaggcatttaactcaggcagctcccagcaccccccaggtggcttgaattaaactccaaggctgcgaggttgtcaggacaattgtttaaaattgtgatgaatgttgggcagggatgtttggtctggtgcctagggaggcaagaactccaagacgccaggatgagaattgcgacatctgcttgttgaactaatggaccttttcttacttaaaaaatcatttgcttaaaaatcagcatggaaggcagtctgtctgccaaagaaaagacatttatcacagttcttcataggcagaaacttctaattcattttcttgttacagtcgcaacagacttgtttggtagaggcagcttaaaaaattaactgtggtaaaataaatataacattcaagttaccatcttaaccatttttaagtgtgtgtgcagttcattgttttaaaatacactcataatgttgttgcaaccatcaccaccctccatccacaggtctctttatcttgcaaaactaaaacgctacactcactcattaaacactaactctccactgtccttcaccccagtccctggcaactgctgttgtactttctgtctgtgaaattgacttctagggacctcatacaagtggaatcatatagtatttgtccttttgcaactggcttatttcatttaccatgatgtccttaaggtttctccatgttgtagcatgtgtcagggtgtctttcctttttaaaggctgaataatattccattgtatggatagaccacatttggtttattcatttatcagttaatggaggcttgatttttgcttccaccttttggctattgtgaataattctgctatgaacatggatgtgcaaacactggcaacttttaattttgatatacttgtaaacttacaggaagattataagaatactaaaaagcatccttgtgcctcttcctcccacattcacaggttatttatatggtactctgcttcctttaccattctgtgtctccatttctctcctctctctttctctgtactgaaacacacacacacacacacacacacacacacacacacacacgtacacacacagacagtattatcactttcttatcccttatttggttatttggtttatctattaaaagtccacttctctattttgtccgcactaggggtaaattccttcctcgtgtacatggctttcaaagatcgcttccagctaacggattgccaggtaagaaagtcggcttttcggaagaggcaccctgacatttggtaccttcaggctgtggccgtttgggaaagcagtctccgatgtatgcatgtttcctagcttcctgggaagtggctggtggatgcagttactgatgtaactgagccttggaagagagtatgaacgcagtgccctggcccccagcactgccactccgccgccctggatctgaggctctgccccgcacggcgtgtgtgggagcggcactcagaacctccttagcaaacctggtgcagagccaggtgtcacccaagagcttctcactcccggtccacgtcctgctaagttgtactgcctctgttaatttctgaggggtctttctccatcaaatgtggccagtaacattgccctcatcatatcaaaaaaagtcaggctaatagaatcgcctaggtgtcctgtttctcatcccagaaatgcctctggtggggagatgattgtctttgtgaacaggaagatggaagtccctgtctctgatcccacccttgtctctctctcagatttatgaagtactgagtgtgatccgggatattggcgccatagcccaagtccacgcagaaaatggcgacatcattgcagaggtacagggctttctttttcgtcatttcttcatcacctggagggtgagaggcaggctcaagaaagggaagctgcatctgtagcttaacaccaaggtggaaaagcagagggacctggtgttcccttgctggagctctgctcagtctcacccatggcatgaatgccagtgacacacgtgcctctccgtgtgtgccacagaacatctaagtcagttactattgcagagagaggccatttctctcggtgctgtaacgcagctgccttgggtggggtacgggaaccctcacgtcacacacaggcattttacaccgtggctgagggttgcaaatgcaccagtcgtcagcatcccagggaacagctgaatgggttttgggaggctgtaattgatccatcctgctcaggcgggactgggaacagggcagtgaacccttctcttcatgaggtcttgggatgagggcagaacgatcggcagtggtaattttccatcttgcccggataactgcatgcccgggcctctgccatcagagctgtgcaaaatccactctccctcacagcctgactttctctaaacattgcaggagcagcagaggatcctggatctgggcatcacgggccccgagggacatgtgctgagccgacctgaggaggtgaatgttcaccaagcggaatgcgtgaatcagtgtcccttgggcactgtgcagagcctcagggaacctgcttcctgcctgttgagaagggggcttctctgatgctgactgtggtctttctgagaagctgtgggtcacgtgtgtgtctgtctgtctacgcaggcaaagtgaagtgttagattgctcctgagggtaaggtggtgtggactgtttcgccagaagattcttctttctgtctgtaattcttcaagcccttgcttgtatagacacaaacagttcttcattggcatcctgcaatgtagattttagtggttcacaacttatggtctccaatatcttaccaaaattcaccaaaacgtagttggaaggatggaaaagctcttctaaatgcctagaaggcgtgtggggaattgtttttccaaggtaaccctgcacaggatatcacatgatatgcagagtttggtagacagaatcttttaaaattatggagggaagattcagagcaggggcctgtgctggctcaaaggtggagactcaccgtcttggtgaggtgtgtgagttcgaagggagggtgcacacgtcttaggtaatggagaacctgtgttcatcagttagaatttgtggctgtgaaatacttttcagaagttggttccttaatgacaggctggatgtcaggctctaggggccctgactagggagcagcctgcagcttcgagtgaagcgtgcaatcagggaatctccagggaaccaccaggatttccccttcatgggaggaagtggcagaaaagggactggcgccgagcagtgggggaagatcaccaagggcctgagtggaggctgacagtgaggaggctccagaagcctgggagggaggagcttggcaagagctccctgcagggctgtggccactgagtcactgagtgtcagcaccgtgccaccaccctgagtttgggatgtggtcatgttcataccagtgtgggaggggagccggtccctgtgataaggaagtggattcaggagggcttggaagcaaaggcaccatctgtgtactgcctcgggtgcaggagggggtggttgggatcctttcagacttgaggggaagggatgaggctggaagaggagaaaggagtcaagacaggcagaaagacgagagtgggagccactcggaatgctttgcacacagtcagggtccacgctttgttctatccttcttgctgcatgcatatgcacacatagacacacatgtacacacagacataggcacacgcagacaggtaggcacacaacagacatagacacacatgcatacacatagtaacacacacagacacatagacacacagacagctagacacagccatagacacctacacacacacacatacacatagacacacagacacatacagacacagacacagacatacacagacacatacacatgcagaggcagatacacagaactgcatgctccaagacactttcagtagcatttgaggccctgaggacattttcctctccccagatgacagaatggaagccgtgacattttcaggattgcacgttcctgcttcaggccagggatgcaggcccttttgtagctatcaaccttctcatgcgtgctaaaggctgaaagggtggcctggcacaggcccgaggatgagggaggcaggcaagcccctgtgtcagctgagggaagccccatgctgagaccgtggctggtggacagtgattgcaggggacagcttgcaggcgagagcaggctaagatcagccgaccataaacatgcctgaggctgattttattttattttattttattttttttcctttttctggagaacggggtctcactatattgcccaggcaggtctcgaactcctgggctcaagctatcctcccacctcttagcctccctgagagctgggattacaggcgtgagccaccgcgcccggccgaggctgattttatgcacatttgtgtgcacacagatccacgtgcacaagcacacacacgtgcacacactcacgttcacacacatatacatacacacacgtccataggcacagacatgcacgtgtacacacacagacacattttagcatacgcacatgtgcacaggcacagacacgcacatatgtgttgtacccacgtattttcacatacacatatacacatgtacaagcacagacacgcataggtgtacacacacattttcacacacacatgcacatatgcgcttgcacacacctatgcaggcaccatccccctttgcagacaccgcaagggttcgtttctgtggtttcacttctccctctgggccggcttctgtgactgccctcgccagattccccaggatccacctgtcgggtggtttaaaccatggcagcataagccatggttgctctcagccctgacctccctggaattgggctttgttcccagggctttgttcccagggctttgttccgccctgaaacagtcttgggattgggccttggaaatgcacagagtccgggagaggtggagggctgacacagttctcacgtgagccctgttcaaagctgccttcatttagtgctcacgtgtgctggacactgtgttcctggcccacatttcagttttgtaactgtcctgtgcaggaggtacaacatctccttcccacaactccagggatgccattcatgcaggctgcatggctgtattcagggagcaccatttacattctactgcccatgagtggtggtaccagagctgtgctgcagtgggctccttggttatctctctttagatgaggacactccagaagcatgaagttaagtgactgcccagttatcaaagcagagagctagaaagtgcagggtcctgcctgctaccccaacccctcccgcagtgtacacatactcagcttaaagccacacctggacctgggctttattagaaagtttcctcctgctttcctcccgtttggtgactgggagccagtccctctgcctgccatgtaccagctgtacaaggaggtgagaagatgtcctctgagaaaagcaaatgccacttctgcaaatgctacatgaggctcctgctgagaccctcactcttcaagttttagagccttctgaggggcttgcattccttctttctcctgctttctgcagagaagtacacaaacacagaaagaaagggccctggctttgctgaagaggaaaatgctctcagagagttgttattctggttgcttgtattcatccattttcatactactgtaaagaaatacgtgagactgggtaatttataaagaaaagagatttaattgacttacagttctgcatggctggggaggcctcaggaaacttataatcatggtggaaggtgaaggggaagcaggttccgtcttatgtggcggcaagagagcgagtgagcagaaggcaaactgccacttttaaaccatcagatctcgtgagaactcactcattatcacaagatctgcatgggggaaaccttccccataatccagtcacctcctacaggtccctccttcaacatgtgtggattacaatttgagatgagatttgggtggggacacagagccaaaccatgtcattgctatttcaaccagagaaattgaaaccatttttacgtgattaggcccagcagctgttgccctgagaacttcagaatccccagcaactgattatggagtctccttgagggctggcagatccagggatgcaccagtatgggatgcagtttttcagctgatttagaggcccctcttgtatgccaggccctgagtccttttagccatatgacagcccagtgaggcgaggaggggggatgcagggggtttgaaaggcttggatagtggcagagcgtgattagaactcaagcccacaggcacctgccggctgacgtctcctctcatggtgagtttgtcaagagggatctgttgtgtgttaaaccctgtgtgggtgataaagagaacaagtatggaacaattttgtgtgaattttagcttcccagtctacttggggaggtgctgctgatggaatgaaacacatcccagtgtaacttctctgtagtttggtgacctatccatcactagcatgatggttctcttggatttgaactttccaaaacatgttcctaacccactaggcctttcttcccaacccaccatgtgagaccacccagtaggattttccctcgttttccacccagaggattggaaaggacactagggagtgcagacatctggaactgaaccatctgtggctgagaggagtggcgactgagcctgcgtgacaatccgggcagtgcctggcattgtggggatgcaaaacagataagaaagtgatcctttctgaagggactgtggacaaggcgaggagaaagaggtagacagaaagtgagtgtagagatagaatttgacagtggctctgagctgtaagactgatgtctgggaagagagtggggacttggagatgaggataatgaagaacccttcacagggacgggcactttccagcaggccttgtagaatgacagatgtcctgacactgctctgtgtccctggacaggtcatttccctttctgagttacctcatcattaaaatcagaagataggcgtagtggcttgtacctgtcatcccagcactttgggaggccgaggtgggaagattgcttgagcccaggagttcaagaccaacctgggcaacatggcgaaaccccgtgttgggacaataaatggagtagtcacctgtatctctgggaggtgctgagggttctagtggagtccatctcacacttcacacccatgcaagacgtccctgtccccgcctggtgctgccgggccacaggcatctctgctgtaagtggagagagagggcttctccttcagctgtcttaggaatgaaaaacatttgggtgtttaatatgctttttcaagagccctttgcttggattgtggatttctagacatcccttttcacatagttgatgcctgaaaggccaaatgtgaatgaagttgtctcagctctgctaaattagattaccagttaatgcaattacagaatttaatcttttggccaagctctggtggagacaaggtaaccaattcagttataggggctcagttatttcttgtgaaaaataacagtgttctgtggagcagcctagactgaaataccatgaacataaaatgaaatcatttatatgcttagcaaacatttttgagcacctgctgtgtatcagacaggacattgggagctattgggggcagggcatggaagatactaagcagtgagtaagccccagtccctcccctccaagagttcaagccagagcccttttgctgggatggagagggagccagtgatgttctgagatctgccttccacaatttcacctgctccttcccttgctgattggtgattcctctgtaggatagaacttgatccagggagtcttgcctgatcagatattccacagtcatcatgtgggatttgaaatatcattcatctgaacatccgatgtatttatttatttatgagatgaagtctctcgctgtcacccagtctggagtgcagtggcgccatctcagctcactgcaacctccgcctcctgggttccagcgattctcctgcctcagcctcctgagtagttggaattacaggcatgcgccaccatgcctggctaattttttttttttttaatttttaatagagacagagtttcaccatgttggtcaggctggtctcgaactcctgacctcaggtgatccacactcctcagcctcccaaagtgctgggattacaggtgtgagccaccacactgactggaacatccgatttaaagcgccagattatttactcaagcagttcttcaatcttgtgctgaaggtcgtaccaggctgtggctggccatgtctgtgcttcacacacagggggccattggtgtagacaaacggggcccactccgttcctagagccctgtgaggctgcattgtttcgtgggtgatgctgacttcattcatgagcatttaatgggagcccagcacaaactccacatcactgaatatcttgactcaagaccctgggagcagaatgaatatatggaattgagagcaatcagtgtctgtgtgtggcggttctcaaacgttagtaagtgtgaaaatcacccacattgctgggtcccgccctcagagtttctagcctgtgagtttctagtccagggcagagccagaaaatctgcatttcttacagactctgggccagtgctgatgtcacaggcttgctgcctgcacctggagaagggtcagaagggagttttcttttctttttcttttgagacttagtctcactttgttgcccaggttggagtatggtggtgcaatctcagcttactgccacctctgcctgctgggttcaagtgattctcctgccttatactcccaagtagctgggattacagtcacctgctgccatgcccagctttttttttttttttttttttaattgtatttgtagtagatacggagtttcaccatgttggccaggctggtcttgaactcctgatctcaggtaatccacctgcctcagcctcccaaagtgctgggattacaggcatgagccactgtgtccagccacaggagggaattagttcaaccaaaccaatgttgagagacacaaggcaagtcatactcctttgaattgtcccctggggtaggaccttggagaccagcagcctcgccttcatcttagcctctctctggggtggaggataaaggtagcggctcgtggggtgggctgagccacattctcatgctctgctgctgttttgcaggtcgaggccgaagccgtgaatcgtgccatcaccatcgccaaccagaccaactgcccgctgtatatcaccaaggtgatgagcaaaagctctgctgaggtcatcgcccaggcacggaagaagggtgagtgctgtggccggactggctgatggcaggtggggaggtttggaggggaggggggctcctcactagggagggctccttttccagaccctcatgccaagtgggccacttgcaccatgttctggcattaacctaattacagccgggcaaggcaggagctccagtttcctcctctgctccactgctgcggccttgttagtatctatttaaagccatgtgcacgccaaggcggggtgggcaggcacatgtcccccagcccccgtgcaagagctggacttactttgatgtggttgaaataaactaggcacatacacagattacgtcagtttccatccgccccagaatccttggtcacatcatgcacctcccctccaaggctgggagtgatttctgccggggtatgtaaggcagctttgtggggtgtggggatgcattttgccccagacactatcacatccagatgttttggtgcttgataaactctcttgatgcattctgaactggggctgggtctctggtattactagggtgtccactgtaactaactgatgaagtgcagcttccagtgcttcctctagaggacgccccatgaggcacctcatgcattttgaatgcagctgagccctgttgtcacccaccgctgacaacatgaatttcgataatcacactgcatcttttatgcttgggagttctctcctcgtacagaaagcctgagggcatgtcgttcattttgatggtggatcttaggctgatctgaaatgaacattataaaagggtccccttctttcttccttcctttctcccttttatgttccctcctcccctttgcctgttgggatctctccatctctgtgtctccacttctcttcccttctttcctgatttctgtttcattttatctttcatttgactctttctcagtccctctgtcattctctctctgtgtctttctttccctgttaggaagggagccatttgacctctatggcttggtttctacttccctgcatcatgcaatccacatggatcaaggtgggctgtgggatttttttcactggcgggtgacttgctgcaagccctggaacaaattgctcaatgatgactgagtcatcttgtcccagagatgatgacttccagacggacccagcgactcctggccctggttctttggagtgctcctggggcctctgtccttaggctacacatcaaatggttgctgcctttctgtcttctcctggcaccttgaaggaattgccttttagaaataagaaagcattcacctaaaataatgtaacctactcagaatgagctttgagttgttttctaggagatattgtggatgacgatggaatcggtggccttgggccacccagacacgcatttgcaagaaggcagcgcatttgtgggaatcagcctctgtacagaaggccggccacagcactgctgcccccacgtagtgtggggatggttggcatagtgtctgaaagggggaaagaatgagacggcttattttctgtattttactactgcgctgtacctagatgatgatgatacgtgagttaggctaacatttcaacgtaattttggatagagaccttgtctaaagtttacttcatattcaaacctgtccaaatgagaagacggaggggtcctacatgtcccagactttagttgggggaggtggagtcgtgggccagccctgccgcaggcctcctcctctctgtccctcagggttcttctcaggtggagttgcggagctggagtgtgttgttgcggtgcccagtttggacctattaccccaactcagtgcctggtagcccccgttgttgttttttttaatttattttattttatttttgagatggagtctcactctgtcgcccaggcaggcgtgcagtggtgccatctcagctcactgcagtctccgcctcctggactcaagcgattctcccgcctcagcctccttagttgctgggattacaggcgcccccccatcacacccatctaatttttatatttttagtagagacggggtttcaccatgttgaccaggctggtctggaactcctgacctcaggtgatctgcccgcctcggtctcccaaaatactgggattacaggcatgagccactgcacctggccacccctattgtctttataaccttgacacactgtgtgtcttatggggtgagcagtaggaggggactttagtctgttcccttccagagccttctgagtgtgagtccaaatgtgcccacaccatggttcccaggatggcatttgcattcaaactgttacccattaatctgtgaaagcctgagctttagacaaacctgagctgccagaaaggaatttccagtgcattcaggtgctaatgagcaggaatgagaagtcctagctaacttcctaggctcttaggctctttcccatcttgctggaacttcctagcaactttgggaggcagccctggcaggaatttttatattttgttttactttgcagctgagtaaactgaagctcagagctcatgtatagtggaattggggcttgactgtcaggcatctaacttgaggccacaaatatccgtgtaaatgtttgactgacttaccttcatgctttgagattattttaatacggtgatgcttgtgacctgtgtctgttggggcttagttccttaagaatcctgattgaaacagtggcctgacacccagcagagatatgggtaatgtacacacaaggattcccaaatgaccaagaaggaaagctctgtaagggagtattaattgtttgcctccaggatcagtattcattcttggatcaaaccccagctccactgtacaccagccacgtgatgctgggtgcttcctcatcatctccacatgtccttttgccatctgcaaggggaggatagtaaccatgactcatctcacagggtgatgatgatgtgtacatgagatattgcaggtaaagatggagatgagaagcgtgaccagttattgtgactacaggatgaaggggctggtctaaccttgagcttgcgaggaaagcagagtaaagatgcctgctgaccctggacaagggttttctgctcagaattgtttgtccacttcaggtgggttcttctggccccctgaggcaagtgtgtgcactgccacagccccctttctgatgctgcatttcttcctctgtgaatggagagattctgaattcattgaatgcattttcatgatgtgatactttaggcctgcgtaccaggaaaataaatggtcccaaccacagttagctcctcgacttgcaggggaaggatgctgagtggaaagtcacattgggaggtagtcggggctacaaaaggggtacaagtcaggagaggttgagcccagaagggagtctcagagaggtcaggctgcgtaagcagactcgaaattttgctataaatgtgagctttgaaaaatgataatcctgccctgggaggagtagtaatgtctccttctcttagtgatccacatgaacctccccagccaagacctgctggtccagaatctaagacaagagaagttcggggaagtgaggatatgaggtgaaacgaatgagaactgttttcacgtgcctgcttgagccagcacgactgcatcctgccttccctgagagacacgctgagagacacgctgcttccatcagccgctctgtggctgttcagcaggatggcgtgttcagccggggagtggtgtgtcatcaacccaatttggcagctgaggcaatgaacacagagccaggaccagacgacctgggggcatttttactcttgaaaagaacttagacattgatcaacttaataggctcatttcatggaagaagtagaaatgcagaaattgaaaatcttgccctggttcatgtagcctgtgggaattagaaaccatgattccaggctcctggccacctctctttccatggagggccccttgtggggatttcttctctagaatgggctccctctgaccacattttgtccatgtgtgaaatccagcatgactgctgatgccttccatgtgtgagtggtggccgtgggcagtgcctgatgacctcatctgatggacattcttttccgtcctcctcctcacccctctcccataacccgggtgcagaaacattcaggacattaaaccctgggaacctcaatttgagataagacctcttatgtcctgtgggtcaataggagtgactcaaacgttatgagaagcacatggtcgcagggcctgtgaggaccacctcagcttggggatgagtccttagttaagcttatgcttgatgttgcaatcttgaacagaaaagggggatgagagaggagagaggacagtagagaaagggggaagatttattttaaagaattatatttaaggaatcaactcacacgattgtggggatggcaagtctgaaatctgcagatcaggccacagactggagaaccaaggaagagctgatgttggcatcggagtccaaaggcagaattccttcccaatctatgccctcacttttaacggcagatggtctgcaaggttgggaattcaatttgcattgtaattcagccactgccaggatgagatcctacttctggttttcagccatctcagctctgcatctatgggacataagggcagacatagaaacttttgattcattcatgtggtgcttgagctgggaatttgaatccctgaattcattcttcttttttcccccactttgtctagtacaattaggagcaaccaaccactctcgttatacttgttaattttacaaaaatgtttaaggtatctgctacacacccacctagaaccttgcctcttagaagcctttgggagtatttaataatattttctgtgtctctattgtcccatcatgccctgtactctcctctttttactactggacgtagaatcattagtgcctttcaacccaatcagatctgagaacgaatttcagaaacctcagaacccattcagaaaactcatttttaagatgatgttcttctagaaccactcttgctacgaaaacctgacagcacagtccccaggctgtttgttagggtctggcataaattcttggaaaggcaaaggagaatggtgagagcgtgtgtaactgtctgtctgtctgtccatcccagttggttttcactgtgctttggtggctgcatatggagctacagatactgatttcccacagttcccactttggatttgttctcctgcttctcgtccatgggaaatgactgccagagctgggagctatcaagcatatttaaaccgcagccttccatttattcttcatgaatgcacacgggccccagactggttgtaaataagcaccagctcccatcccctgcagttcttggccttatagagagcctgccagaggctggcttggtcacatccttcagtttagactttacctggagaagaaaatcacaaaggtctaacgggcacccagatagcatcagcagtgtatttagagaagtgcagaagggccaattaagcccatttcgtggtttattattattagtggtaattatttctggcatgcagttcaagggtgtctgtggcctggctgagctccggaagtgcatccacagcaccctcctgtgaatgtttatagacccaggaggggagccctgggttgggagctccagaccactggggatgggaggcagagactctatgtatagatcatactcttgtggaggtagaggcctggaacatgatggctaaactcctgtcgctgattctgggctaagaaagaaagaaaatccaaaagacagcaaggacctctgaatccctgagggaagttgaacagagcaaagtagaaatgaaccacaggatggctccatccctcccctggcatccactgcccctgcccctgaatgtccctatctttgcttagctgtggcccagaagtccactcagcctttgtctaaagaggcaggttctgctcagcagtggcgttgagagctcagaccccattttgggttttctagaggcagaaggccaagttcattctcttgaagtgaggtagatattcctgtgcacagagagaaggggaatccagctcctcatagagcagctccccaccccaagctgagttgtgtttcgcagggagagataagcctgtggtcagcagcattcatccccatggtattcaggccactttccaagaaccagcccctccttgtacttaagtttctagaggcagggccgaggagcaggcacagggagaggatgagcgtcggcaagttacaggaaactcaggaaaatgtttatgtgtgtccagggattttcagagactatccagccattctttatctccaagtgcctctgctctcatgaacttcttcatgtggacaaaagcaggaagcctttagggccacgcatctcttgttttcctgtgacttacacagccctcacctttgtgcttagatggactgtggccagcgggacctccaggcctggctgggtcaggagagttttgcttaaccagatctgtttgatccttgaaccaaaagcggggagccagagagatcctttgagaactgatgactgctgctgggtcctgcccagccatttgcattttataaaggtctttggcagcggccaaggccttctcattatgtggtgtttttccacttcgggatgaaccggagtggtttgtgcagccacctgatagctctttgcaccagcttctgcatgggagactttgagcaggccaggagccaaggggaccctcctaggccttccgagcacctagcactggcccttttcttccttggggcttccttctggaggaggtttccctgggtttggagtcctccctcctgctgggggtgggggcgtggttgctggtggcctggagtgagctgcctgctgtggcctccagcactccccagctgaacagcgagtcctttgtgaaattcctgaggcaggagggggcagctgtgcagagccagctctcagagtggccgacagggagggtgttgtggtgtatcatcaagtgataaggccttcggaaaggctgtggagaggaaggaaaacacattcctgactgtggtgtgtttgcccttgagggccctgtgtttggggaagtagagaagcttggctgcattgttgtggggtgggagttagccctgtgctggggggagctagtgagagatgaattcagctgacctgggatcaaattccagcttggatgcctttaattaataacatattagaccatttaatcaatttaacacacgtttttggagtgcctactatgtgcaggcaggtaaatgatcttcaaggtgtctccatcaggtggaaagtcaaaaattcagaactgggcaatgactggaggggaggatgggattctcaggtgaagggtgtgagacccgagttgtgttttggacgatgttaaaggaggagatcagcttccagtagtgaagagcatctgatgctttggtgaggaggattttcttttaagtccttgaatgcagaagggctcctttggaagattttatgcaagagaatgccatggaaagattatattatagtggatcactctggaagtgtcatgcggaatgaatggagaggtaggaagcggggttgggagagcaaacgtaaatctaaggtccaattgggaggctctgttggaatgagctggcgagagatgatgagggcctgatttaaggaacgattgtattgaaggcactaaggtattggcattcagcgaatgtacatgagtctcaactttctggtttacatctgaatggacagagaagaggacatgatctgagcatcagggagttgatgtttgtcttggacattgcattaatatagttaggctaggcttccagaaactctgaaatcccagtggcataatgtccagtttgtttctctctcacagagtcagctgtgaagatggtggctgtaacggacagcttcttccaggcagtgactcagggatccaggctgtctcttgaggatatctggggggttatgtatttgccctgaaatacttcgccctggtgatgtcatgtgtgatttcctcccgcagacctttagtcagagctagacactgtgaagggctaggaattgtgaaaagattgtgtgaatgaacaggaaggttaaatttgaggtgccataggccatgcataaagaacagtccagatggcacctgggaccggatgcctggacaccatccgagcaggagattaatggaattgaaaatcagcaacgtaggagacagaagccttcaggatgtctgggatcctatagggagggtgtgttgtttgaagagcaggggctgaaggtggaatcttggggagctcatgacaggctggcagaggtactgaatttctccaagtctcagtttcctcatctgcgagatgagcctgatatttcctataaagggatagtgagtgcactgggtgctgctgggcaggcagtggctcctcataggggtggttcccttccccctgcattgtgttggactgaaccttgtgtgttctgtttgtcaggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctggtgagtcctggcgacttgttcacacttcacattctgtctttcttcagaccagactgacctgttaggcgaaaacaacatggtggccaagagcagccataaaactgggagacccttgttcaccaaactaggttggctacatgagtacagggaattgtcattctagcaccattttgggaggggattctggataaaaacctgggccatgttgaaagtcaagccaagaagggagaggaggcgtcaaaaggactccacttgggttggtgtgatgccattcatgagacagcccaccaaataggtgtaggcgcacagcatcttgacgaagctgcagcaccacgttatgcattttctttgcagtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtaaggagcgatggcctcactccttggtggctctcagccttccttgtcctcctcatctgggggccatggggctcatggaggccttgaaatgacagacagtggaggacatcctagaagccagtacttatatgacaatatttctgagggttggaaatctaagacctcttctaataggtcatttcttcctaaatattacatatatatttctttttaaaacaatttttaaatttttttcagacaaggtcttgctctgtcaccaggctggagtgcagtggtacaatcatagctcactgtagcctcaaactcctgggctcaggtgatcctcccatctcagtctcctgagtagctaggaccacaggctcagaccaccatgcctggctaattttttttttattttttgtggagatgggggtctcactatgttgcccaggctggtctcgagttcccgggtttaagcaatgcctcggcctcccaaagtgctgggattacaggtgtgagccaccacgcctggcttacctgtatatttcttatcattatcatcaatggaacagtaaagactgaaaacctacacagctttagatgtgactctgggtcagtcaggaacaaacttccttagcaaccaggtgacttactcagttaatcctcgtctactcttggaaatgggctcaatttccttaaaagtgtcttttagggctctctggacttagcatgtcttctactgccagcttccagtaggcctgctatgaacatacactgacctttagaggatctttgggctttttcattttaatgttttaaaatatattaacagaataggttttctgttttttagtgaattgtttagattatatgaagaatatatccttatttccagaagaataaggaagtaaataaaagtcactgtgtttcagatataaccacaattaacattttggcaaatgtctttccattttttgctactacacaggcacacacatgtatatgtgacatgcgtgagtgtgtaaataatattggcatcatacagctgggcccactcccaggttcatgcctataatcccagcattttgggaggccgaggtgggtgaattatttgagcccaggagttcaagaccagtctggcaacatggcaaaaccctgtctctactaaaaatacaaaaattagtgaggcatggtggcaggtgcctgtagtcccagctactcggtgtgggggaggcaggaggatcacctgagccttgggaggttgaggctgcagtgagccatgactgggccactgaactccagactgggggacacagtgagaccctgtttcaaaaaataataataataataatattggcatcatacatactattttgtagtcttttttaaaaaaaattttatcatggaaatatctccacctgcttaaatatacttgaaaaagttgatttataataacagactcttccatgtgagtgctaaactgggactcatttatttatttatttatttgagatggagtctcactctggagtgcagtggtgcgatctcagctcactgcaacctccgtctcccgggttcaagcgattctcctgcctcagccccctgagtagctgagattacaggcgtgtgccaccacacccagctgatttttgtatttttagtagagacagggtttcaccatattggccaggctggtctcaaactcctgacctcaggtgatccacctgccttgacctcccaaagtgctggcattacagatgtgagccaccatgcctggccaggactcacttataattctttttttttggctgggggagacagtttcactctttccccccaggctggagtgcaatggcgtgatcttggctcactgcaacgtccgcctcccgggttcacgcaattctcttgcttcagcctcctgagtagctgggattacaggtgcctgccaccatgcccggctaattttggtatttttagtagagacggggttttgccatgttggccaagctggtctcaaactcctgacctcaggtgatccacccacctcagcctcccaaagtgctgggattacaggtgtgagccaccacgcccagccacatttatgtctttggttgaacatttatgttgtttctggtttttttttttttttaacttgaatgacatttttataatagacacattcttgattatgtttgtaggagaaatttctacaagtggcattgctgggtcaaaggatgcatatatttttaacatttttggtacatattgtcaaagttccttccagaaagtttgtactgctttatacgccaccaccaatatatgtcattccccagtgtcttctaccacctgggtgtcatcagcaaagatccattgtttgctgatttgataggtgaattttgtgtcttattgttttacatttaatttattcaattactgattagagtgaaaattttttcctatgcttagtggccatttgtacttttttctccctcttaataccagcttatttcctttgaccagttttttactggatttagagtgggtttgggaggggaagcacttgaggaaatgtgattggcacctaaaaccagatgtggggcggagacttctaggttggctagactagaagatgacatctggccaggcatggtggctcatgcctgaaatcccagcactttgggagagcgaggtgggagggttgcttgagcccaggacttcgagcccagctgggcaacatagtgagatctgtctcttaaaaaaaaattagcctggtatggtggtgcatgcctgtcttcccagctactcaagaggctgaaagaggaggattgcttgagcctgagaggccgaggctgcagtgagctgtgatcactctactgcactctagcctcaatgacagcaagaccctgtctcaaaaaaaagattaaaaaaaaaaaggaagcctagatctgtggctgtattttgttgaaaaggacagccaattgggccaaatgatatttcctaaagagggattgccacccctgcaaattaaacgaatttttttttgttttgaaataattatagattaagaagcagttgcaaagatagtacagagagaggtcccgggtacccttcacccagtttccctcatggttacatcttatataaatgtagaacaatatcaaaaccaggacactgacagtgtcacaatgtgtgggtatagctctaggctgtgtggccacctgtggagtcatgtgaccatcaccacaatcaagatgcaggtctagtccagcatttcagagaccaacctcttgctgctcctcccctccaccctccctaaccctggaagaacccatctagcccctcatctgttctccatctctaccattttgttatttggagaatgttatagaaatggagtcatacagtgtgtgacctttgagacggtttgtgtttcacttggcacaacgctcttgacatccatctaagctgtcgtgtgtatcaatagtttgttattgaaaagtaactttttaactcgtttctgctgtgtgcctcctgtgcacacctatgctgtctccctcaggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagcgtaagacctgttaactgtgcagaccccatccaaacgaattacagtcacagagacacagacggagggagagccccagggtttctaaaaagaacttgctgtgatgggaatgcgctcgactgaggatgttatgatttgcaatttgctgggaaaagaatagttatttcattttctttagtgaggtcaataagattgttactctcataatcattttggaataccacagcctctctatctatagacctttagagcctctaaagtgatgtcaggatgtgcaaagcttccagaagtcaggcaccgctccattttcataggttggcacagcacttctcatggcagtacttggtgcaagggacctcaatgaagcagtgagatgtcctctcctgagatgcccactggggactttgatcctcttaagccattgttttctcaggccagtatccatgcagaaaactggatgacagccattcttattatcttaaaggaattgattgactgacttctccctaacagaagtaccccccagccatttgattgttgttttaggatctgccgctttgggtatctcttccctctgggtctgggctttagagcttagagatgtcctctcttgttaacaggacccagggcaagtctgttaatgtcttacgctcctcagctgagagtgaggggttcagacgaggtctccaagtgtcctgtgattctgtgaggtcagcagacattaagcagagttgttagacactgccgattcctcacaagcaacatggtataggcagaaaaactgaaggaatatgcccagagggagagctttggaaaagaaatgggcctcgggcagaagagtttcgtgtcaggaactcatttgaatcttgaagacagctcaggccagcaagcactgacacctcccccacacaccacgacagcttagggcaggtttctggcatttctccgggacaaccctgggactttgccctgtcccagtcctctctcatttgcacacacagaggtgtttgggctgcaatgggctcaggctcagctctggcttctgccacctgtgaggaccagggtggtgggtgtttctcagaagactgttcaagtctgtgtttaaagctgtctttctccctctcccaccaccactcactggctcagcctggcagcgcagccttatgatcgcgccccttacagcccagatcatgacttcttgggtgtcctgactggctattttatggtcagggatcctagggccctgccccatgaacctccctattcatgtgcctgtaacttcacattctcattgactctttcatttgaccttctcaataaagggactggtattattatcccaatttgggaaaataaataaacggaggcttagagagcttaagtgaccagtctaatgttacatagcgattttgcggttgagccagaattagaacccaaaattgttcaggactcttccctgccagactgcatatgcagcctcttggtcaggcttagacggggaaaatgcttcccctctcttgcaaggttgcttcccccagaggtgctataaatggctggctgggctcgttatttaagacacaaatgacctagctggggaacttgcatttggagttcttaacctagaagacgagacagtgggaaggagag

SEQ ID NO: 111 - DNA, 143526 bp, Homo sapiens
gcgccaccagggcagcagccgccgcagccgccgccgctgggcagaggagccggagacgcgagcgggcgaggtggcggcggcggcggagcgggagcgggtaccgggcgcgggcagagcgcggcggcgcgggtaggctccggcggcggggcgggcgcctgcgcggcgggccgtcccgggcgggcggcggttaaggcggcggttgaggcggttggcggagccggcccgggccccgcattgtttgttgtgcgtccttagcagcggcggcggcggtggcggccgaggcggagagcagggagcaatcccggccccgcggctccggcattgtggccgccgccgccgccgctgcggtgccccggccgcttcgggcaagggcagcgggcagccttcctcaccttcgcggggacggggtcccggccgatcaggggagggcgtgggcagggttgggggacgcggtgccgggaggtcttccgggacggagggctcggggctcggggcaggtgttggaggacattgggggcaggagctggggagaggcttcggggggcaggcggaaggtgtgggcagatttgggggtaaataggggtgcagagggatccggcccaatggaggaggagagccttcaggcaggtttggggggccccctgggccaggcgagtgcgagatggaggacattccgtccggtgggggggggcactatattgtggggttcaagagggaatgagggggcttttggggagggcagggacgagtggggtgggaatggagggagaagactggggactcgagcaggactggaaggagcgctgcgtgccaggggcagggagtggggcgggtattaggaaggccaccgggacgcccgtgaaggggaacgatggaggagggggtcggggcagggggaagtgagggcaggcagggagcgcctgaaagggagggaggggagcagggtgcctaggcttctggggtgatagggaaatgaagggtaggcccaggggctccaggagacctgcgaggggtgtgagggagtgtgtggccaggtgtataggggagcctgcagggaggcgggagggggttgacatgtaaggataaaaaggcaggtatctggtgctcagggaagaggagtatggggtggaagggggaagttcattggggcagagacttagtttgagggcttgcagagagaggtggggacagtaggagaagggtgatggggatggagagcaggaggtgtgtggggcatttaaaggatagcgggagaagtgcgtgaaatggagggtgtttatgcaggaagtatggaagaaggtgggatcagcaagagagggaattttgaggtaggacggagggtgaggggttcttggcaagtgttggaggacgttaggggcaggagctgggggagagggacaggtgtggggtggcgtggagtgtgtgaggtggagggcaaaagggggtggggaaagggaagtgttcttggagtggcaggtaaagtgtggggacaaatggaaggaaagatttctgaggcgggaagtgtggagcggttggggaggaggaaggtggaggggagggtgagaacgaaatcagtagagggggacaacgggatagactggaggggaaggtggacaggtctggagtacagtaggtggagggagggaagcacaggtttggggcactgaattttgtgctgtagggagaagggaggtagggagaaagaaggaaggtagacaggctattttggggtagaggatgtagaagaatgcttaatacctatagtggagtaagggaagggcaaggcagaggtgtatgtggacatgtctgtaactagaaaggcataggtgatggattggagtggtggtggtggtggtgggggaaataggatgcccaggtttagggcaggaaatgactgcttaagttggagagagctaggaacacaggttgcttaagagagtatggaagatccaaggagtggaagtatggggagagattggaacactttgagtttgagagatgaaaggggccaagatttttaggtcactgagagtctaaggaagatcaggcagagtgcagaagttggaaaaataactaaatggagaggattaaattccatactgagagaaactggagattgaggggtggggggacctggatcctggaatgatgttaatggaaagtggaggacattaaactcagtgtcatatctgaaagttcatactcctagggtcagagagatcgttgagcctgcttttaattccagaacccagtaaatgaggaagggggaaggggtaagggagagctgagtgcacatccccaaatttgggagaggtgtgtagtgggtatcatcctagcatattggtttgacgagtggacagaagggccacacagggtcacgaggagcgcaccaagagtgaatggaaatgggattgcagcaggtgcagggcagatgtctttgtgaaactggaagagaccaggcccagtggccagtagcattcaagggctatgcataagagaggaagaaagggataccttggtgcagtgtctcagataccctggtgctttctgggtaatgggtcagtattcaggcagcatggggtgatgtaatatctgagtcccatgctataggcagacagaagtaatgtacacctagctcctaaaagtggcagaattggagctttctgactcttaacactctttcaaggcgtgaataactgatctggattgttgactttttctcccaaatggttcaggtaaaatttagttggaggcttttggattctctggtattttgatttgagttgggaagtgtaatgttagctttattgaggaaagacacttatgggttgggcggacatatggccttcagcttgccaaacacatgggaagtaacctttaggggtttgaacacagacatttatttcagtgcaagtctcattcactgttctgtggcttgtgttagattcttaggggtttgaaaggattaagcaaactactttgagactgcttcagtaagcaaggtttcctagaatcttggaaaacgatttcccttttgacagttgaaaattaagtcttgtcagattttgctaagaaataaatttcatcatgttgcagaaataacttcaattatcactctgtgggcttcacgtaatgtgtagtgtggtacctagtatgatttcaaataaaaggttcgctttggtagcttgggagctttctgggttgattagttttcttcttttgtcgatttaggaagtatcttaatgcagccattgtatgttcgaataataagtttgagtggaagtgggaatcttgcctaaacataatgagggcggagcagaacaccaaattttaagtaatcggaatccgttaatataaatattaaaaaaaaaacctggaagcaaatgattcgtaaaatccaaatttgaagtgtgtcatggcagcaaaagaatgctctgaaggcattactgtaagattttatttttggagggaaagatttttagagtataatgtcccttcgattgaaactctgagtattttgagatttgatatatgtatacaatataatatagggagcatgtctgacctcatttgctttttggcagagaatttgagcagtaggatataagatgaatagagtgagctttgaaagttctctccaacatagccattgtttcctccttatatttcttaagtccattgtgttcattttattgacttggggtgcgcactactttcttgctcagaatactcaattctggtatagtgttcggattatatgtattgttcagtgaaattctatgaattgggacaatttgtaggcactttagatatcctaagtttacgaaccaaggaaagcaggttatttaggctttgtaggctgaataattgggttctggttttattttcgctggtgacttgctggacaagatatttaatccctttgtgctggtttcttctctagaaatctgactctatccatctcccatgagaatcaaggtggtttatataaaacaagtttaagtctttcgggaagactggagctacgtaaatacggggatagatgttacttagtttcttttttctcccctgtggtttttagactggtcaaatgttagtacttcgtaatttaccattaggtggattaatttgttgtgtgaaagttggatagagatgaaacttatgtgaaagagatgtctgcaaattgaagtttgttcattctttgctgtctgcttacctttccaatttctcagctaagtgttagtgctggtttgaattcttcagcctgagcagaagcttgtgagagacattgggttctagctatagcccaagattgtttctaagcaggaatttccagagacagaggccttctttggctcagtgaattcaattctttttttgggggtggggaatgcagtggcgctctgtcgccaggctggagtgcagtagcacaatctcggctcactgcaaactccgcctcccgggttcaagtgattctcctgccccagcctcccgagtagctaggactacaggtgcccgccaccacgcccagctaattttttgtatttttagtagaggcggggtttcaccatgttggccaggacggtctcgatctcttgaccttgtgatccacccgcctcggcctcccaaagtgctgggattacaggcgtgagccatcgcgcccagccaaattcaattcttatatcagaaataataaacataatacattttcctatgtattttgcagaaaattgattactgactgagtgactggaatagaaaaatagagctatcccttctgctagtgacgtcaagcttccttgttctgatttactgaatactccttcctttttcaagttttagttatcaaataattacccatcatttggtatttccgtatgctttgacaggtaatgctctatttgagggggaatgatttttaaatgctttcttaatgttgtgtttggtttacaagttgtaaagagccttccaggtgttggtcatgattgacacagcaaaaatgtaaatagcaaattgccttttttttttttttttttttttgagacagggtcttgctctgtggcccaggctggagtgtggtggtgtgatcatagctcattgtaaccttgaactccagagctcaagtgatcctcccgccttagcatctcgagtagctgggactacaggcatgtgccaccacatctggctattttttttacttttagtagagaccaggtctcaaggtcttgctgtgttgcccaggctgatcttggacttctgggctcaagcgatcctcctgtctcagcataggttgctttattacacattaatttgccttgagcttggtgatacccagctccgatagtgatctttctttgctacgtgatctactctaatagtttactctcttaggtaacatgtttggacactgttacccattttactgcttttctgttttcatttgttttgcataggtccttttattggaagattggttgtttttcaaaattcgtttagctacagaaactgtttctgactagtaattctaagaggctagtgaatcgagtctaattttagaaaactttattgagagatgtaagtttaatgtatgtgtcagttaaaatagaagtaaagtaaataaggccagattaatggtgatgtagataattaggtgatttgagcctgaaagttgtgttaatctttaatatagcttttagttcttgcattgaatagtgaggtgaccaagtgacctgatttgtaattttcatgtctaatttgaattatttcttgtcctaagggtccattaagtgcatcctatttgagaagtatagtgcctgcctcacaacagactctccacatgtgcatgtggctgaatgaagcagtcctaaattttatttggtattcagattctcttaacttctgacataactagcgctgtgtaaaacatctgctttctttagttaactttagcataacttgaaagggtacagttgattacatcaataataaaatcacagccttgcattgtgtgacttcatggttcatttccacttgaaaagtgagaattctgcagcaggttgtgtaataaattctgaggcatttctgggtcatgggtaagatgtttcttactgcacctgcagaatttcctgttctttgcagttttccaggtgccaggatttttcacaatatcctattgggcagatcagcattttgtttatgattttaatttaaccaatatagtgctgttgacatatagtgactagtaattgtcctaaagggctctgtctctatttttttcttaccatgcttgttttagtatgccattattaagcccgttttgccagttaattcagcaagcataaattgacatttaggctcaaaggtgtgttttgtaccagacctaagatttcttagtatgcttcaataatactggtttgagtaaagaatagatccttctctagatatattggcccttaatatgaaaatggagtttgtaactggttacttatgtttagtcagcctaaatggaaataagtacaatttaagacagctaggtagtgatctaataaataagtggttggtttgtaaaagttaagatggaggcagttcatttttaagatgtttatagttcaagtaaatctgaaactcattaaacattgcatctaatcataggcttctgtatagcttaggcaacctaaattttaacctaatgaagttttggatactgggtaactcttgagttaaataattctgaataactcacaaagatagtgaactagaggggaaaagtgttgcagttttgatgattaaaagctggagagaataaaatctcaagactttggtgtgaatattttcggttgtttttgaagtaagctgtgaatgagcttataatgccagggttagcatagaagaacagatagcaaacatcgtgatgaagcttttaaaaatacggtatcttaaaaataagtactaactgtgatttttttgttctgccagttttgtggtaaatgttttagaactatacaacattgacttttgaagttggtcagtattattgttcctttatttctagagctcagagttcatatacctgaactttggtccctgtgatggctgtataatgtaggtgaacaatggaatattacatttagggaaatggaggcacaaggagttcactttagagcagagattggcagactgtcagatcactgagaagttgtatatcaaattcatgttagtttctgaatttggcaaggaagattgatggctgagcaaatttgaaatctgcctcttttaatcaagctgttgagtacacaagtcttttcatggactgaatgggataatgcttagtcctcccaggaagctcagagtcccaggattatgagatagtaatgaatctgagaaaaagtactggcactgggtggagtatgggtatgcacacagtgcctggtgtgcaaccttaattgctgtattagaagaacgttattggtactataagatttagctatgagatctgatcctatttactagttgtagatctctctccttaagtctgaaataggaataatactcctaatttacagagttatattgaagattaaagaagataagaaaattgtttggaagctataaagcatattttctttttttggaagtgagcagaaattaagggcaggctttgaagtgatagactcaaaaggacctggatttttatttttcatttttcatcatggacatttcagatgtatatgagtggaaacagtacagtaaatttccatatagccatcaatcagcttcaccaattatcagcattttgctgctcagccctcactcacaattgcattttactttttttttggtagggaatttacagtcaatcttagacatcatatactttgatccataaatacttcagtatatatttctgactgataagaaccaaaaaaaccacgtaaccacaacattattttaaccccctaaattaacaataattccttatcttctgcacagaaggacgtggatttaaaacatacctcttagaaagtacttaccagctttgtgagttaagcatattatttactctctctgagcttctggttccttatctgtaacataaagataatgcctcatgaagttattttgtgcttaaatgaaataacatgtaaaatatcttaacacaaaggttcttggcaagtggtccagcctctcttctgagcctcctgtgacatgtgaattagaattatgggctgctttcctcccttctttagtatcacaaagagtaacagtactctggaattattgcccactagcctagtgaaatttttcttcattgggttatttgactcttctagtgaaattctattaacagctgaaatgatgtctctctctctcctgcaacatcattattcccctgtctactggctcattccagttggcacacacatactatatttcatctattttttttaaacaaccatttcttgaccacagtgccttttttagctgctacccaatttctctgctcccctttacagcaaaacttcttgaaaaagtttcttctgttcatctttagttctcatgttctctccggaaaccactctagtgagatttttaaccccaccactctactgaaaactgtacctgtcaagactacgaagtttatttcttatttgacctattagctgtgtttggcacaaataggtgcttccttttgtgaaacactttctgctttggtttctaggataccagattgctggtttttctacctacttggcttcatagtctcttttttggttcttccttattacacctacctcttaatattggactgcctcgtgggatctctgttgttgttgttgttgttgttgttgttttgtgagacagagtttcactcttgttgcccaggctggagtgcaatggcgtgatctcggcttaccgcaacctctgctgcccgggttcaagcaattctcctgcctcagcctcctcagtatctgggattacaggcatgcgccaccacgcccagctaattttttgtattttttagtagagacggggtttctccatgttggtcaggctggtctcgaactccggacctcaggtgatccacccgcctcggcctcccaaagtgctgggattacaggcgtgagccattgcgcctggctgactctcaaatttttatctctagcctggaactccaggcttgtgtatgctactgcctacctgacatctcttatatcttctatccttatttcaaattgaacttaccctgtctcctcttccccgtgtcccttttataatcttccatatctcagtaaatagcagcttcatctttccattttctcaggtcaaaacctggagacattcttgactcttctcacccattacatctgatcccttaggaaatcttagcagctctgtttaaaatatatccagaatctgaccacttctcatcacttgcactggcataagcctacattaccttctccaaattattgcagtaatccccccccctttttttttttttgccctttcctccttatagtctattcttaatacagtaacaagaatgatcctttaaaaaagataagtcagattttgtcttctctggtcaaaaccctctagtgattgcccatcttgctcagagtaaaacacaaagtcctatcaagtccttctgtgatcgaatgccttctttgctgtctgacctcatcatctcttactcttctttttgcttactccattctggccacaatggtcttcttacggattctttttttttttttttttttgagacggagtctcgctctgtcacccaggctggagtgcagtggcccgatcttggctcactgcaagctctgcctccggggttcacaccattctgcctcagcctcctgagtagctgggacgacaggcgcccgccaccatgcctggctaatttttttgtatttttaatagagacagggtttcactgtgttagccaggatggtctcgatttcctgacctcgtgatccgcccgccttggcctcccaaagtgctgggattacaggcgtgagccaccacgcctggccttcttgcagattctttaacataccaggcatatttctgtctcaggtcctttgcacttgttgtttaccctgtccagaatgcagtttttcagacatttgcttggctccatcttgtctctcattttcagtgaggccttctcttaccaccctattaaaatggcagctcctccatttctggttctccttacccaacctttcccatcctctttttctccataccactttaaaccatttcacttatgatatattttgcttatattgtttattgcctttttttctccacctgatataagctccatgaaagcaaggatttttgttggttttgttttctgtagatttcaagcacctagtagaacagtgcctggcatttagtaggaacccgagtatttgaatgaactattttattaattgtagtctatacttggaaaaggtttaatttttttaaagttttaatttcagtttttctttggaatattatgcgccttgaagtcgtctttttgctgtatttctgtttttcttcatgagtatccttattaatttattcatcttgagtccttattaagcactatgctggttgcatggggatatacaaagatatagatataataattctatacaattttgtaaataaatatatatacataaattatgcataaatatgtatcttttgtataagttatatatatatacaattattattatttttttgagacagggtcttgttctgttgcccaggctggagtgcagtggtgtgatcacggctcactgcagcctcaacctcctaggctcaaccagtcctcccattcagtctgctgagtagctaggactacagacatgtgccaccatgcctggctaattaaaaacaaattattttgtagagacaagtcttgctgtgttgcccaggttggtcttgaactgccgggctcaagccatcctcctgcctgggtatcccaaagccctgggattacaggcatgagccagtgtgcccagccagagataaagtattcatggactctgacttttatacttttatgagcttacagtctattaggggagttgatagtatgggatgtgggtgtgtgtgtctgtgtgtgtgtgtgtgtgtgtttgtgtgttttaaaaaggtaagtacctaagagagagtgatccagaattcagaagaacaagaaattatttctagtggaggggaataatagagcgatttcagcgagggtgtgtgtagtgtgtagtatcagccatggaaaacaaatagaactggattatgagaaaaatggaaaagagaattccatatggagggaatagcattagcaaaataagaatgctcaagatttgtatggaaaataagtggttcattttgttgacgatacgatatatgaaaggaattagcagagcgtaagtttggagaggaatgttggagctactgatagaaggatttgaatgcaggaataaggaattcaagccttactctgtttgaaagccccagtgataaaggacattatcaggactatctttatgagtttgacaatgttacgtggaaagacagactgaaataaatacgactggttctcgaataatgtttcattcgatgttgtttcattataatgttgaccaaaaaaaaaaaaaaaagattcctggctggagccactgtctacatggagttttcacgttctccccatgtctgtgtgggttttctctgggtgctctggtttcctccatatctgaaggatgcgcagtttaggttaattggtctgtctaaatggtcccaggatgagtgagtgagggtgtgtgtgtgagtgtgcgctgtgacggaatggtgttctgtctaggattggtgcccaccttgtgccctgagttgttgggataggctctggccatctgcattcttgaactggaataattaagtagtcatcttgttttttgttaacttttcttacatatatatatagctcacatttatttcagtgtttaatattacaagcgttttggtttttatttagaagtttggtgatgtttttgtgacaagaagaacttaaccgttgtatatatcaattagcctctgataaattggttttattatatgttatttcctctaacgtcgcagtttccaagaacctatcaagtacattaaatgacaacttactgtacactgattaaaatgctattgtaataatttggggggaaagcaataaaggtagtggaaataggtataggtagtggaagtaggtatatatataatctcagcattttgggacaccaaggcggaggatcagttgagctcaggagttcgagaccaacctggacaacataatgagaccacatctttatagaaacaaagtagctgggtgtggtggtgcttgcctgtagtctcagttacttgggagcctgaggttggaggattgcttgaacccaagaggttaaagccgtagtgagctatgatcatgccactgcactccactctaggcaacagagcaagactagcaaaaaaaaaaaaaaaaaaaaaaaaaaagaaagaaaggatgtcttggaactgttgcaacttggtaactactgaatgtgagggctgagcaacaagcctgacaactacagggtttcaagcctacttgattggcagcctggggttccctcagtataagcagggagcccaagagaagtgagatcaggaggaaaatttgtttggttttggtataacgtttgcaggtgtgatggttatatacaggtgatgatgattctgataaaaagaaaattagtattctctttagaaaggatgtgcatctgttgctttcgtgccttcattttgatatagctaactcccagaaagagaagtaagactcagttgctggatctattgctggcatcagaatctagataattgatttggaaaactttgacacagtacctgaatttttcttttcatctgtaagtagctcaacccttttcactaagtttgttagataagttgctctggttgtaaaaacactatgtattctcagtagcttgatacaacttacaggttatcctttgaaatctcctttactgctgcttcattggttatggatatctaagtagtgcctttcttacgtctttgaagaaaacagatgagcagttgagtgttcccaactagtaaccttgatcaccttgagatgaaggcagtgtttatttgaattaaaaggtttgcatgcttttgccataccatactcctgtttttccccttaggacatagagccacattggaagaggacaagccttttaacctaattagtggtagttaagatgttagttgccaaaacatttctttaacagcctacatttaacaaaataccagaagatatcagaggatgtagctttctatgccaggcagattcaagaacaacagtgtaaggttcttttagatttatagcattttcagagccctgtagcaggaggtgtttttaacccaaagatgatagacaaaaaaattatttgcaaaatgatattgataattgtgtacactttttatttataggctaatgatgtatgatatttatatatttaatgcattttttaatagttgaaaaaagacatgatgagtttgttgaaaacttgcaattcaccggctacgtttagaagggtgaccttgagcttatcacattagtcgtctctttattaagtcttttttctttgcccttagataatattgtcagtgaacattattttggcactgtcattatagagccttttgttttccattaaataggagtcagtaggacccaactgtcctgaaatgagaaaattttcctatttaggataatttatatttttcacctcaccggaggtgtgatggcttttagtttttcagatttggagtatattgtaaatttttttaaatcttggcaattttatttcacatgattggtttgctaagaatataaagttttacccttgtgagaaacctgcgagatccttttagtcctgctttgttccagagaggttaaggcactagttgaaaatcacacacccaactagtggcagagttggggcaagaggtagatttcttttttgttctttctttttttttttttttttttttttgagacggagtctcacgtgatcaggctggagtgcagtggcgcgatctgggttcactgcaggctccgcctcccgggttcatgccattcttctgcctcagcctcccgaggagctgggactacaggtgcccgccaccacgcccggctaagtttttgtgtttttagtagagatggggttttactgtgttagccagactggtctcgatctcctgactggcaagaggtagatttcttgcccttcagtcttgggctgctttcaccatgtcaggctgctgtttagaaatgtgtaccaggaaatcttaaatgaacgtagctgagttggtcactaaccagcttagttggttggtcattattgggtgttattacacctaataatgttcaattggaataattaagattttttccccctcgttccttctgaaaacgtttttttaaaaggctaaccattttaaactgaacgattcagtttaaatgaaacattcacaatgttgagcaaccaccactttatgtagttccaaaacattttcatcacttcaaaataaaaccccttacccattatgcagtttgaaaagtttttaagcaattagaataaaaatctttgctgtgacaagtaaggtcgactagggcaagtttgtattacaggtcactcctagtgctttgttgcctgcttccgatttgccagtgagaaacagagtatccttcttatgctatttaatagtgatattacaaacagcagcaacatcaaaaaagaatgtgtcaggcacataatgaataataatgctgatagcaggcatgcgttgtgcatattattgttaatcttcacactagcctttcaaagtggttactgtatttctgatgagaaaatgaagccttgttcagtaactctagaatcacttagctgataagtggtcaatctgggattcaaatccatatctatttggcttgaaaagttgggtgttcttgtcactaaatttgggaatgagcaggcaaaaagaaacacatggaaggaatcatctcgtttgagggattcagtactctcttagcagtacagtgtgtaagggaaggggatttgagtttgttagtcctgttggtgtttgttagttgccactttatcctgtcccactatgatttgtatgcacaggaggaaaaacaaaataggaaataatctttggaactctttatggacattatcatgaacaattagaagaaatggcaatgtagcttctgacatttgttcttagaaattatctgtttctttttttcttctcttttaatgagtctttatatgattttattttaaattcataaattgatttgcttgagtggtttagtctgagcagtattggaacttgattgatttcccattttaagatccttttaaaaagtggtgattcaattccagtgaagcataactcaaattgtgtgtattgaagacttttgtaattacatttttgcccctattaaaaaactttattttagcttttttaaagtttgaaagaacttttggtaggccagttgtcagtcattcctttgaaagcccctagtaagtcacctcataaaccttgtcacttttctactgtgttttggcccgaatcatgttacttcccttcagtaataggccctggggtaatatgttaaaatatgctggctttgggtaaaaaggatggtatcatgtaaaatacagctctctggctactttggacaaagagatttttttaaggttatgtgagcataacaagaatataaggtatagcaatagcagccatctacaaatgtcttgagtgtgtgtattgatagttatccaaagaagtatagatttttgacagtgaccttgtgactttcgctaatatctaaatactaggtacttccataaatggattttaagcttttaaaaacttttatttaaaagttttaaaatgcccttgtagcttggctcaaatattacacattgcttttctgttttgacctagtggtgacatttcattctctctgaaaccagcagaaatgtactgtgaagagtacaggctctggagttggtcagatttgttttcaagtctttgtcacttactagctgtaagacctttcctcttttaaaatgaatatcttatgttacagctctgtagcgttagaggtgatgtctctaaagggctcagcacagtatctggcacatagtgaattgtgttcaaatggtccgtgttataggaagaagtctaaattttgatagcctagccaacatcacggtgcaaatacaggaaaacctcatctgtatactgtcctgcaatcagcacgtttcttcttggatttgtgttttgtttgtgtgttgaagtgccatgtgtcagttttcaccatttcctgcaacttttcctttttctcagaaatgcctggcaaataccttcattgggtattgtataattgagctaaaaaaaaaaaaatagatggtgctatgcaagctaatgatgagggatttgctcccttatagcaatccctttcagttaggtattcctgtgtagcatgttaacaggtgcttaccacccttagagatgtcagctggccgaatgcccaagcttatgccaaagaagggagggagcttttgttgtctggaatgaaaagtatacaatgcctactaaatgcttatagtgtatttcatgatgattgttaatgttaaagcatgaaaagctatatcttagcctaataattttactcattacttccccattatttgcattgtttctcttgttctgtttagaaagacatacaaaggacttttacactgtaactgtaaggttgaggttgtgatgaattgcaatctaagaatattagctatggaggggactttggagatcagctatactaaccctcttatcttgtacatgaaaaagctggctgagagaagttgtgactcactcagggacatagaaagtaagtgacaggtttgatttccaatccggtattatgaaggttacctggtaaagtggagagagcactggactttggagtcacacaggcctgattttgagtcctgattccaccatgtattaactgtgtgacctttggcaagtaaatctgagttagtttcctgctttgtgttactttgtggggtcttgaggggtcttgaagattatgggataatgtaagtatagcacagagcctgacatttgcgatgggctcagtaagtgccgtccgttctcttgtactatttttcttctccttctccttcttcttcttctttgagagagggagagagaaaagaaagaaagaaaagaaaagaaaagaaggaaagaaagaaaaaagaaaagaaagaaacagagacagagaaagaaacagagacagacagagaggttctctctctccactgcccaggctggagtgcagtggtacgatcatggctcactgcagcctcgaactcctagagttcaagtggtctgcctgcctcagcctcacaagtagttaggattacaggattaccagacctggctaattaaaaaaaaattttttgttttttgtttttttgtagaaatggggtctcgttttgtcaccctggtcttgaactcttggctacaagccatcctcctgcttcagcctccctaagtgttgggattataggtgtgagccactgtagccagccctgctttcctttaaaacagatcatatagctaagtgattactcgttatgaaatgggaatcaaagaatggttgatgtttttgccaaagccttttgctgaaaatctgttgttcattggaggaggattgctgattgcaaaatgagtgcaaaacatttgtcaagagcttaagtgaccactgctccaagttgtacagtgttgacatggttcattcctgagaaatggctgcatttccctagtgaaatggatagaaaacctagcattgggaacaccaaatcaacctacatatagttaggccagcagttctcaaaaaaaacttttttttttaactatagacccttttacaatcttaaacattatcgaggaccccaacgatctcttgtttatgtgagttgtatctgttgatatttatcggaaattatatctgataaaaatttaaatatttatttaaaaatgctaataaactattatatgttaacacaagacaaaagaaaattagtgagaagactagcattgttttacatttttgtaattctcactaatgcctaacttactagaagacagctgggttcagatagctgcttctgcattgtctgttttaatattcttgatgaagtatatgaagaagaaaatctgccttcacacagatatgtagctggaaaagggagaaatattttaatagctttttcagataattttggatattcttctttgatactacaccaaaacttgacaaatggtagtatcctgatagaatctgaaaccagatcagtgaacattttgtgtcctgttacattaaaatccattggtctttgcattttgattggatcttttatctatacatggttttataacattatgcattggccattggaaaatattgattcattgaattatcttgatcttccaaatgtgacctatttcatgttccgtcttcaacgttatatagcctctgggaaactctgtactctggaaagaatgagagtggaaaagaaacatagtgccttcatactacttggaaaatagttttggccatgcagacccctgaaaaggtcttgaggacctccaggggttcctaaaccacacttgcagaactgcaaagttagaaaaattggtaagctaaaaggagtgactcggttgctttatatttttttaattaaaaataatttaaaaacagatttaaaaaataatttttattttgagacagggtcttactgtgccacccaggctgaagtgcagtggtgcaatcatacctcactataaccttgaactcctgggctcaagtgatcctcccactccagcctccttggtgtctgggactgcaggcatgcaccatcatgcccagctagttttttaatttttttgtacagatggagtcttgctatgttgccctggctggtctcaagctcggcttcaagtgatcctcttgcctcagccttccaaagcgtatttttatttttttgagacagggtctcactctgttgcccaggctggagtgcagtggcatgatcacagctcactgcagccttgacctcctgggctcaagtgatcctcccacctcagcctcccgagtagctgggactacagatgcacaccaccatgcctggctaattaaaaaaatttgtgtgtgtgtggagatggggtctcattgtgacctgcggtttccaactcctgagcttaagtgatcctcctgtctcagcctcccaaggtgttgggattacaggtgagagccatgtggcttggcctacagccttaataagagataatctggaaattactatgaaatggattgctacttaagccttagtcttagaaaccatcttattccttgaagtaaagagctgccaaattttgaaatgcagcgaataggtcattaaatatttgagtgctttttatagacagagcagtgtattaggtactgctaaagatatgaattatgaaaaacggttccttctctttagtagtttatagtctagctgaaggggtaagacatataaccttgtaaaaagatgactaatgcaagttctctataacaaggtgacatacaaggagagaggaagccattctttattatgggaaagtacagacagtgctcattcaggtaatcattacatcaggttatactggagaattaacactgaataattatgttaggcttacaaaattatgttgcaatttatatttttattctcacattgttaccctatttttataggtttgtatagtttccagtatttttacaggtttttatttgccttaaaaaaataattcggctgggcgcggtggctcatgcctgtaatcccagcactttgggaggctgaggcaggcggaacacgaggtcaggagttcgagaccagcctggccaacatggtaaaacaccgtctctactaaaaataataataaaaaaaatctgggcatggtggcatgtgcctgtaatcccagctactcaggagcctgaggcaggagaattgtttgaacccaggaggcagaggttgcagtgagccgagatcgtgccattgcgctctagcctgggcaatagggtgagactccatctcaaaaaaaaaaaaaaaaaaaaaaaacacgataggggtgggagaagtctgttattgctatttgatagatgagaaaagactaagttaaatatgccaagatcacatagatttgagtattatgttatttgcatttatgtttctcattagaatagaatagaaatactcagataccttgctttggaggaaaaatatatacatacacagagtaaagatctccactcaagacttcatagaaatgttttaatgcttcctaaagcaccttgtgtataccttgtgcttagttgttcctttactgaattattataacgatttaaaaaaacttacaaagtgcctagcaatagaaggcactcatggcaactattattattgttgtttttttcaactttttcaactcagctctgatgttacttaagacatccaaattctcaatccatgtatgttaagatatattttagttacatacgacatctaaattctccatccgtgtggagattctgatttctccatttactgaatgcagtaattctggcctgtatttatggggtgcttactactttgttcagatactgtgatatgcattttacacacattgcatctttagatccttacagcagtttcactgtggggtgagtgatggtgtttccattttataaatgagaaaactgaggcctggactaatcagttgcctagggtgcttactagttaaaagtacagctaggaggctgggcgcagtggctcatgcctgtaatcccagcactttgggaggctgaggtgggtggatcacctgaggtctggagttcgagaccagcctggccaacatgataaaaccctgtctctactaaaaatgcaacaaattagccagatggggtggcgggagcctgtaatcccagctactcaggaggctgaggcaggagaatcttttgatcgcgggaggtggaggttgcagtcagccgagattgtggcactgtactccagcctgggtgacgagcaaaactccgtctcaaaaaaaagaaaaaaagtacagctgggatttgaatccacctctctgtcttctgttacctttccatttgggcagtaagttgaaaaaaatatttttggattgtagaggagtttttgctgtttttcaaaggatagctttttgaggggggcattgggtagtggctgttctccccttttataataaattcattgattggtattttttcaatctggttttttcaaaacttttttttaaattattgttgttatttaattaattgcctgatgacattttggtaaaatagtaatggattaacattttccagatcttgatttctaagttcaaggtgatattttactatattggtgagaaatagtttgttagtaggtttttacaggttgttttaggccaagaattgacttacctttactgtgtaataacattactacttgattgaataagatggttatagtcacttttgaaacagtattttggcttacaaagcttttttgaggggaaaaaatttgtttgtattggcagtcagccaatattttataagctacaattttcctttgaatagctggtggtttgtagctccataatttgtggttcttctgaacttgtaaaaagattacacatatttaaaaatggccttatcactttaatgttttaagcaatacacaactgtcaaattctgttatgttatagtattgttgttttacttaattttcctgggctgagaatctaacttaataatttatacagtataattggaatctcatccccctaaaccccaatgaaactccaaacaaacctaaaaaccaaaaactacattagtaatgtaacaggcactgttaaaggcaaaggaaatgtgagcgactctacatcggtctgccaaaatccttgcagtattcatgctagtccattatttagccactgctgcccggatgtgttgaattatgtggtatgtgggtttgtttgggtgtatatggtgttcttatgtgacatttagttttaaattaaggtttttgtgatgctgtcaatgttgccttttcacatgcagttggaaaagaatacttcattcgaaatgtttcatgttctgtaccttgttctcctggtttgtctgtgggtagttaaatttgtgaaagtcacgaggttattttaaatctttccttttgattttaggttaagtctaaaatggaatattgtaaccttttggcttgagagattttggaaagccagattaatatatccatttttgtacttacagaagtttcacagataaaggtgaacctaccattcaatttcagactcaaactccattgccgagtaggaacgttatttaaaaataaaccataatgaactattgtctttcttgggctaaatccttttgtttctggaagctgagtgaggtttgggttaaagtttccatttatcagtgggataatttttgtggctaagattttagtgaattgttaacagccagatccttaacaactgttaataatcttattaacatgttagtaaaggttgcttttaaaaagactctctagctctggaggatactgattctcattcttgattgaacgttagaattacctgagagttaaaagaaatacagatgcttgaggccggacgtggtggctcacgcctgtaatcccagcactttgagaggctgaggagggcggatcacgagttcaggagatcgagaccatcctggctaacacagtgaaaccccatctctactaaaaatacaaaaacattagctgggtgtggtggcagctcccagctactcaggaggctgagacaggagaatggtgtgaaccggggaggcggagcttgcagtgagccgagatcgtgccactgcactccagcctgggcgactgagcgagacaacgtctcaaacaaacaaacaaacaaaaacaacaaaaaaaagaaatacagatgcttggatttcaccttgaggattctaatttaattggtttgggatgctacctaagcatctggatttttagaggtaattccagtgtgcatatgaggcttagaactcccgctctgggaaatttgttagcccactcaaggggaaaaatttggttttagagaatatatctttacctttggagtttataaaactttttttttgaggtagttgtggattcacatgctgttgtaggaaataatgtactgagtaatccatctctgtaattttatcatttcaagaattttatgtaaatgaagtaatatagtatgtaaacttttcagcttggctttttcactcaggctaattcctttgagatccatccaagttgttgcatgtgtcagtagtttgttcctttttatagttaagtagtattccatggtaggtagggaagtatcacagtttagtcattcacctgttgaaggacatttggattgtttccatattggctattactgttaaagctgctgtgaacatttgtggatgggcttttgaatggtcataattttccatttctttgggataaatgcccaagagtacaattgctgggttatgtgataaatgcatttttagttttctcagatagtgctgtactttttctgagtggctgtatcactttacattcccaccagcagtgtatgtgtgatccagtttctctacatctttgccagcgtttgacatcaatactattttttgagaaagattagtagacttcattggagcagttttaggtttacagaaagttgggcagataattcagagagttcccatataccttcttccctcatgactttccccttttattaacatctgttaccatggtaaatttgtgaaaattgttgaacaataatgcagtattaatgcattattattaactagtctatggcttatattaggactctgtgacttgtacaggtctgtgggttttgacaacaaatgtaaaatgacatgtgtccactgttacagtatcatacagaatagttttactgccctaaaaatctgttctctacctgttcagccctcctgtacccccagttcgtggcaaccactgatccttttactgttaacatagttttgccttttccagaatgtcatatagttgaaagcatatagtatctgaccttttcacactggcttcttttgctaggctatatgcatttaaggtttctccatgtctttacatggcttgataactcttactctccccccatctctctttattgctgaataatatcctatagtggatgaaccacagtattcaactgtgattatatcacaatttgtttatccattcacctattgaaaaacatcttggttgttcccagtttttggaaattatgaacagaactgctataaacatttgtgtgtggacttttgtgtggatgtaagttttcagatcatttagataaatatctaggagcacaattcctattgtattgtgttgtaagactacatttagccttgtgagaaacttctaaacttttccaaagtaccattttacatttccctcagcaatgaattattttttattttaaccattccgatacttatgtagtaattcttttcattatgattggatttgcatgtctctggataatgattttgaatatgttttcatatgcttatttgccatctgcttttcagtgaaatgtttgttcatgtttttgcccattttctaattggattcttgttttttaatttttatttgttttaactgttgagttttgagggttctttatatattctagttagaagtcctttattgggtatgtggtttgtaattattttctcctaggctgtagcttgtctttatatcctcttaattgtgtctttcatagaacaaaaattaattttgaccaagtctagtttatcaggttttccttttacgaatcttgcttttgcaagaactcttcaactagccctgtgccccaaagattttttcctaaaagtgtgtttatttctgaaagttttatagttttaagtctgtgattcatttcaaattaggttttgtgtaaggtgtgaagtttagatgaaagctctatttttctttttttttttttttttttgtcttattgatgtctaattcctctagctgcatttgttgaaagggctatccttcttccatttaattgctttgcatttttctaagaaattagttggacatgtttgtgtggatctgtttttggcttctctgttctactccatcgatctctgtgtctgtccgtctaccaataccacgcaatcttgattactgtggctatataataagtctttaaatttggtagaatttctccaattttattattttaaaaattgttttagcttttcttggtcttgtgtctttccatgtaagttttagaataagtttggttatgtctataaaaatccttggtaaaaattttattacatctatagataaatttgggaagaattgacatttttactgtggagtgtctctaccattggattttaatagattggaatgagactagaaagaagtagttctgtagagaaaatactcaaattacttaaattgtatggagagaattctttgtaattagcaaaatgttaaactttttagccctccctccctttttggtgttaaaaaccataattaatagagctgtggaagtggaagcaatttcatttcaattctgtttatttatttatttgagacagggtctcactctgtcacccaggcgggagtgcagtggtgtgatctctacttagtgcaaccttttcctcctgggttcaagcgattctcctgcctcagcctcctgagtagctgtgactacaggtacatgtcaccatgcccagctaattttttgtatttttagtagagacggggttttgccatgttggccaggctggtctcaaactcctggcctcaagtgatctgcccaccttggcctctgaaagtgctaggattacaggcatgagccaccgtgcctggctattcatttattcataaaattttcactcaacatctttatgaacttctgttatgggccaggcactgttttaggcaccagaatacagtggtaaaggtccctaatcattgaccttacattctaatgaagagatagtatatgaataataacgatatacctcaattaagtgctatgcagataatcgaaacaggttgaccttgaaatagtggggtggctaattgattgattagatcagggaaggcctctgaagaaatctcatttgtttgtggtggtgagatctgaatgtcaagaaagagccagccttttgaagaaaagggagaagactattccaggcagagggaacagctagtggaacagctagggacacagtgggtgtgtggaaggaactaaaaaggaggacagggtgtctggagtgtaatgaacaagagggagagtagtacaaatgaggttggtgaggtaggcaggggccagatcacctgggactttgtaagccaaggtaaggagtatgatttttattctgagggtgatgagaagccactggaatgtttcgattaagggagtgaaaaggttgctgtatggagagagaccagaacaaaagcaggaggatgaattagggagctatttcagaccaggtgaaaggtgattattctaggaaaggattcaggatatattttcaagatagagtcaacaggatgtgttctgtatttcatggccacaggaaaagggaatcaaagataatgcctagatttttttttttcttttaaaacttggttggatgattattgttatccagtgagattggtaagacttgggagaggaacaaggtatgttttggagaaaaaaaaattgatttttttttttgtgtgtgcgggttgacaaggtcttgctctgttaccctggctggagtgcagtggcacgatcacggctctctgcaaccttgagctcctgggctcaagtgaccctcccacctcagcctcttgagtagctgggatcgtaggcgtgcgcaccaccacaaccagctaattgaaaaaaattcttttttgtagagacaaattctccatttgttgcccaggctagtcttgaacttctagactctagggattctgctgcctcatcctcccaaagtgctgagattataggtgtgcaccactgtgcccagttgatagtcctttttaaatcactttgttttttttttttttttgagatggagttttgctcttgttgcccaggctggagtaccatggtgtgatcttggctcaccgcaacctccgccacctgggttcaagtgattctcctgcctcagcctcccgagtagctgggattacaggcatgtgccaccatgcccagctaattttgtatttttagtaaagatcgagtttctccatgttggtcaggctggtcatgaactcccaaccacagatgatccactcgcctcagcctcccaaagtgctgggattacaggtgtgagccaccatgcccggccaatcactttatattttaactgatgtttgccatcaattggatatacaagtttggagtccaggcggaggtcaggattgttgatatagtgtggtgatttgtatatagacattatacagagttataaaactgggagaggccacttagaagacagtgtgataccagagaagggggcctgggacagagccttggagcactggcacattatgaggtctggaggaggggaaggcagagccaacaaagcctaggaaggtttagccattgatgctcttgtatgtttgcgactaaagttatagaaagataaggatatagaaaaatgaattctatcaatgccttctctgaaacctgaattttgtgatatccattgattctatcaatcctgttgaaagataagaggagacaaataatagaaactactttttgtgagaaaattagctagtgatatttgcttttagtgaaatgctagtaaaatacgtctctgtgtttctctctctttttggcttgcctctttgaattcaaagacttgataacattaaagaaaatgcaggatctctagatttcggtgtggtgggcagacaataacatttttatacataataatataatggtttcatgaagaaagcatcatacagtatattaagtggttgagtaactactctgggtctagcataatgctaaattgaaggagaaaaaaggaatgttaaatatagaccttgctttcattgaattttgatgaaaagagaggtaaaaaagaataagctatggtagttgaaaaggatttcttggaggagttggaacttgaagaataagtaggacttaggtgggtagaggagaagagcaaatcccataatatagtaagatatggtggaaagaaaatgggcttatttttttggtcagaagacctggtttgagtgaggactcacttaatagtttgtgacattggatgaatcacttgacttctttgagcctgtattcccttaggggcatacctgtacttgcctcataggtctgctgtgaagataagactgtttatagcttcaacaataatagtaatgtagtacttctcgtgtcaggtggctagtttgcagatactcattttaggaacatttcataaattcagatgctacactgaataatttgtatttatcaaatattttataactatcctttaaaacttatgtgtatagttcctaggtcagtgccagacatttagtaaattgtaggtgatattgttactctgctcctgttataagaatagcataggaaaaagagatgacagtccttgtccttcaggagttcttgctttcagtaataagtcatattcataagaagctgggggaaaatgcaagacgttctgtgccctggtcctaagtttgtgatatcaggtacaaatgaggtcagagtaggcttgtcattgggacaggcctttgttttggcagtgagtctaaatgtggcccaggaaaaaaggtaagatttggatagacaagaggaaagcccgataggcattccatttttttttttgtttttgagacagagtctcgctctgtcacccaggccagagtgcagtggcgcgatctcggctcactgcaagctctgcctcccgggttcacgccattctcccgcctcagcctcctgagtagctgggactacaggcgcccgccaccatgcctggctaatgttttgtatttttagtggagacagggtttcaccgtgttagccaggatggtctcaatctcctgacctcatgatccgcctgcctcagcctcccagagtgctgggattacaggcgtgagctaccgcgcccagcctaggcattccatattaagaagatgtttattttatgtatttttatttttaggggcaggaaagcataaatgttactgccactgctaaggaaatctttaataataacttaaaaattctcattctgaaacttttgtaatgttatgatcgaatttaccttcctgcctttacaattcattgaacttttgcctgctcccagatggcattctaacgtggaatttattgtgggggggtgtctcttttttaaaaatatggaaatgtttttattatatacttaagtttaattctgttatagcttttctcttttgtgtgtaaaaataataaagctctgtttcatgctgtgagatttattgttagaaagacagggcaaatttctgaaatttccttgggtagtctcccttctcatctttagcttatttgaatcttaactatttatcaattcatttgcatacgtgggatgttaggatgactctttgttttgaaaaacagtgctgtcagagttcctgtacagtccgtgctgaaattagggtgccctagtacaatgtactgttctctcttagtcactataatggttttgtaagtagctaaaccctaggtcatgctgcttttatgcagctgtcttccttggttactgaaagttggatggcgcttagtttgcctttaagggaatctaggtttaattgtatatctcctagaacattttgcaccaccaagtaggttgtagagaatctttgttagcattctgctagccttattgatacgtgatcacctcactgaaattgtgcagtatcatgtattctttgattgtattttttagaaatgggagtcttgctatgttgcctaggctggtcttgaattcctggcgtcaagcgatcctccggtcttggtctcccaaagtgctgggattactggcgtgagctacctcatttggccaaattttaaataagaaatgctaacgtttactgttactgctgtgtgctatgcactttgctaagcagctttaaactgtggagttttcttttcatttaaacatcacaacaattaagtgaggtgagtcctgcttttattctcattttacagagacagaaaggttaagttccgatctcaaggttacacaggtggcaagtggtggagaagggatttgaacccaggcaatctgactttagggcctattctcttatctactatgctttaacactcccctgaggtaacacctttctgggaaactgtcctattgagaactttactttttatgtgttaccttgtgtgaaggcattaaaagcttgtgcctgtttgggattttatagttgcacctttctcccgctgtaaggggtttgccattgtattacttaagtaacccagttgctgaaatagagccctgaaatacaatggctgaaaccccagaattcagcgcacagtagttgagagcaggtgttccacatcagcatgtggctgtcctttatgcaggcatttggggacgtaggtgaatggggactgtatcatctcgaatgcacagctttcaaggttgttcttgttggaagcacagggtaagaaattttgtcttaagcaagtgaggtgaaagttgtacaaatataatttctcctcccattgctgaaggcttagtctcattgcctcatctagctgcaggggattgggaattggagtgttctttctctttgctgacactaagaggtaaggtgtcattctgtactattttgagtatttcatcagtgttgaaatgttcttgggagtgcattttcagttacagaatgtaaaggtgagagccttgtcctagctacaactctgttatttggaagaaacagggtggattttggtagttagcaattttctgccgcagctgtaacactgtagatttcagtaggaatgttagaatagctcactgctgtggtttgcaaagtattattacacacattcaactcttgcttttttgttgttgttattgagatggagtctggctctgttgcccaggctggagtgcagaggctcaatctcggctctgtactacaacctctgcctcctgggttcaagtgattctcctgcctcagcctcccgagtagctggaattacaggtgtgcgccaccacgcccagctaatttttgtatttttagtagagacggggttttgccatgttgacctggctggtctcgaactcctgaacgcaagtgatccgcctgcctcagcctcccaaggtgctgggattacaggcacgagccactgtgcctggcctcaactgttgcttcttataaaggtaagtagataaagtaagtgatggtattcccttcgtaaaggagaaaatcgagacataggtggttaaacattgaatgaaaccagctagaaagttgaagagctgggacttaaatccagacatcatggctccagagtcagtgaagtttgtatgacacacttttttttttttttttagaaaatcctattcaatttttatatttactgtggtcactactcttgtatcctttcttagggtgtctaatatcaccaatgtccaatatactatgctggcaaattactatcatttgatgagaattattgataatttgatgtcattttgaagattcagaaagtacgttaagaacttgtattgcctcactgtcatcatgatgttcacaaatgacgccatgttttagatatgtcagtttatgtaataccgggtagcagagattttactctctttaaaaattatacttttatagacttgcttacggtaaagtgacatgtaaaatgagcaaatgaaatagaaataaaataggaaataaaaatagaaattaaatattggggcacttaatgtttttttcttagtaagtagcatgtattgtgaaatacagtgttcatataatttcaccaataattttgctgtactatgtgataaaaccactttatactatatggtactcaagaaattgggaacattttctactttagagcagctggaggagtcctttctccttgctgacactagaaggtaaggtaccattcctcagtattttgagtatttttgtattcaaagtgtgttgaaatgttcttgctagtgcatgttaagttgtagagtttgtggtaatctgatttagagattggaagctgtggactatgacacatattaagtatttgtgcagatggattattaatcagaaagtaagatggagccttttacacattcctattttaatagaacaggtagcaaactcattctggtgttcttatttttgattatttttcttggaagtttattttgctgagcgctctattcctaaatcatttcagaagtgactttagtatagctgaattttaatagatagaaataacatgacttcaatttaattttccatagactaccctttagacattctttacagcttcagttttgctatgaaagggaagagatcagacaaagagtgccattctttttgcatgtggttaatgaccaaccaatagctctctgggataacttttttttttttttttttttttttttttttttgctgaacttgtctcttcatccagattctacttagattttcagttgtctttgggataacttttttttttttttttttcctgaagttgctcttagttcatacagattttaattagattttcagttgtctgacaatcacaatagaaataaaagtggttgtatcataaattcagtgaagtctaactgggactagcattctttcagtggttttgcaaggatacagttatctgtatctctgtaatccattattttaacatacacatattgatttatttgcaaaatgaaaaaaaaaaacctaaattaaaaaaggcttatccttcaacttctgtagctttgtgttacctactttttagaaaagttacatgcaaaattttggccttctaccacagacaaggaatgctggcaagtgtgttgttaaaattctgtcattgcctctttatttgcctaaattgatggaaaaacactttcaggtcattttagtgaagttcagtttcagtggttacataaggtatgtcatttgaatactggttgtaatgtgtttccggtgttcacttgtatttataacctgaatacccagtaccccccccccccaaaaaaaaagccagttgaacagatacaaaaaaaatttttttaaactttttttttattttttgagatggagtctgtgttgcccaggctcagctgactgcgacctctgcctcccaggttcaagcgagtctcctgccttggcctcccaagtagctgggataacaggtgtgcacccccatgcctggctaatttttgtatttttagtagaggtagggttttaccatcttggccaggctggtcttgaactcctgacctcaagtgatctgcttccctcaacttcccaatgtgctgggattacaggcatcagccacctcgctcggcctgaacaaatacaaaatgtttatgctgagactaggcactttatatactattacttttgaaaaaacaaaacaaaacaggatttaagactaccaactaggatgggaagaacactagatttttagtgataagtccaggttttgagtctgagccttgctacaaagttacttggtggtcttgggcaggatattttatctctttgggtcttagttttctttttgggaagtaaggatcctgtacagtattagtctttttgaccagttttaacagtctgtgattctcagttttttctgtcttgtgaagagaaacttaacagtattaaagttgccagctcttttttttttttgtcttctgaatagtcttggtaacagaaaactggtttgaattagcctatctaattttaatgttttccaaaactagttttaaaggagacatgaaattagaagtatttagttttacttctttttttttttttttttttgacacggcgtctcgctctgtcgcccaggctggagtgcagtggtgtgatctctgctcaccacaaactctgcctcccgggttcatgccattctcctgcctcagcctcctgagtagctgggactacaggcgcccgccaccacgcctggctaatttttttgtatttttaatagagacgggatttcaccgtattagccaggatggtctcaatctcctgacctcgtgatctgcccgccttggcctcccaaagtgctggtattacaggcgtgagccaccgcgcccggcctagttttacattttaattgtgccttgctgttgtcactttaaaagaagcatgtgaactgaaaagacaaaacactttgaaaatgtactgtgcaatgaaaggagagtcacctattattaaagttctttgaattcccatttcatggcagagggcagtgaaatgagctaacatgagcatgtttatttatgtagactttcccatgtaaatcaatgcagatgtattgctgttacatttttctccaaacattttattatgaaaaagcttaaacatgcaaaaagttggaagagttgtatagtgaacctccatatattctgcaattagtgcagcctatattctgcaattaacattatctttcattaactgtatcttacatctatgcatctattcactccactatttaaccttcattacatcttactttttgcttcatttcaaaataagctgcagacatccttacagtttacccctaaacattttgacatacatataattagctggagtttgatacttgttaacacttcttaaagttcaaatttatatacataagcctggcataggggctcaggcctgtaaccctaatgactcttgggaagctgatgcgggaggattgtttgaggccaggggtttgagactagcctgggcaacgtagtgagacccccccatctctaaaaaaataaagaaattagccagatgtggtggtatgcgcctgtagtccagctacttgggaagctgatgtgagaggatcacttgagcccaggagtactaggctgccatgagctatgttcacgccactgcactcccagcatagatgacaaagcaagaccctgtctttaaaaaggaggaaaaaatttacatacataaaaatgtataactgttagtgtgccatggatgacagtcattaattgagcatctggcatttttcagggtctttgctagtcttgcagatagagagatgagtaagacacagtttctgccttcatggtgctagtaggataaatagaagagatgtctaaaaacgtagtgttttatttggagcttttagttgcaaataagaatcagctgtcttctacagataatcggtcttccttacagaacctgagggcaggaattcagtggggctttgggaagggctggaaccaagaaccagaaggctcacaggactgttttttcctaactctgcccatttcgttctttttcttcgaagatgtacttttttctctttttagtacaaatggtagaacatggctgtccgtagagcttttattttacatctaacaattctcagccacatagacataccagttttctctgttaatttcattccaaattcctgggaggtagaatctggccccaccctggttcagcttgcctgagggctgagctgttggaagctcacttttgtgaatggaatgaagtaggagggatggaagagacaattcccagaacaagtatggggctgttgtaacctgggctgacactgaaaatggtttataactacaatgtgataaatactggtgcagacaagaacaggctatagaaatagatggaataggggcagggtcagcttcctggagaaattgtcggctaaggtttttttgtttcttttttcttgagatggagtcttactctgtcacccaggctggagtgcagtggtgtgatttcggctcactgcaacctccgcctcctggttcaagcgattctcctgcgtcagcctcccaagtagctggaatttcaagcatgtaccaccaagcctggctaatttttgtatttttagtagagccgaggtttcaccatgttgaccaggctggtctcgaattcccgacctcaagtgatccacctgcctcagcctcccaaagtgctgtgattacaggtgtgagccactgcatccagctggctaagttgggttttgaaagatgaattcaagtacaacagtgggaaggaaggatattccttatagaagaacagtaggagaaagataggaaatggcatagtgtgtttaggtaactgtaaggagattggtacattcgcagtataagttttgaagtggggtaggttcattagagaccagagagagggagatccaggccagtttatgaagaactctatcttgttaagatatggggagtcagggaaggtgggtgacagatttatttccttaagagatcatttcatggaatgaactggaggcaagtggggcagagacagaaaatcttttgaggacttagactaagaaaatggcagtaaaaaagaggaggggagataatttggtagtaaaatctttagtacttgtgatttatttgatgtcaggagaaggggaggaatcttaagatgatgtccctggtctcctgacttgagtaactggattaattggtatactagccaagataagaaatatgggagactgtggtgctggcagtgttatatttcttgatttggctgataactatgagggtactgtttaaggattattaaattgcgcttatatgttttatgcatttttccatctgtaagttatatttcacaatctaaaagaccagaaaggaacaagagaaaataagtttgggaaagaagatactgactttaggattggacttttatatttggagtcaaccctccagatggagatgtgtggaaggcagttggaagtgcagtaaaattggaagtgcaatagaggagtataggctgctaataacaggtgaaaggattaggttaggtctgtagttctcaggcctcgttgtacattaaaatctctgtagagttaaaaaaaaaatactgataacctggatcccaccccagattaattaaattgacctctaggggtgtgagggtaccatgtctagcttaaaaagctccctgtgcattttcttataatacacagagttgaagaaccactgggttgcagaaagatcacttactccctacattctgttactgacagagttctgcaaagaggattttgtaattgctttagaactcaatataggtttaacctttttgttttgggtacaattattataccctgtgctttccccctactaataccagaaatttaaaaaagtgtgtacgcttttcattaaaataatgatgcacatgtgttcttgaaaaaagtatgtggaagacacaagctgtttagttaaagcaattttaaaacagaaactttcctgtgattaactgaaatggccatgtcttacctagttttaattattaatagtgtatagcttttgcagccaaacatagattgcctcatcacctacagtgtctttgaaaaataaatatgaaagacagtgattggtaaatgaattgggtgatgtagtctggaaggcagatagctgtaaatggtgagcagctgtctgtgatatatctgatacggaaaggacggttgcttacttgtctgtcctcagggtcctgtatctgtatccatcaataagtatttattagcacttactatcttcccagaagtgtattaggaaatgtatgtaagttactaaataagtaactagataaaatagacaaaaatgcatgggacttgcactaggtttgccagtgtttgggttggggaaggctgtgtaaatgacaattcaatgtcaagttacgtgataattataagaatacagttgctgctcggagactggaattatttcttgcgcttgagtgtaaagagtgattcttgcaacacattggcctcctattttcttgagctccattcatctagtgatcttattttctgtggacatctgtcagaccatggaccccagatctgttgatcctactgctttttcatcgtcctttatatccctgatgttcacattcccttcctcactcagcttaaattccatagtcattatgctaactcctctgtatagtctgtatagtcccacactttaatcatacttacttggcaaaacttacaaccctggttaaatctgactctcctcctaatctgcacctgtacctgtgcatctgaacatagctggaaaacacataccttcatacaccctatgctgaatgatcttatttattttttaaaattcataaccttgaacctcaaatgggtccttaatgctcctaggcaatcatatgtacctggcccattcactctgtcactctgttagacagttgtttgattattccgaccccttccttttaaaatccataataccctctctcccattcaactgatgaccttgctacttacttcactaaggaaattgaagcatgtacttgtgccttctgccctcattcctctcaccatagataaactacatgtgcttctatcaaaaacaagctcttcacttgtgtattagatattatcctctatcaactactcaaggatattgccctgagaatccccctccagattttcctgcatcatcaatattttgttttctgttggatcattcatcaacatttaaacatgttatttttccagtgttaaaaatacttgatcccactttgattgccagctactgtctcatttctttgcccttctttgtagtgaaacatctagaagtagtctctattcaactgtttttaatttccttcctcatatgatccctcttctatttctttattgagatataattcacatgccctaaaattcgctatttaaaatgtacaattcagtggtttttagtatatttacagagtcgtgcatccattaccactgtctaaattccagaacattttcatcattgaaaaagaaactctgtaccccttagtggccactccctgtttcacccttcctccagttcctggcagctactaatctactttctgtctgtgtggatttgcctattctggatgtttcacgtaaatggaatcatacaatatgtggtcttttgtgactagcttctttcccttagcataatgttttcaaggttcatgcgtattataacatgtatgagtgtttcattcctttttatggctaatattccatttatgaatatgccacattttgtttgtgcattcatcagtcgatggacgtttaggtggttccacattttggctgttacaaaaaatgccgccgtgaacatttgtgttcagatttttgtgtggatgtatcttttcaattatcttggctacatacttagtagggtagactttctgggtcatattatagccctgtgtttaacattttgaggaactgccaaattgtttttcaaaaatggctgtaccattttacatttccaccagagttcaagtttcttcatcttgttctctcttaagccaactttaatcaggtttttcctctatttcccaaacttcttagctgaacgtgcccttgacaaggtcattagtaacatcaaagtgcctaaattcaacagtcagttcacagtcctcattttgtttgacctatgcccagcatttgacacaattattcattcctccgtaatacactttattcacttttggcttccaggatactgcatgttgtgtgcagctccccctgtcccccaaccccacacacacattttattggtcaatccttgtcagtttcctttgttatttactcctttctctcctgcctttaaaaattggcgtgtccattggagatctttatctagacttacacatctttaagtactatccttgaactggctcccaagttgatatctctaacctagatctcttctttttgtccttccgagccatgtgtccagctgcctgcccaccaggatgttagacattttaaatggaacatgtctaaaacccaactccttttctttctttaaaaatatgtgccacccataggtctccccatctctgatcaaggcaatgccatcctccggttgtttaggccaaaaccgatggagttaacctacactccttttctcacatcccacatccaatctgctaggaagtctcgttgacctcaccttaaaatatctgcagtgtcgtaacacttcttaccatctctgccgttgccattaccctcgtctgattatcatgtctcacctgcatcgttgtgatggatttctaattagatcctctgctgtatgtttacctccaacagtctagctcaacacagtagccagaataatcctttagaaatatgtcagatcaggccgggtgcagtggcctgtaatcccagcactttgggaggctgaggtgggtgaatgacctgaggttgggagtttgagaccagcctggccaacatggtgaaaccttgtctctactaaaaatacaaaaattagccaggtgtggggtgcatacctgtaatcccagctacttgggaggctgaggctcaagaacagcttgaacctgggaggcggaggttgcagtgagccaagattgcaccactgcactccagcctgagcgacagagtgagactctatctcaaaaaaaaaaaaaaaagaaaaaaaaaaaaagagaaaacaataaatatgtcagatcatatgcattttctgctcaaaaccctgcattgcctccctgtttcactcagtaacagccaaactaggccctacttcatctgaccctgttacctctctgaccacatctgttgttgttatcctttggcttactgcattcacctccttgctcttcttcaaacaggtgtgtgttagactcagggcctttgcacttgatgttctttctgttggaaatgttctttaccattttcagatctcctcaaagctcaccatattcagtaagcttaccctggttacctttaattatgtaacttgctcctcctacattctggattctcctcttttaaatttttgcataacatttaacattgattgagtacattattgacttatgtttatgattgccgtggtttgaatgcgtctcccaaaaagcatgtgttggaaacttaatccccgcagcaacttggggaggtgagacctagtaggaggtgtttagatcatgaggaatttactctcacgaatggattaatgctgattataaaagaacttgaggctgtgaattagatctctttctctcgctcatgtgatgccttccaccatgttatgacgtggcaagaaagctctcaccagatgtggccccttagtcttggatttccaagactctagaaccatgagccaaatatatttttattcattataaattaccaaatctgtggtattctgttataatagcataaaatggactgagacagtgatacattgctcttcctccccaccccgccaccccctcactccccaacaccgctaagctgaagctccatgagggcagggatttctgttttgtttacagatgtaacctaaagtgtcacagtgcgtggcacatagtaaccattcaagatatatttgtggaataagtaaatggatggctgtatggcagaggtgggggtctgaggcaggccttgaaaaattttgattaggttttggggagaaaaggacaacttagtttcccttatctttcccaatcttctcttttctgtgcctttagcaagatctctttaaccttcaaggcatggcatctgaattagaacctgagtttgaatctgcttagtatatatgtgaccttgaggaagatttctggccattcttgagtcccttttaataataaaaaagtcatttttattgacgtatactttgaatatagtaaaatacattttttttgaatatacggttctatgaattttgacagacttagtcatgtaaccaccatcaagatatatccattactacaaaacgttcctttcagtgccatgtagtcagttccctctcttcacctcctgctcctggaaaccattgatctgatttcttaagtgtgactcatttttagtcaaacctctttcatttagcctctgtgctttcgagatgcatctgtgtaattgcatgtatcaggagtgcatttctttttattgcccagaagtattccagtgtatggatttaccacagtttattcatttaccagttgatggattttggggttatttctagtttttggccattatgagtaaatttgctataaacattttcatttctgttgggcaaataccttgggtgtgggagcgctggattgtatgataagtgaatttaactttataaaaaaccaccaaactgtttttcaaagttattagctttttttcacatttatcaaatggggtaatagtcaagacttttagttgtgagcaacagaaattgagtctgggaaaggaacttatgaacagggtgttaggtggctcacagaatctcttggagggctggagaaataggctgagaagttagcatccaggaacaagattctaggcacagacgaggttgaatcgccaataccatcagggggtgctagacactgtaggtagaattactgtctctggaaactggatgaagctgctgtgcttgctgctttcacttgccagaatagattttctgaggacccagcttctttgagtcatttgcttttgaatcaccatctggaggtaggcgctgcctcataaggtgggggattccccaaacataggaaagaggattcagatgtggggctgaaaaaggaaataacacgtgtataccacaacctccagaggtggctgtgattagatagaataatttccatggtgtctaggaacttactagaatataaatgctagtttacttttctgttttcctttttccccatctgtcttttgtaagtaaaatttttgttaaagtgtaaaacaaactacataaatcataagtgtgtatagcttgatgaattttcttgaagtgaattcatccttataaccggtacccagaagaaatagaacgttgccagcacccagaaacttctcccgtgtcctcatcttcatcactgcacactccccactccaccactgaatcactggttttgactagttttgcctgttttcaaactttatgtaatcaaaattgtgtgtgtatggtttctttctttcagcatttctttcaatatttgtggacttcattttttgttgatttcatattgtttcattgtgtgagtataacactatccattgtactattgatggacacataggctatttccagtttttgactaatgcaagtaagtactgctatgaacatatttgcacgtcctctggtttaaatatatatgtttctctaggtatgtaacatggagtgaaactaatgggtcatgggttctgtgtatgttcagctttaggagagtctgctgaaaagttttaagtatctttttttcactttccactactaccagcagtacatgtaagttccaattggtcacttctttttgacatcttcctctgttttcaataggactttgtaccccagtatagtacttgtttgagtctacctaatcagttacaagtatctctttcctataatgttattaactctttgaggtgggatttcttgttttgtctttctcctcttagtatcgagtacaggcctagaacacgtagtaaatgctccgtgaaagttgcgtgaaaagatgaatcgtgagtatgtctgtgggtgggaattatcttggcattttttagaacagagaactcactggtctgactggaattagaagtgatgggaacaatgggtgataggattgaattaagtcaggtgaaatctgattcaggaggtaataggtagccctgtttagttcctgaactgcgagagagttaatgaaagctgttttgttctgtgagtgaagaattgtgtttttgttacaggtgtgtccagctgttaggaaatagttacaaaaaagatttgggcccatgattggagacaagattagacaaggcatgagtgggtgtgaatttggttagcttaatctcttagtttttagtttctttataaaatggggctccaccttgtaaagattagagctaatatataaatatgagtagatgttttcttttttattcactgtgtattttgttttgtggcatttgaattttgtggaactcggaattttgaaacatgttgtgaagtgtaattctgccagtgtaaatccatgtggaatttttctaactatagcatctctggagcaccttgcgtactcttctttgcttctactttgttgctctactctagcacctttggttctgcctgtgtcagaagtaaaaaataaaccattaataaagtggcttcttgcctctgagagcttatcccgcaaagaaatgttgaactgttccctgtaatttctgttaattataaagcacatatatgaatataaataaatactaagaatcaagatttttagtggaagaggaaaaaaatccaagaggttcataaaaaaaaattgtaacgttgaattggaattatctatatgaactcatgcttttgtgtttcttttttccaattttgcttcacatttaataataatgttttgagctcataatgtctagatattacctgattgttgaacattagtatgaagagatctccctgaaacagtggtactatattattattttaaaaactaatgtatttctttaactggagagttttagattgacataaaaattgagcatgtaatacaaaaagttttcatatcattctatcccctcactcccacctcataattccacctatttttaacatcttacattactgttggcacgtttgctaaaattaatgagcaaatattgatatgttattatttaaagtataatttgcataatgttcattctgttatacagttctgtgaattttgaaatatttataatgttatggttaccattatggtctcataaagaatactttcatgctttaaaaatcccgtttccacttattaacctctgtcctctttctccagaaatcttggcaactattgatatttttattgtctttagttctgccctttctggaatgtcatatagttggaataatatattacatagctttttttagatgagctcatttttatctatctatctatctatctatctatctatctatctatctatctatcatctatctatctgagcttccttcatgtcttttttatgctttgatggtgaactccattaaatcactgaataatattgctatcatttgccttttttttttggtattcacctcgaaagacatcttttttgcttccagttctgatgattataaataaagctgtcataaacgttcctgtgcaggtcaactgggtaaatacttaagcacaatttttggatcatattgtaaaagtagattgtgattcctaaaatttggtagatttcataagagaaactatctgggtttggtgccttctccttttggaatattcttaatgttaattcaacttctttaagaggcataggcttattctgatgatctgtgtttctactgtgaccttcggaagagtatgcctttccaaggaattgatacattttactgaggttatcgatcagtggccgtagaattgttcatagtactccttgattatctttttaattcccaacagtttagtataggtggctcctcttttatttctgatattagtaatttgttgaactcatggttttaaaaatatttacttgctctattgactgaaagggcctaaaagcaatggcagccagcagagatgagcatatctagtgcccatatattgtttttttaataccatttgccactaaaaggaacctcggagaagtggctgattccaggtgtgggaccagaagagtgctgtctaagtctggaacatcttgtgtcaaaaagcaagggagctgtgaaaggctcggggcacatgtctgaagaacacaggaactcacttgtaaaggctaccacaggccaaatttgagacaacttgaacattacaaaatggtaatagacattgagtggaaaaaaaaaaaagaaaacactgccatgatttcatagtgagaaagagaaggaaagagcgaggagaggggtaggaagggaggtgaagagaaagagagaaaagcgaaatcttctttgcagaagattgccaggtgataaatgtaaaaggaattatataatgagaaaatcacctttttgtataccccacataataatctggttcaggtaaggacgatcactggatgccataactattaggtgaaagactgttgggagaagaaaatatttacacagtctcaaagtatcactttacaggttactttctacttaataaagggaaaataattttacaatatagagatctgtcattcaccaccttaatgaagtgactaaaacttaagatcaaggagctggtatcaagtaccccctgacttgatgcagtaagagctatgcaccatcacctttgtttaaatcattgccggaaatgaagaaacaatcagagaaatcagaatgtggagcgttctttaaaacccttggtctggattcttaaaaaagacgctgaagtatttatttaggggtgaagtcaagatgtctgcaacttactttcaaatggtttcacaaaacacagagatacagcaaatgtagcaaaacgttaactattgatgaacctaaatgaagagtacacaagtgttaattttaatagtcttttaattttcctgttttcaaagtgtagatttttaacagttaattgataataaaatatgactctgaagggtcttaagagatcttctaatccaaccccttgtttttacaaatgaggaaagtgcgacccagggagacttgtctgaggacacatcagctggttactgatagagcgtgaagagcatgcctattctgtcttttgccaccacccgtggaggatgtgagtggcaagatgtgggaggaatggcaaagggacagagagagggtctttgggaggaagggctctccggagtcatggtaggaaaggggcaccccttagtaggagcatgttgtgggtcacagccacagccaagatgaaggagattatgacctgaaacacaggcaggcccgagagacccaacgcttcacccagcttagctcctccttttctctttttaaaaattctttgttgttttctttctctaattattctttccactaccttaaaaaaaatctctataaacaaaaaacaaacgtctctattttattgtcagttggtcattttgctttttccaccaagaattaacgtgatgtcatggaaataatataaattttggagctagatagacctgatttcaaattccaatcctgcgtactagctctgcaacttggaagtcacttaaccctgctaagtcttggtttcttcatttttgacaagttatttcttcctactttgaaaggaagtggcattgtactggggcattttaaaaaataaatcatgttttctcctcagttatttggaggttagttatacagtcctgttagtgggtttcttaaaaaaatacagtgatacattgttgacttgttggagtctattgttaattggtaactggtagtactgacaatgtctgcatcttagaatactttaacttcctttaccctgttctccacctacatgccattttagttgtttacattattgtatacatttaagcccacaagtttagtcattcaccgcacaatgaagtttcaatgacagactgcttgtacaatgtacagtggtcccatgagattatatcatatttttactgtactttttctgtgtgtggatacatttagattgtgttacagttgcctacaaccgtatttggtagaataacttgctgtacaggtttgtagcctagaagcaataggctataataacctaggtgtatagaaggccataacatctaggtttgtgtaagtacactttatgatgtcacacaatgatgaaattgcctagtgacacatttcttaggttgtatcacttttgttaagaaatgcatcactgtattaaataatatttgtcattttaaaaataatgttataactgttcatattcacttagatttacccatatgcttacctctttatttgctctttttccatctgaatctctaattttttatctgtaataattttctttctgcctgaagaataccctttagaatttcttttaatacaggtttacctgtggcatactctgtttttgtttatcagaaagttcatttgtttgcattcattcctgaaggctgtgtatttactagatatagaattgtgtattggcagttattttctttaagcacggggaagctcccattctggatccattgttaatattgagagctggcagtgtgtccctcctttgaaggtaattgtcttttttctctcatttaaattttgtagcaactctgtgaaatacaggttttattgttgttagtacagatgagaataaaaactctggataacttgtccctttcacacagctagaaaatagtggatttaaatccaagtctgtgagacatcaaagcctatactttccccactttgccttactgcgtctcgctaaataaaagtacacgttcatcaatttaacagtatttattgagcttctcttatatgtataactttgctatgaactgaggtggatactggattttgggacataattctggccttcaatttatagtttggagaaaagcatgttgaaaacattcaatttgtaatatgaggcagtatgtgattaatagctaaaatggtgatagcctgtggtaattactaaaagagtttaatgcaaagagaattttacaattggctggatatgtcagagaatatcctgtgaaggaggtgtgacttggtctgaaccccaggcagagtttgtggggggttgaaatcgtagagactctttgggtcgggggaagttacgtgaataaaggcatggggactgaatgatggatttggggaatggcagcaaggttgatttggttctagctgaagattataaatattgttgaagataaggttgtatgtgaggtggtgtgtcattatggagattgcaaactcctgttctctgtcttttagggcatagggagcccttgtagaatggtttagggacggggtgatacagtgattatttacagggcaagagcttggcttgattttatcttccaacctaaatctcaattatgactttgtcacttcctcatttatattgtgggttagttaaatttttcaggcctctatttcctcatccgtgaattggaaataatagtacttcttttatagggttgttgcaaggataaatgaaatgatatatgcagtgtacttagaacagtaagcgctatgtaaatgtgaggcatcattttattattattgttagtgttattaaattagattatgtatgttagtattcaccctgatgcctggcacatggttaatcataattccagtcactaatagaatatatatgggataattaaccaaattatattttcccacccctgcaccttatataggaaatttatgtcctttaaaagtcatatttaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaaagtcatatttaatgtataaataagctgtataattcatttaggttatttcctcattgcattgtttttgattacatgttacatatcattcccagtccactcctcagctaactcattatagttataaaaataatggtgaagaacagtgaagaaaacattctatgctaagaatgtgtagtaagaagagagagaaggaggtaatattagttaaatctgtgataagacagtatatcatagacagaagctgtgaagatgccataggaaagatgtaggaattgtgctgggtcctgaatttagaaacattatctatgggcattgtttaatttgatttctttaggaattgtttgtagtgtgaggatgctaactaagcttccaccgtaactataaagaataaaaaactgccttgtctgttaaaattttatttgaagagaaattgtataaagccattgaaatatctggactgacaagctagaaatgcatttaagtgaaggctcattaatctttaagaagttgaaaagcaaacgtatgtggcagagaagccagtgtggatttgcaatactgaatgccagcatcttcaaatattgtcagtaaaggacagtgggaaataagaatggacaccacttatatgtttaagtttaaaatagttcagcattatatcaaatgcctttattgaaaataacctaactagtagctaattatagttttaagggaggtttaactttatctggtgactgtttgcattgattagaatgatttcacaagagaatatgcctttaagtggacatgcttttaatttcggaggaagtaaacacatggtgctgttcttaggttgtatttcagatcttctgtggtctaattggcaatgatttttaccttgttttcactgacaacttagaaaagacattctttaaatactgtctcattatttttcccatttctttttcacattctttgtgtttcttataaattggcaagggagtatctttgcatatggtttgttattcttggaataagatgcttttttttctttctggtcttgttttcctaacctttaaccatcctgttaacagatggttagattatccttctactctatcattttgagtaactttgttttgaaaaagcccaacttctaacagtgacttaaatttttacaagatagtatcagtaactcattcattatggcagctttgattcttgaggttccttttatctttcgggttgagtttgtatttatatgtaatactaaatgggaagcctgactttaagttattgggtgattatttcttcctgacatcggaactcaatttttagttgattcatagcaccttgagaagcagataaggcaggtatcttttacttgagggcacttaaaattgtagagaaccataggttttggcacctaacagacttggatttaaattgtagattttcccttgtgtacctttggacaagtgacttaactgagtttcagtttgtaaaccttaaaatagagactgattgtatcacatttaccttgtagagttgatgtgaatattaactgaggtaattaatgcaaagtgtcctgtacactctatggaacatgggagataaaaaatgaaggctcacttgccaaggtaatcagttttacaagatgggacatgtaattgtacatgatatcgtagcagtgtttgctatttatatgggtagttccctttatctgagaataaagcatctttagaatgaatcgtggtcaggacctcagttcaagtacactctgataagcttggatttgcttctcagtgactaaagggtagtaagcacagcagctgtggtcacgacatatatttgcatggagcatgatagacatttctatggcaagactgtctgttgtaaattatgagcctagctgtgctccaactataaagaatgatgaggagttgcacgtattcccaccctgaagtaccaggaattataattgagtcatcaatcatttattcatttgattattcgcttgacaactatttgagagcttactatctaggcattgtgatatatactaggggtatacagccaagagcaaaacacagtatctgccttctaggaacatgtagttacagagctggtaagtggtaaaacatagggcaaaactagtgcagtgtgagatatgggaggtcttcttcattcagtccatgccaggcaaaggattaggaagggggtagcggtacaggtcaagatgagaggacgcttcctgtgggagaaggcactgtcttaagttgaatgcagaataagggtggagggtttaagatgttaaggatggtattttgaaaaatttcattccaagggttaaacatcttatttctgtgagtaggttacagagtaagcatggttgagtctaattttcagcagaggagtgggaaatgagatgtccgaaatctttctttcactgttatcagacattaggagtagacctaactttgtgctttggaaatataagaatccagaatcgaacttggaagctgagggccttcttgttcgtagaattttagaatgttaccaacactgtatttattgaatttatttattttatttttttgagatggagtttcgctcttgtctcccaggctggagtgcaatggcacgatctcagctcactgcaactccgcctcctgggttcaaacgattctcctgcctctgcctcccctgtatctaggattataggcacgcatcaccacacccggctaatttttatatttttagtagagacagggtttcaccatgttggccaggctggtctcaaactcctgacctcaggtaatttggcctcccaaatttttgggattacaggcatgagccaccatgcctggccttattgaatttttataatttgtatacaataaatatttgttaactgaatagtaaatgagattggcatggctctggttcttaccctaaccccagctttaagaattaagatcagagtggctgtaatgattgggtgagctatgtaagtaatgggcttcaggctgggcacagtggctcatgcctataatcccagagctttgggaggctgaggctggagaatcgcttgagcccaggagttggaaaccagcctgggcaacatagcaagaacgtgtctctacaataaaacagttagccagtggtgcatgcctgtagtcttagctacttgggaggctgaggtgggaggatcgcttgagcccaggagttcgaggtcgcagtgagctataattgtgccactgcactccaacctgggtgacagagtaagagcccatctctttaagaaaaaaaaaaagaaagaaattgggctttggcatcaggcacctccactgacttagttacatgcttgcctaagaccataacccaggaacagtggactcactatccataccaagtgattattaacaagaggagcaaaaatgtggacaccagaaactataatgcgaagcaatctatatgcccagagactaaagtaaaattttgttttaaaaaatcagccaggattttgtacatatatatacacccacacacatataaacacgtgcataaatgtcaagattcataatactgagattttcatatttgttcattcatatctgtatgaatatagtataggtaggtacagttgtctgagaggaaataaaacttgttttgagaacaaagaggagggagaattaatgttacacttgggatgggatgagggaaggctttctggagaggtagcatttgacctgactctttcaagagagggatggtctgttttgcagaacctttattagcataatgagtcatgaggagtcccagctctgtagacaggtggtctgattctttcttttattttcttaatttttaataaaaaatttttatttccataggtttttggggaacaggtggtatttggatatatgagtaaattctttacctgtgatttgtgagattttggtgcacccatcacccaagcagtgtacactgaacctgatttatagtcttttatccctcaccacccatcattcttatgcctttgcatccccatagcttagctccctcttattagtgagaacatacgatgtttggttttccattcctgagttacttcacttagaataatggtctccagtaccatccaggttgttgagaatgtcattcattcctttttggggctgagtactgttccattttgtgtgtgtgtgtgtgtgtgtgtgtgtgtgtgtgtgtgtatacatatatatatatatacaccacactttatccactcattgattgatgggcatttgggctggtacacatttttgcaattttgtgaattgtgctgctgtaaacatgcatgtacaagtatctttttcatataatgacttcttttcctctgggttgatacccagtagtacgattgttggatcaaacggtagttctacttttagtgattctttttttttttttttttgagatggagtctcgctttgtcacgctggctggagtacagtggcgcaatctcggctcactgcaatctccgcctcccaggttcaagcaattctgcctcggcttcctgagtagctgggactacaggtgcgcaccaccatgcctggctaatttttgtatttttagtagcgtcggggtttcaccatgttggccaggctggtctcgaactcctgacctcaggtgatccacccgccttggctcctaaagtgctggaattacaggtatgagccactgtgactggccgcaggtggtctgattctagtcctggctctgtcgcagactagctgcttgatctcaggtaagtcacttcattcctctaaactattgtttcctctgtccagttggtataatcatattctccacagatggtttttgaggattaaatgaagtaattcatgtaaaagatgtagctgagtatttgggcattattactgttagggttttgtgggtaggctttttgaagctgaatttagtcgattctgttctcctgccttaataaagttatcaagtttcgaaaaacgaacctggtggctgtacttttccatttatcagttacacattctgaataactgagattttgtcaggattcttcttgaattggagaatttgttgcatactgagaaaacaccagtcacaagttcatggcgttatattgctgtcccttgagtttcagtacgctgattaggttggaagggtaatcttccctgcttatataagactgtgcttttcaaactactaccatgactgttagtaaatgaaccttcattgcggccttgggagcacataggtgggtgatgattatttttcaggaaacagaatttacagagccagggaaaagcctttatggctgagtggccatttcaacactatagccctggtctcctgacatagttctatttttttatttaattttctttgaagtctagtcatcagacctgaatttgcacttaatctctgccatttactagttgcatgatcttgtgagagttttaaaatttatgagtctggcccttttatctgtgaaatactgagattttgaaccacacaggaatgtctgtgatgcagaatttactttgcttaatttttaataagaattgctttgtataacgctgtatgggaatgcgtatttgtgtatttaagactcaaatttattcacttattggtgtcttgcctggtaggaaatgtctctatttctagattgtcttcaatgttcttatcctgcttatctgtggataatattcttgatagtcatgtgaaggatctatcttgggaaagccaaggacatctgggaatgtttgacaggtgaataacaactaaataactgaatcgacttctcacatcattgctggcgttgcttgttctttcctccttttctgtctcttttttggctagggaggggcgttgggggtgtcagtattatccaaatagttggatagtttaaaaccttgcagctaataaatatacgaattttagtagtttgaagtttgttttccactggaaattcaggcaagagatccattttacatatgaaaatcattcgacaaatgcttatcaattattaatatatactgttttcctcatgaacccgtgtcagaggtaggtgaatataaagttctgtgagtaccgtattggaaatgacaaaatgcggtaattgaaactcactagaacaaattctttttatagtcttaccttcccctgaagtgttaaatgtatacacgtgcatttatttattaagtggctgagttgttaggaaaatcctaatgttgagttttctaataactgaaaaaaatccgtattaaggaagaagttttgcattttacttttcttattcagagcaaaaggttgggaaaaatactaaggttgacttgaaagtgtcattcaggagtaagaaggttctttttgagttagtgtctatattttaggggttaggtgagaagtcatcttgtaaaaagcaagattattttctatagattatggaagtttttgttctctttctagtatgtagcaaactgagtacttactcagttgcagttttattaatactgttatattggatataccatgagtcaaattatagtctgtgaattatactcatatgtgataagttaggaggacactatattagcaattcaatattttaaagttatccatattaggaaaatagtataacaactctttatagttgaaccgatttggcctaaatttaaaaaattatacttcagtcaggaagaccaaaacttaatttagtaaaaatttaatataggctgagaagctttttaaagaattggttataatgtgcacagaattagataatggattagtcatagtccttgtttatgacatagtttcattggcctgcaataagcacttgtttatccaccattggggaaaaaaaaggtaggtacttattataataacctatatgtgacttccaggtttccccaaccatcctatccccatggcttcctcgacagaattcaaacctgaattttgtattcaccctctttctgtttttatttgtctttatcacatctttatggattcttagaaggaatacttttttattttggtttattttttataaaaaggttattctatgatgtaatcatttggaacttattgtttttacttaatgtaatgctaaaatttattcataatgttgcatgtcattgtagttcattcactttgtcgaataatctattatcttaatgtacatagtttaattcatttacctgtgaatggacgttttgcatgttttccaggtttttgctgttgtgaacagtcttgctatgaacattctaatatgtgtctgttgtttgtacatgtgtgagtttctcttagtgtatacctaggagtaaaatccctgcataataggttatgggacttcaatttgtggaagactgaacattttttcctaccatcaatacataaaaagccattgtgggtccacattttttccagttcttggtatttttagatttctggtgtttttggagcttgaatagatgtaaaatggtatttcatttttattgcatttggttgatctttttttttttttgaaacggattcttgctctgttgcccaggctagagtgcagtggcacgatcttggctcactgcagcctccgtctcccaggttcaagcgattctcatacctcagcctactgagtagctgggattacaggcgactgccaccgcacccagctaatttttgtgtatttttagtagagacggggtttcaccatcttggtcaggctggtcttgaactcctgacctcgtgatccacctcagcctcccaaagtgctgggattacaggcgtgagccactgcgcccggcctgcttgatcattttttataataatgtttcttctatttttattggttttgtgttttaccttctgtgaaatgcttgttcttgccttttttttctgtttttttcttatcctactcctggattttttttttcttttcttttggaatataaaaagacttctttttgtattcttgatgtttatcttttgttgggtgtatgtattccaaaaatcttgtttgtaacttgtctttttaccatctttagggtgttttttgatgaccaaaagttcttgattttaatactcagatttattttatggttatacttttgtgtctttaagaaataattgacttttgtttttctcattttcgatgcccatatctgttaactctatagttgacacttatttaaaggcttgagattgcagtggtagaatagatgaagaagatagtttaagaaaatgaaagaacaggaagcattttcgaatataccaatatatataactacaaattgctcattcccaaccactgaatagaaaataagcctctcttaaaagctagattcacatttgttttttgaatacaagtatctgaataaggttcactggtctgctaccatgacttttccctaaattctcagcagcctatatgtttcttgaatgatttaccctttctctgaaccttgtttatatatatgaataaatttgtgtgtgtgtgtatggcaaccattgatgagaaaatgagtatgaccagtgtaatttatcgagacaaacttattatttattttgaaaattatttttattactgagcttgaaaatatttcattctgcttatcaacattgtatggtaaatacctgtatctcctgtcacttccatgtatgcactctgttctctagcagatttgaaatctggaaacctccctcatcagcacacatgtgcacacatacatgcatacatacaccccatactcttttagagccatcctctttacatgttgtttctgcgttgggaaagtgtacatggtgaacttcttgtggtttactaagaagaatatgattgtaggcatcacaaaaataacatattgtgtagtactttatcaaatgcttttacatttttacatttaattcttaccacaaatctatgtgattaggtgggcaggttatcatcccactttagagtgtattgttaatactgaagccttgaagacataaagtcaagtgctttcctggtatttgtagatgcttagtaagtatttgttggttagatggatgaataaatggctagttatgctcaccctgatgttctttcgattataccatagcatcatatttaactgtgccccagctgaggtcttgatatatagtagaaactagaatgtttattgactaagacttctaagtattatgggtaactagttctagactagccttcttgccataaacaattatgaaacttaacagaatatatgtgggaagattttcaggctttgggcaacaggctgcacaggattgtgatcttgacatttatgaggagagctcagtgattactcctgttctctgcctgaggacagtttgctgagctggaatgcaagcagagcatgtcacctaaccatgttgaggaggcagaggttggagtttggtacacttgagacagctaaagtgttcggggaagggaaccagacaagaagaagctgtacaagagaggttcccaaatgtttgtttgtgagtctcttgtgaattcttgtcagagtgttgggctgtccatgatggggaaagactggagggtttatcaggtggctgccacaggattggcagtggaacaaatactagaagtatgtggctaggggatgttaaaactttgtcccagccacaattgagagacctcccaggcatctggatgaaatgcaagaaagaccatgtggtaaagctggggtaagcaatactgttaaatcatagccatacttattcatgtatatgttgtttatggatgcttttatactacaatggcaaatgtcagcagttgccacagagactgtgtggcccaccagtctacaatatttactattttgcccctccccttaagaaaaagtttgctgactcctgcactagagtaagtcctactctaggaccctcttaacaacaaactgtgcgctagctaaggtctgtaagcaaatcctgatgaaatctgcggagaaagcagaacttggaggctgagttctgccaggttacaggacttgggaaacatcctgggctttccatagatctgtcctaacaaaagtattactggagttaaaattagaatgttttggggcagtattaccttctttggtgctttttgtaaccttcgttatagtgacagtgactttagccagcaccctcgaatactttgaatgtcttgtttactcccctagataattctatgttggaatatgtctcattccacttaaaaaaaaaaaaaaaacttacagtcttctttgatggagaactttcttgtaccttctactcaatatcaatatttagtttacattgaatacttattttgctagtaccggaaggctaaaaccaaagctaaagtagcttcttgctaaagaggatcaaagttccttttgtttctacgtatcttacgtgttcacataattttaaaaatattttgaaattagaaattgtttaaagcttatagacaaaaatagaatatgataaacaactgtgtgttcaccacaaatatctctctcatattctaatgttttaccaaacttgtttcagatttttttcctctaagaaatagtagctcagatatgtattatgtgtatatccctccctgatgtgttctttttttgaactttttattatactttaagttctgggatacatgtgcagaacgtgcaggtttgtgaataggtatacacatgccttggtggtttgctgcacccatcgacccgtcatgtacattaggtatttctccgaatgctatccctcccctagcccccgaccccgctttcctgatgtgttctaatcctacttttcccaaaggtaaccactctcctgaattttttgtcattactttgaatgttttttatactaaaaaagtatgtctgtatctctctccataaatgatatgtaacattatcttatgttttttcaagcttatattcagggcatcactttgttcatgctattctgcaactagctttttcctccaactttgtttttgactttagacatgatgaagtggatcactgtcattcataaactgtgcagtgtatatctttattctcttgttgatggacatttagattgccagtattttgtgataatgcacaaaatcagtgctacagtaaatgttggtgttgtctgtcttattgggtttctgtgttgaagttactctaggtgctgtaaatagaagtggtatcattgcttatagggtatccgcatctttgacgttatcagttactattaaattgctcctcgagctgttttttttattcttttatagtttcacctgctttggttttatgcaattagacataatggactttccaaagcagaaaatatgacatgaaaatctcattttaccacagaaaaacggaaagttggttgattagattcttgataaatttgttcatatttaaaaaatcttcttggctgggcgcggtggctcatgcctgtaattctagcactttgggaggccaaggtgggcggatcacctgaggtcagtagttcgagaccagcctgaccaacatggcgaaaccccgtctctactaaaaatacaaaattagctgagcgtggtggcgggtgcctgtaattccagctactcaggaggctgaggcaggagagtcacttggacccgggaggcggaggttgtgatgagccgagattgcgctattgcactccagcctgggcaaccagagtgaaacccgtgtcaaaaataaaaaaaataaagaaaaaaagaaaaaaaaatcttattatggaaatgttcagacataaacaagtagcaagaaccccagtgaaccataaagaaccccctgtcattcattttcaatacctatcaacatatggccaattgtattttacttccttgcccctgcaactggattatttttttaaaatcccagatatccacattcatacattcatctgtaagtagtttggtatgtatctctaaaaggtatgactcccccattccaaaatgaaactcacataatgccattattacactccagaagtaatccccaaatgtcaaatattcagtgtccgaatttccccaattgtctgttttttagctttatctacggtatttaaaatatgattacattgcaaaacatacacttttaaggaatagttttaactgatctcataggaatgtacttgcagatttctcgtgtatcatagaatcatattcaggtagacttaaaaaagtaaaaagtaatctaggtatagttcaccccatttccttataagcgatggaattgaggctcagaattgaggtttgttcacaattggcgaacacgttaggagtcgagccggaactgtaatacagatcttttgaccccaatctattgcttttataccaattacattggatggcctgtcttagattcttcttttgtccgttatctccaaattactttttccagtggtttttcataaatatcagtagtactaatcttgtgatttacgtcaggttttaaaaggagtttgtgaaagggttgaattataatatcaacacctgagccaaagatattgaattgttctgaaaagctacttgtcttttctgacctagatacacagtttccaactgtggcagaggatgccagaaagagaagaatgaatagtagcaagagcctggaaattaaattactatattactgaaggatctaatgtacttattaatttttagcacttttaagtagtataagataattttcttgtatggacacaatattggtgaatctatgtatttctttttgtaggttaaaacctatttattttgctaagctgaatattattatttttgcttgtttcaaaattggtaatttgttaacattactgcttgcttataactggattgcagattctaagttcgttttgcaaacttacctcattaagagaaataatcgtgtccattctgtctccagatatgggttttgttttgttttgccatgctctgtggtacagaatggcaacagaaggtcttttgagaatcaaagacactgttttaagcttgtttaccaaggtattggtttacccttcagtgttaagtgtgcttcagcagacagaggaggacagagaatatttgaattctttttgtttttgagacagagttttgctcttgttgcccagctggagtgcagtggtgcaaactcggctcactgcaacctctgcctcctaggttcaaacaattctcttgcctcagcctctcaagtagctgggattacaggtgcccgccaccacacccagctaatttttgtatttttagtagagacggagttttgccatgttggccaggctggtcttgaactcctgacctcgggtgatctgcccacttcggcctcccaaagtgctgggattacaggcgtgtgagctaccgtgcctggccgaatatttgaattcttttttttttttcctttctttctttcttttttttttttttttttgagatggagtcctgttctgttgcccaggctagagtgcagtggcgcagtctcggctcactgcaacctctgccttccgggttcacatcattttcctgcctcagcctcccgagtagctgggactacaggcatccgccaccatgcctggctaatttttttttttctgtatttttagtagagacggggttttactgtgttagccaggatggtctcgatctcctgaccttgtgatccacccacttcggcctcccaaagtgctgggattacaggtgtgagccaccatgcacagcatatttgaattcttaactgtttcttggcacattacccctttttccttttagtcagaattgtcacaaaatcggtaaattctaaaaatagtctgatgacctctattactcccttttagttagaagaaaataaatagctacggagtcatgtactattctggtgctatttcatgtttgatcgtggtttaaaggaatagatgccatcttgagctttttaaagatcactgtgtgaaatcaaatatacacctgctctttgatttgtttgtggagacagtgatgtgaattggaaaagatgttggggaccccaattctagggttagttctgcagttacttcactgtgtgatcatagacaaatcatttaacatctttgtatatttgtgctttcacaatttaaaagattattaaaaaatttatctgttctttactgcttttcaggatcatgtgagcattgaatgtgatcctgtatgagaaaatattttgagaaattcgtttgtgtttctcttttgtgccagacattgttttaggtgtgcaatgcagagtaaacaaagacaccatctgccaatggtaaatcctatgcagaaaaataaaacagatgtgctttgggaggggctgctgtgagagaagttgcttttttgtttgtttgtttgttttgtttttttgtttttttgagacagagtcttgctctgttgcccaggctggagtgcagtggcgcgatcttggctcactgcaacctctgcctcctgggttcaagcagttctcctgcctcagactcccgagtagctaggactacaagcgcctgccaccatgcccggctaatttttgtaattttagtagagacagggtttcaccatattggtcaggctggtcatgaactcctgacatcaggtgatgcacctgcctcagcctcccaaagtgctgggattacaggtgtgagccaccgcgcctggccgaggtcgctattttacatagggtggtcagagataggctcataagatgacatttgagcagacacctaagaagtgagagaaggggtgatgtggatattgggggcaaactagcaagtggaaaggctctgaggtgggaacgtcagcaaggatactattgtgagtagagcacagtgagtgaggaatagtgatagaggttgaggccaagaagttaacgggaatcagattattagggccttatagccttaattattgtgaagtatttactcagagacaggaaactattagaaggttttgagcagaggaatgctgttacgtaatttagattcttttttttttttcttttttagggatgggatcttgctgtgttacccaggctggcatgcaatggagtgatcatagctcacggcagcctcaaacttccgggctcaagtgatcctcctgcctcagcctcccaagtagttaggactgaaggcacacgccaccatgcctgcctaaattttttgtagagagagggtcttgttatattgcccaggctgtcttgaactcctggcctcaagcagtcctcccatcttagcctcccaaagtattaggattacaggtgtgagtcaccatgcctggatgctaatgtagattagcaggaatactctggatgctgttgctgagaataaactctggggaagggtttattttcaggtggggaagtaagataactagttggaaggcaatgtataatccaagtgagagatggtggttgctctgaccaggttggttatggtggacgtggttaaaagtcatcagattttattttatttttattttttagatttttaaattttaattttcagttttttaagggtagatagtaggtgtatatatttatggagtaggtgtgatgttctgataggcatacaatggataacaatcacattagggtaaatggggcatctatcactttaagcatttttcatttctttgtgtaacagacattccagttatactcttttatctatttttaaatgtacagtaaatttttgttaactgatgaaggaaagaattctaaagccagtaagacaaaagcatcagataacctacaaaggaaaacctatcaaagtaacagcagacttctcagcagaaaccttacaagccaaaagagattagggtcctgtcttcaacctctttaaacagaacaactgtcagccaagaattttttatcccacaaaactaagttttgtaaatgaaggagaaataaagtcattttaaacaaatgccaggggaatttgtccctaccaaaccagcactacaagaaatgctaaaaggagttataaaccttgaaacaaaagcctgatatacaccaaagtggaaagcttaaaacccacaggatctgtaaaacaattatacaatgaaaaaagcaaacaaacaaactaggtaacaacatgaggaagagaatgatacttcacatctcaatattagcattgaatgtcagtggcctaaactagctccacctaacatacagaatggcagaatggatacagaatccaaatatctgctgtcttcaagaaactcacctaacagagaaggagtcctgtaaactcagaaaagtggaaaaaggtattctacataaatggaaaccaaaagcaaacaggagtagctattcttagacaaaacaaacttcaacaacagtaaaggcaaatatagtcactatataataataaaacaatcaattcaacaagatattacaattctaaagttatacgcacctaacactggaactcccagatttgtaaaacgattactgctagacctaagaaatgagatagacagcaaaacaatagcagtggtagatttcagtacaccactgacagcactagacagatctttgagactaaaagtcaactgagaaacagtggacttaaacgaaatgctagaacaaatggactgatatttagagaacattctacctaagatctgcagaatatacatttttatcagcacatggaacattgtccaagatagattatatgataggccacaaagcaagtctcaataaattttaaaaaatcgaaattatatccagtatccctgcagaccacagcggcataaaactagaaatcaactctagtttgtactagtcaaagaagtactgttctggaagtactagtcaaaaaggaactctcaaaactgtacaaatacatggaaattaaatattctgctcctgaatgatatctgggttaacaatgaaaccaagatggaaattttaaaattctttgaaatgaatgataataatgagacaagttatcaaaacctttgggatacagcaaaagcagtgctgagggaaagcttatagcactaaatgcctacatcagaatttcagagcacaaattgacaacctaatgtcacacctcaaggaactggagaaacaggaacaaaaagctagaagaagaagtaacaaagatcagagcagaactaaatgaaattcaaacacacacaaaaaaatacaaaagatcagtgaaatatgctgtcgcttcgaaaaaataaaattgatagaccatgagctagattaatcaagaagagagaaggcccaaataagctcaattagaaatgaaactggtgacattgcacttgacaccacagaaatacaaaagatcattccagactactattaacacctttatgtgcacaaactagaaaagccagaggaaatggtcaaattcctggaaacgtacaaccttcctagattaaatcaggaagaaataaaaccttgaacagaccaataacaagcagtgagattaaatcagtaattaaaaaattgccagccaggcatggtggctcatgcctgtaatcccagcatgttgggaggccgaggcgggcggctcatgaggtcaggacatcgagaccatcctggctaacatggtgaaacctggtctctactaaaaaaaaaaaaaaaaaaaaaaaaaaaattagcggggtgtgtggcggggcgcctgtagtcccagctactcgggaggctgagacaggagaatagggtgaacccaggaggcggagcttgcagtgagccgagttcgcgccactgcactctagcctgggtgacagagtgagattccgtctcaaaaaaaaaaaaaaagacaaaaaaattgccaacagaaaaagcccaggatcagatgaattcacagctgaattctaccagacattcagagacttggtaccaatcctactgaaactattccaaaagattgagagaaggaatcctccctagatcattctgtgaaaccagtatcaccctaattagaaaactaggaaaggacacaacaaaagaagaaaactgcagagcaatttttgtgatgaacatagatgcaaaaatcctcaacaaaatattagctaactgaattcaacaacacatcaaaaagataattgatcatgatcaagtgggtttcatggcagaatgggtacagaatcgaagtatctgctgttttcaagaaacttgtctagtaggagtagtttaaaatatgcaagtcagtaaatgtgatacagcacataaacaattaaaaacaaaagccatatgatcatctcaatagatgcagaaaaagcatttgacaaaatccagcacactttatgataaaaactgtcaacaaactgttgagagtaggcatggaagggacctaccttaaaataataaaagccgtctatgactaacgcacagccaacatcatacggaatggggaaaagttgaaagcatttccccgagagcaggaacaagacaaggatgcccactttcaccactcctattaaacatagttctggaagtactagccagatcagttaggcaagagaaagaaataaagggtatccaaattggaaaggagagagtcaaattattgctgtttgcagatgatatgattgtatggctagaaagtcataaagactcttagatttgataaacaaattcagtaaactctcagtttgtaatatcagtgtacacaaatcgatagcactgctatacaccagcaatgatcaagcttagaatcaaatcaagaactcagtcccttttataacatctgcaaataaaataaaataactaggaatatacctaaccaaggaggtgaaagatctctacaaggagaactacaaagcactgctgaaagaaactgtagatgatacaaacaaatggaaacacatcctatgcccatggattggaagaatcaatattgtgaaaatgactatactgcccaaagcaatctacagattcaatgcacttcccatcaaaataccaacatcatttttcacagaattagaaaaaacaatcctaaaattcgtgtggaaccaaaaaagagcctgcgtagtcaaagccattctaagcaaaaataacaaatctggaggcatcacattactggacttcaaactgtactacgaggatacagttaccaaaacagtatatggtgctggtataaaagtaggcacataggctgggtgcggtggctcacgcccgtaatcccagcactttgggaggctgaggcgggcagatcacaggtcaaaagatcgagaccatcctggccaaaatgatgaaaccccatctctactaaaaattagccggatgtggtggcacgtgcctgtagtcccagctactcgggaggctgaggcaagagaatcgcttgaacccaggaggcagaggctgcagtgagcccagattgtgccactgcactccagcctggcgacagagtcagactccatctcaaaaaaagaagtagggacatagacaaatgaaacagaatagagagcccagaaataagccaaatatgtacagccaactgatctttgatgaagcatacataaacataaattggggaatggacactatttaataaatggtcctgggaaaattggcaagctacatgtagtagatgaatgaaactgtctatctctcactatatacaaaaatcaagatggaacaaggacttaaatgtaagacctgagacaataaaaattctagaaggtaatgttggaaaaattcttctagacattggcctaggcaaagaatttatggctaagaccccgaaagcacatgcaacaaaaacaaaaataaataaatgggacctaattaaactaaaaagcttctgcaaaagaaataatagagtaaacaggcaacccacacaataggtgaaagtattttcaaactacgcgtccaaccaaggactagtatccagaatctataaggaactcaaatcaagaaaaaaaaaatcccattaaaaagcaggcaaaaggccgggcgccgtggctcacacctgtaatcccagaactttggaaggctgaggtgggtggatcacctgatgtcaggagttaaagaccagcctggccaatatagtgaaaatgtgtctctacaaaaatacaaaaaaaattagcctggcatgatggcgggtgccagttagctacttgggaggctgaggtgggagatttgcttgaacccaggaggtggagattgcggtgagctgagatcgtgccattgcacttcagcctgggtgatggagtgagactctgtctcaaaaaaataaaaaataaaaagtaggcaaaagacatgaatagacatttctgaaaagaaaatatataaatggccaggatacatatgaaaaaaatgctcaacatcactaatcaccagggaaatgcagattaaaaccacagtgagataccaccctactcctgaaagaatggtcattattaaaaagacagagccaggctccgtggctcacgcctgtaatcccagcactttgagaggtctaggcaaacagataacttgaggtcaggagtttgagacaagccacccaacagggtgaaaccctgtctctactaaaaatacaaaaattagcgggacatggtggctggtacctgtaatcccagctactcgggaagctgaggcaggagaatcgcttgaacccgggaggtggaggttgcagtgagctgagatcgcgctactgcattccagcctaggtgacagagcgagactccgtgtcaaaaaaaaaaaaaaaaaaaaaaaaagaaatatgtttcacagcaacttgtatggagctagaggccattattctaagtgaagtatcacaggagtggaaagccaagctatgagtaagtgaaagctaagttatgagtacccaaaggcatacggagtgatataatgaattttagagactcagaagaggcacggcgggaggggagcctgggattaacaaaaaactacacattaggtatagtgtacactacttgggtgatgagtgcactaaaatttcagaatttaccattttatatttcgtccatgtaacaaaacccacttgtaccccaaaaggaattgaaataaaaaaaattactgactgtaatcaccctgttgtgttatcaaatactagattgttttccttctatttaactatgttttttgtacccatataccatctccacttcttccccaccctctcggcctctgataaccatcattctgctctctatttctttgagtttaattgtttaatttttagcttccacagatgagtaagaacatttgaagtttttttttctgtgtctggcttacttcatttaacctaatgacttccagttccatccatgttgttgttgcaagtaacaagatctcattcttttttatggcagaatagtactccattatgtatatgtaccatatttactttattcattcgtctcttcacggacatttaggttgcttccaaatcttggctattgttaatagtgctgcaataagcatgggagtgcagttaccttttcgatgtactgatttcttttcttttgggtatatacctagccgtgagattgctgaatcatatagtagttccatgtttagttttttgaggaaccttcaaactgttctccaaactggttgaactaatttacattcctaccaacagtatacaagggtttccttttctatatatctttgccagcatttgttattgcctgctttttggataaaagccattttaactgggataagattatatcgcattatagttttgatttgcatttctctgatgatcagtgatgttgagtaccatttcatacacctgtttgccattagtatgccttcttttgagaagtacctattcaaattttttgtccattttttaattgggttattagatttttttttcctattgagttgtttgagctccctgtatattttggttattaatctgttgtcagatggatagtttgcatctaatggaactattttcttccattctttgggttgtctctttactttgttgattgtttcctttgctttgcagaagcttttcaacttgatgtgataccatttgtccatttttgccttggtggcctttgctgtggggcattactcaatacagcattgcccagtccaatgtcctggatagtttctcaatgttttcttttagtagttttatagtttcaggccttagattaattctttaatccactttgatttgatttttgtatatgatgaaagataggggtctaatttccttctttcgcatatggatatccagttttcccagcaccatttattgaagaccctgtcctttccatagtgtatgttctttgaacctttgtcacaaatgaatatccactggagatgtatggatttacttctgggttctctattatgttccattggtctttgtgtctgtttttatatcagcatgtgtctgtttttatgccagcactatgctgtttttgttacaacagctctgtcatataatttgaagtcagataatgtaattcctccagttttgttctttttactcacgatagttttggctagtctgggtctttggtggtactgtgtaaattttaggattttatttttttctatttctgtgaagactgtcattagtattttagcagagattgcattgaacctgtagattgctttggatggtatggacattttaacaatattgacgcttccaatccatgaatatagaatatcttttcaatttttttgtgtcctcttcaatttcttccatcagcactttatagttttcattgtagagatctttcacttctttggctacgtttagtcctaggtatttagttttattcacagccattataaatgggattattttcttgatttctttcagagtgtttgctgttggcatatagaaatgctactgatttttgtatgttgattttgtatcctgcaactttactgaatttgtttgtcagttctaatagtttttttggtgcagttttcaggtttttgcaaatatgagatcatattatctgcaaataaggataatttggcttctttccaatttgaatgctccttatttcattctcttgtctgattattttagctaggacttcccaatagtcagattttagatagtgttgtaaggtataggtaacaggatttaatgatggatcagatgtgagatgtgggaggaagaaaggagtcagggatgactttcaagtttttggcatgaacaattaaagggatgaagtagttgccttctcttgagggagggaagaccaggaggagcaaacttgtgtggttttttgttttgttttgttttgttttttgtttttgatgcattaggtttaagatgcttattaaacatccaagtggatgtgttgattatttatttgaatgtgaatttggaactcaggtccatatgaatttgggagatcctcagtatatagatggtatttaaagtctcaaacctagataacattgccaagggaatgttgaaggtaagatagagaagagatgaagtctgagggctgagtcttgaggcacttcagcgtttagaggttgtggagataaagaagaaaaggatacaagggagtaatttataaagtaggaggagaactaagagagtggtgtcttagatggaagccaaggggagtaaagtgtagggaacagtcaactgtgtcaactgttgctgagaagtcaactaagaggaggactgagaattattcacagcattaaataccatggaaatcctaggggaccttgacaagagctgttttgatggagcattgggatgagaggctgattgggatggttttaagagagaatggaaggagaggaaataaaaacccaaagtgtaaactcagttatgctctagaatgagagcagagaattgggctagtagctgtagcaaagcaagaggtcaaggatggtttttaatgttttttccctttttatttttattgatgggtgctattacaacatgtgggaatgctgatagaaatgactcagtagaatgggtaaaatggatgatacaggagaggaaagagagaagaggggatgattactgagtgacatcccaagtaggcaaaaggaggtgggatccagtagagtttgagttcaggaatttgcattagataggaatggggacagttcatttataataacaggaaggaagaatatatggttaatgatgcagcaaggttggcaatttgcatgaagtaggaagcagggtgacctgttgaatatgaagaggtaagagtatagatgtttgaagagacaagagaagtgtgagaaaatcattaggagagtgaggaagtgaatgaacatttaactttttcattgaggctcctacttgcattttaggtgggacagatcttggacacggcaggatattttgcattccagggtcccaaatgccaggattacctacctagtcattcttacaactaaaaaaacttgacttcacattttcacatccctttagaactattgattattgggccttttgaggctaatggtcatgaaaaagactaattagcatgattatgtgatacttttttttcttagttatatttaatggtacatggttaatgatgtggtgtggccaagaggcttggatttaacagggttagagttttgctaggagaaggaaagagaagcagttgctggtatgaatgataaatgatggatcacgtaatttcggttggataaggacagaaatgagggcatgaaaaggatgagggactgtgaaaagtggtagcattagcgattgtaggtcccggtggggcgtgtttgtctaaaataggaaagaagatgagaacattggaggaaaggaatacaaggactggagaagcctgaattttagaagggtcatctctgcggttattaaaattctaatatttatgccagaagtaaagttgagtgtgtcactgagctaagtacagcactaaagtcctgaaggaatgggatagggtttgggggattaatccaagatggagaagtcaaataagtaatggaatttgtgcttatggaggacgagtcagaaattccctgttagtcactgtggtgatgactgccatggaaataatgggaagagatggtgaccttttggatggaacctccttagattctgtggttatggcactctaaggaaggataaatttagggttgaattcaaattctattgagcctctgctgagtgcagggcgatgtactaggtgctgtggagataatagtaaatcatatcattaaaactgagtaatagaaatataaaggaagctgaaaaagtgctggatggctcaaaggaggaagaaattatataaactgaagtattaggtaaggcttcatggaggggtagatttgagatgggcatttgatgaatagaacaatgacaaatcatgatggcgtagtggctgcagtccaggtaagggaatcgtttaactcaagcttagcggtagcacattgcaaggtgttctggcatagagtcattattcccgtgttgactggagctgtggtggtgagagaaatgacaagaatgacgataggaccttggatgccactgaatatttgagtttagtgccagttgcttaggtaattagtggttattgaaggttttgaagaggagtctgatgttctcaaggtaaaattttcctcaatgatgggctgaaatgggaatagtataggagaggataaatccccgtaaatggtaaaacatagtaaaacaactttacacagtggtatacaagacttccaaatatgtaagtatccttgaattattagatatctgtagtagtaaaacaaggattaaaacaagattcctgttcctatgcactatccccctttccctttttaaaaattgagatgggggtctctgtatgttggctaggctaggcatgaacttctgagctcaaatgaccctcccctgagctcaaatgatcctcctacttcagcctcccgacggactataggcctgtgtcactgcacccagccctttgtttgagtttaatttagacatcttgcctcctttgtaatttttcttttgttgactttccaaatagcacagtctcattttcctgccatctctcaggttattccttctttgagtatagttgttcttctccttttgctttttttgtattcattggtacacccactcccttggccattttgtggcttcacataccaaactactgaaaactcccaaatttatatcctaatccagacctctctgctgaacactaggtccatatccagctgccttcttagatgtctaataaataactcaaattcaatgtcagcatgtccaaagctgaatttctgatcttattcccaaaacctcctctccctggcaccttccttaactgagttgctcaggccaataaccttaaagtcaatcctgatgcctccagttccttcacaccccacatccaatctattcgaaatgctgtggcttttaccttcaaaatatatccagaatatgatcactaaacctccttaagtggcctccttccttccactcttatacagtgttttcaacaagtaaccatagtgatcttttaaagatatgacttagatgttgtcattctgtgctgaaaaccttctaagggctccccatctcagagtaaaagctacagtcttcaaagtgaccagaagggccctaaattaggacttgacaaactgacccatgaccaaatttggcccattgcctgtttttatatgaccagtgagctaagaatggtttttatacttttaagtggttaaaaaatatcaaaaattgatattttttgatgtgaaaattacatgtaattcaaatttcagtgtccgtaattaagttttattggaacagagccacacccatttgtttgcatatcatgtatggctacatttgcaccacaaaggcagagttgagtagtagagaccttatggcatgaaaagcctgatgtatttactatctggcactttaaagaaaaagtttgccagcctctgccatatatggtctgatcccctcacccccacctttctgtcctctcggccctcctctctcccccacctcactgcagccactttggactcattattattcttccactgaacgcaggcacgcccttccttaggaccactgctttaactcccctgccagaagtgctcaattcatagacatctgcatggctgttaaccccatcaagtctttgcttaggtgccacctttgcagtgaacccttgactatctgttaaaatggcactccctctccatgtattatctgtgtgtgcttactctgttgcctcctcaacttgcttcctctcttttccaagcatttcacaccttctaacgtactgctaaattttcttatttttatatttattgtcttttgattatttccctcttctggacttaaaccacaagggcaaggatttttgtctgttttgttcactgttggtagccaaagtgcctaggacagtgcctgggatattacaggtgttcggtaaatacttgttgaaatgcattgaatttttggttctttcaacaagtgagtcatctgtctggctgaatgttgttttgtcacataaggcaccagtgattgggaagggctaataactgcctcttttagcaaagggatgtgtttttctgttatccactcttttgattggttattcaataagagcttttccattttgctcactgacagtaaatattcaggaatctcattctggttcgacttagctggctcattcagtatattttaggttcagattatagccgtcgcatcttctttgtacataccgttaattgagaaaagacctttcggcctctgcccattattgcaagccttcaagtgatatggtagaatagagcttttccatcgttataggtgtttttgggtaaggaggaatagccggaatttggaactaggtgaggattttatattagctattgataagtaattgataggtttaaccttcttgcacgtgccttttttttttacatgaaaaagaagcttccagaagaaaatattgaaattcagtgttcttttcacattactattgcatagaaataatgccaccatgtagagaaagttgaatttatttgaagggatttggggagagtattggatttatatgtatttgctcttactttccttagtgtgttctttttttttttttttctttctgagatggagtctcactccgttgcccagggtggagtgcagtggcacgatcttggctcactgcaacttctgcctcctgggttcaagtgattcttctgcctcagtctcccgagtggctgagattacaggcatgtgccaccacgtttggctgatttttgtatttttagtagagacaagatttcaccatgttggccaggctggccttgaactcctgacctcaagtgatccacccatctctgcctcccaaagtgctgggattacaggtgtgagccaccgcacctggccccttagtgtgttctgagttgattcatctttgtattctccatgctaccaagcatatacatacaaattaataggcaattaataaatatatatttacttgtaaatctcacataatttatctttttttctttttttaaatttttatttatttttattatactttaagttctctggtacatgtgcacaacgtgcaggtttgatacataggtatacatgtgtcatgttggtttgctgcacccatcaactcatcatttacattaggtatttctcctaatgctatccctcccccagccccccaccccacgacaggccctgggtgtgtgatgttccctgccctatgtccaagagttctcattgttcaattcccacctatgagtgaggacatgcagtgtttggttttctgtccttgtgatagtttactgagaatgatggtttccagcttcatccatattcctacaaaggacatgaacttatccttttttatggctgcatagtattccatggtgtatacgtgccacattttctttttttttattattattatacttcaagttttagggtacatgtgcacaacgtgcaggttagttacatatgtatacatgtgccatgttggtgtgctgcacccattaacttgtcatttaacattaggtatatctcctaatgttatccctccccaccctccccccaccccacaacaggccctggtatgtgatgttccccttcctgtgtccatgtgttctcattgttcaattcccacctatgagtgagaacatgcggtgtttggttttctgtccttgcgatagtttgctgagaatgatggtttccagcttcatccatgtccctgcaaaggacatgagctcatcattttttatggctgcatagtattccatggtgtatatgtgccacattttcttaatccagtctatcattgttggacattcaggttggttccaagtctttgctattgaatctcacatagtttatcttaatgtgatcttctgggagaggcagtgaggtgtctttttctaattttttcttgcccatatttaatattgtagatgtgcggtggttctttcataatgaaataaagcctgtttatttttacatagcttgttttaggtggcttatattagtattaacaaaattgaaggtttcctagtcagttactgttttgagagtaaatttactggattccataacaaactgtttgcaaaacattacttgggatttttaaagaaagtatttttatattctctctattgcatttcaggaaaaaaaatccctaaatatttaagtttcatagtttgaatatagatagcatagttgtttgttggttttgagatttttatttttatttttgagatggagtctcactctgtcactcaggctggagtgcagttgcatgatctcagctcactgcaagcttcgcctcctgggttcacgccattctcctgcctcagcctcccgagtagctgggactacaggcgcccaccaccatgcctggccaattttttgtattttttagtggagacaaggtttcaccgtgttagccaggatggtctcgatcttctgaccttgtgatccgcctgcctcgggctcccagactgctgggattaacagacgtgagccaccgcacctggcctagtcttgagatttacccaaaaactttgaaaataagtttttgggaatttattcataattgccaaaatttggaatcaatcaagatgtccttcagtagttgaatggataaattgtggtatatccatacaacagaatattattcagcaataaaaagaaatgagctatcaatccatgaaaagatggagaaaccttaaatgcatattgctaagtgaaagaagctagtctcaaaaggctacatatgatatattattccaactatatgacattcttgaaaaggcaaaattatagactgaaaaaacttagtggttactaagggcttgggggtggggaaggtgggaaggtcaaataggtggagcataggggattttcaggggtgttaaactaaaactattttgtatgatactgtaatggtgaatgcatgtcatttgtaaaaatccatagaatgtacaatgcaaagagtgaaccctaatgtaaactatgaactttagttaataataatgtatcaacattggtttatcagtggtaacaaatgtaccacactaaggtaatatgtcaagaataggagaaactatgtgtggtgggtggtgggtggtgtgtggtgggtggtggggagaagaggtatatgggagttctttccactttccactcaacttttctataaacctaaagctgctctagaaaataatgtccattaattgaaaaaagtgctcaattaaaaagtgacacacattcctttatatataatgccaccttctgcgtaagctgttctaaggagtgcatagttaatatttttctaggcttagtttttcagagaaatttacatacatctgatgtataaacaaaatgtttctatttgacattaggaaatttgaggtgtgtttttttcccgaaaccatttattgggtgtatactatttgtaagatattattaggtatttttatataacctgtccatttagtttggagtagatactagtcagcccatttcatgggtgagaaaactctggctcagataagggaagtgacaaagctggtacttgactccaaagcctgtgtgttctatggtcacatagactttttttttttttttttaaatagctgaagtttgtcctctataggaaatgtaagtcctttagagccaaaacagtattaaagaggattgtctagatatgaatcttggctctactgtttactttatggtcttacttaggttgtgttatctgtttatgctttagtttccttatgtgttaattggagacagtaattgagattgttgggaggcttgagttaatatatgaaaagtcttaggaacagtgagtacaaagtctgagctacatacatgttatctactaattagtagtggaattatttctcattttattaagaaaggaaacagagacccaaggaaattaagtgactctttgagtcacataacttctaaggtcatatagctattaactagcaaagttagtttttaaaaaaattttaagaccagaattttatccactaggttgaccttttttttttttttttttaaaaaaagaaaaactcttaaaagctattgtagtttctccatttcagtttagagtaaatcagacatattataaatttggcttttttctcaatcagattgataaatattggggaaaaagcattggtctgtaatttaggtttcagaccatgtcttgtcccttgtttgctgattctgtttcatttttaaaatgagggtagagttggtcagatgatttttaagtttgttttatagcaccaatagaacatacagtgaatatacagtgaatagagatacagtttttttttcatgagttattgcactatgctatcatactctgaagttcccagaggttcttgatggtagggtagttaccccccatgctaaatgactgtggagtgctgtacttttcatattggtgatccatgatttttccactacatctgaagctatttcatagcattgttcttccttttctgccttcaatctattcaattattttgagaccagggtcttgctctgttgctcaggctggagggcagtggtgtgttcatggctcactgcagccccaccctactgggctcaagtgatcattccacctcagcctcctgagcagctgggactacaggcatgtgccactatgcccacctaatttgttgttaatttttttggtagagatggggtctcactgtgttgcccaggctggtcttaaactcctaggctcaagtgatcctcctggcctcagccttccaaagtgctgggattacaggcgcgagccaccatgcctggctggctccacatttttttttttttttttttgagacggagtcttgctttttcgcccaggctggagtgtagtggcgtgatcttggctgactgcaagctctgcctcccgggttcacgccattctcctgcctcagcctcccgagtagctgggactacaggcacccgccaccatgcccggctaatttttttgcatttttagtttttgtattgttaatttgtattgttagtttcaccatgttagccaggatggtctagaactggcttcactaatataaagaaagcttgtgtactttgtttcacttgttgactgaacacatagcaatcgtttttggctgctggattcacagctaaatagtgactagccgaatcccttagaatggagtagggttgggaatgggagatgctgaagactttggttatatagtaaggtatttataggaaaggtaaaattttagtattgtatttagtattatgttacttagatggagcatttttgagatatctcttactgtgggatcatattttgatccctgttttttggttgtccaaaaggatcccatgaattgcagcacttatgcattccttccttaatgcgatatgagtaataataaagtaagtcccatttattagaatctcttctgttaaatagtatcatttttttaaagagatagggtatcgctctgttgcccagtctggtctcgaacttctggcttcaagcaatcctcccgtcttggcctcccaaagcattgggattacaggcatgagtcacctcacttggcctaactgctaatattaagaaactgttactgacaatagggtgtttccttattaaaggaaagatatttaaatgaagagaaagttattttctttgtgagtttatacgatatatggtatgtaaattatgtcctcttatagccacatagttaaagcatgtgctgtattttgatgttctggtttttttttttaatttttttctccttttcttgtagctaggtttataatataagtgtttcatcagtgctcagaaaagtttacttttactatgtctggaataaaatctcataaaggtggaacaaaataagtaacaatgattaggactctggatagaaataatactgtggaaatctggtgagggacatccaggggtaatgaagtcaggatctagtgaatattcaggagtctggcatagcagtgcatacaggcccagggacaaatagggccttttgggagttaggaagtagagccaaaaaagcattctgaattttaggctgaaaaaaattaaagaacaaacattgtgccaacatgtactctttaatggcagtatccaatgtaaaagcatcatggaataatcattggtattgttgtattttcaggtgtctttactgaattttcagatgggtctgagtaatgccaatttctgattgaaaatctaatggttaactgcaacttgttgccatcagtggtagtattactctttcaggtggtgcttcttgactgaatctctttgcaaatgtatttatctcattgagtgctagtcagccagctgccacattgtagctacaggaggcttacttttctggccatatcacctaggctcctgggcccaggccttcaaaagatgtgttagctttttgtttgaactgagggaattttcctctattgagtttatttctttttaatcaggaacatgtttatgggttgcacactcatattggaagctaatagtaaataagcatttttgaagttgttttcctcttctcttgcaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatggtaggttattgtggatattttcataatttagttacaaaagactccagtaatttaaaattagaaatgttaacagtgagggcaaatgaaaaacagtggtgttaatttttggctttagtgtgtcatataaagatggcactctactattcaaagcgaatgaattcagatttactacaagctatgtaaaccacaaggtagggcctcatgagcctgtaggccatgaattattaaaacaaaggaggaaatgctcataaataatattttctaataaaactggcattagcaaactgatacaaatagctaggtttttaactttaagttcagttttttttcttgtggaaattaaaaattctgaaccagtcctttaattagtgatatgaatgatgtagaagtttataatatgtgtgaatgtttaactgaaaaagccacctctttttcatacttttaaaataatagggtcaagtgctgagtatagtaggggcactgaattgagaatcaaagaaaccttgctttttgggaagagttcagacttaaattgaatttgtgatgttagatgagctcatagtctctggtgcctaggcttttaattggtaaaatgtgctgattttttttcccttagtattatgagttctggagggtgttatatgaattttttttctcctaagtataagcgagaaaaggtttcttttttttttttaaagacggagtctcaccctgttgcccgggctggaatgcaatggcgcaatctcggctcactgcaacctccgtctcccaggttcaagcaattctccctgccttagcctcccgagtagctgggattataggtgcccgccaccatacccagctaattttttttatttttagtagagacggggtttcgccatgttggccaggttggtctcaaactgacctcaggtgatccacccacctcagcctcccaaagtgctgggattacaagcatcagccaccgtgcctggccaagattttaaaaacacattaccagtgagagaaaaagcagaaaatattaatcaccagtatgattatttggaatatgttgtttagccggtctgttggtggtgatttttttgattttttgttttttttttttttttttttttttgagacaggatcttgctctgtcctccaggctggagtgcagtgacatgatcatagctcactgcaaactccaactccttgggctcaaaggatcttcctgcctcaagcctcccaagtagcttggccttataggcgcatgccaccacatctggcaaatttttaaattttttgtagagacagggttttgctttgttgcccaggctggtctggaacgccttggctcaaggaaccctgctgctgccttagccttccaaagtgctgggattataggcgtgaggcaccgtgcccagcctggtgatgtttctttaaatgttacttgcttttaaaaatatttgtgccaaggattataacttaatcagctgactccttagagaagaaattctgatattttagatctagattgtgggaacaaatgttaacttgggattttccctgtcattttagttatgtggtgaaatgtgaaaaaaccacactgattcttttatatcttaccatgtgaattatttacctctcattccgctcatttcttatagtcttgatattcttacaactaaaagaaatgctttattatttttcagagtggatgaagatgtcttccttagtttattctttttaaattcagcttagattttctggtgtataaattttgtgtttttatataatttaattgatgagtattttctggtttctcttattacttgctttttagatctcagattgcaatgagaattttctctttctgcatggttcttctgatttaattttttgtctttttttttttttttttttttttttttttttaaagaaacggagtctcactctgttgcccaggctggagtgcaatggcacgatctcagctcactgcaacctctgtgtcccgggttcaagtaattcttctgcctcagcctcctgagtagctgggactgtaggggtgtaccaccatacctggctaatttttgtatttttagtagagatagggtttcaccatgttggccaggctggtcttgaactcctgacctctgatgatccaccctcctcgtgagccaaagtgttgggattacaggcgtgagccactgtgcccagtctgatttattttttcaatacttaaagaaaatctgtttagagcttatttgagtaaataagatttctctgcatttcttcaatttttcctgttactgtttcttttttttttttttttttttttttttttttttttttgagacgaagttttgctcttgttgctgaggctggagtgcaattgtgtgatctcagctcactgcaacctccgcctcctgggttcaagcaattctcctgcctcagcctcccaagtagctgggattacaggcatgcaccaaccaccatgcctggctaaatttatatttttagtagagacgaggtttcttcatgttggtcagactggtctcgaactgccgacctcaggtgatccgcctgccttggcctcccaaagtgctgggattacaggcatgagccaccgtgcctggcctgtcactgttgtttcatggtgcttattctgtcacatccagtagaatgttagatgtaacatttttagatttaacattggcagtctgtattatttgtgtgataaatgacaaatgtttatgtaatgtagcaatacgcagttttgctcaggtgtggccggtgtgcaggactaggtaatttagcaagtacatgagcctagctaacagcctagcatttccaactctatggctcttttgttctctagtacttactttgggatagatgaatatgtctcactaagtgtttaaaaaatttgtttctttgtggcaaactgcaccagttggaaaactggttgtggatgttgagcaagaaagacatctagacagatgatttttattgagaaaaagaaaagctttgtaatctattttagctctgtttttatataatgatagaggttttcaaatgattaccttttcaaccaaagttttctttgctttatagaggacagtgacactatagtgttaatttactgttatccaaaaataatgtgatttttaaacatagataaacaagaacaaaagaggcaagactgttcataaaaaattgagaatgttttagtttgcgatggacttcaaaacaaaatatttaccatgtactaacatataatttcatgtaagtaaagacagtataaccagcttttaaatggaatattttaggctttatggaaaactcactaagttatccttgttcattttgctgtgtattggtataagtgtcttcgtgatatttgtaaatttggaaaaatttaaaggtttttggatgtgtgactcatgagtgtatagaatctactctgttaaattttcatgaaattcattcattttctgggttctggtctgttccactgatctgatatttcattttagttagtggtaccacccttcgatctttgtagagtatttcttgatacccttatttatgtttttccccaaatgagctttaaaatgatttttgttgagatttaagtaaatcaatcctgaggagattttgattgagaatatatttgtaaattagcttgtcattttgcagtatgtatttttcccactctgcatttggaatgtctcccactagtctatttaaaaaattaaaggccttgcaccaaaggtttgaatgtcaaatagtgaacactattttaatgttttttatagttttcttatagtgttcacagataactttttatttcgtattattctatattatgaaatcctaaattctaaaatttaaatagagacctgggtcttactctgttgcccaggttggagtgcagtgacatagtggtagctcacttaacctcgaactcctgggctctaaggatcctcctgcctcagcctcctgagtggctaggactataggcacctgctaccacgtccggctaattttttttatgttttggagagattggatcttgctacattacccaggctggtctccaacttctggccttcaagcgatcctcccacctcagcctcccaaagtgctgggaattataggcatgagccaccatgcccagccctgaaatctcaattttctaaggttagaagtctttggcagtttggaaaggttagaagtctttggcagtttatgagtcactcaccatcctgcatttctgcgactctcttgaagctaagaagtatctaattcttgcagatgatgtgtgatgtggatgacatttgttgaagtagtattcagaatgtgtaggttcagctaaaagataactttattcatttatttatttatttagagacagagttcactctgttgcccaggctggaatgcagtggtgtgatctcggctcactgcaacctctgcctcctcagtagctgggactataggtgcatgccacgacacccagctaatttttttatttttagtagagacggggttttaccatgtcggccaggctggcctcaaactcctgacctcaagtgatctgcccacctcggtctcccaaagtgctgggattacaggcatgtgcccccgtgcctggccaggataacattatttataaataatgccaagagtgactgaagtgaaccttaccaaaacatgaatggaagagctcttgttttctggtgaggagttcagtagaatgggattttacttcccacgctggagcagttttttcttgtttcagtattaactgtttcacagtagacagtcagtgctatgggttggctaaagatatagttgtatatcatctttttcaggtgatgtttcttttgttgaagtaattgttttcgttctccttctaacagagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaagtgagtgtggactgacctctgggacgctgtgctagagtgcacagcaaagctctaaggtctgctggattgagtgtgtgttatgctgttttttggattttgtcttatgcatatgtgagactataaccaaggaagtaaatgttacatggagattttctgagttaaatttgaaaggaaagcaagtaaagaataaagattagagccagagaaagaaaatggacctgcttaggatcccttttgagagaacaccaagtcctttaaaatcattatgtttcaaagttatgatctttttcctgtgttgattcagcctcctaaattttcaaataaatagtagtgtttttgatctctggggagatcataaaataccatttttgtaaggcatttaaaaatccttgtgtagaagaaagagtgtaggaaaatgtattttaaaggtatttttgactgtatctacctcactgattcccaggaatttagcagtgtcttgcatatcataactgctctttgtatatttgtggattggataaagatctaatgggacccacacccctcaacaattatagtagcatattctaagtgtgacaataatagattagtgaaactgaaatggtacctggagttaggtcattaatctttttatgccaggctaagcttaaagttactgttttgagcagttgtcacaatgattggaataagtgtctaactttgaaagatggagctcatttgactatactctatgaataaaaacattgctttggctataatttgtaagtgaaagaggttacagaatttttgcagcttttaactttaaatcagtgtgataagtaaataataataggaaagtattgataaatggattttcttcactgaaagatagtataactttttttatcttcagatcaaagataatcagtgtgtcagttttattgctgaagagcacaatttttttaaactatttacaggcagtttatacattgtgtctggtcatggtcttgtcactgaaggttcttggaaatgtgtaatttttctcatatatgatgtctgtacaaatgttactgttagatttggaattcatgttcattagtaatgttatctaattatttagttctatatgtatctcagctcctgtgcaagttaaatagtcacgtattccagatttaagttgcactttgctacatgtttatgtcatgttaaaaatttttttattgtggtaaaatatataacataagatttgctatttttactaattgtaagtatacatttcagtgaagtttatgtctttttaatacattttctaattttgtttcttctcaagcctggcatattttggaaagcactcctatagacttgcttaactggatgaggtctgtgatttaaagacttgtacaggataatatgctccatacttttatttgaagttttatttttatttttatttttttagagatagggtgctctgttgcccaggctggagcgtagtagtgtgatcatagcttattgtagccttgaactcctgggctcaagtgatcctcctacatcagcctcttgaatagctaggactataagtgtgtgccatcatgcctggctaatttaaaaaaaaagaatttcgtttggagagacagagtcttgctgcattgccgaatttggtctcgaattcctgacctcaagctatcctgccttggcctcccaaagtgctgggattacagacatgagccaccatgccaggcctggattttatacttctgtgtgtggatgctcttggttgtctatgtacagtctttccgttttgtggaacagtccctgggtgagcccttgcctatgatccttcccatgtggtggaactcaaggagtgcagaatgagattctattcttatatcagaggctggcatgtattccaaggacagagttgtgttctggtaataaacatatattgtgcacctggtgagtgttaaccactctgaaggacacagagatgggtggggggtagcttgtatttattaagcaattaagcattttccattgccaggcacggttaggcagcttttacctatgctgtcttaatttaacttaatgctttacctttttcaaaatggattcaaaagtcaaataacttatacaaggtcctacaatatgtattattaggaatattagaattctgtttttaattttaaattcacatatagtaaattcaaatacattgggttgcttgctttacaataactgctatgttccaatttttaaattgaaattcagaactgtttgaattaggaattgattttttgctcaatcatgctgtcttctacctgtgggctgataagaccaagtatatcataattatggtttagaatttaataactgagctaataacagctactgtttattgagtgccaactattgtaccacatacttttcctactatcttgcagcaaatctaccagtctctaatattattatcttcctttctccactcctgttttacttgtgaaatttcctgtgctccaaacttgcttataaaaaaaagagtgactcagaatcattaacaaactttaacttgcttaaggctacttagtaaatatgtgtggttgaaccaggactcatattgaagtttctctgactccagatccagttttcttagcatctattcttcagtttcctgtgaataacatgtgaaagtacagagcagggagagacgatgatgtgctggttctggaaatctgcaaaagctccatgaaggaggtagcacttggaataggctcagaggatggataggggtagggttttggcatgtggtgaaagtgaaagaaaaaaataaatctcagcaccgatctaggtatgagaaagtatagaactgtttaaggaataataactgttgtttattgagctgttaatatctgttgggctctggccaaagtttgttaacatatattctcactaccactctgtgagaaaggtattattcctgttttacaaatgaggaagcaggctcaaaagaagtcaagttatttgaaatttgtccaatgtcacacagtaagtagcagagccaggatttgaaccaggaagcgatgtcattttctaaattgctttccaatatggtaagtgtccaagtgttcagtgggacaccaatgaattagtaggtagagtgttatccaatcagcgcctttggaagattattctggttgctgtatacagtactttggagatgacagaggtcagaaaggccagtaaggaggaggttattgaggtggtctacgtgagaggtaataaaagcctgaagaaactggtttgcaagtttgatggtgattatagagggataatttataaaccattacaatattagacttggaagaatgagaggacaaggatacagaggaagaagaaatcaaagatgactgattctctattgttaatatcagacaattgcctacacttggtcacctgctttaaaatgctttttatttctatatttataccacctttaacatttttcattgatttaatgtttattgaatctctataagtgtgccaggcactgaacccatggctggattatttatcttcctttctagtttccactgccacaatttgtttctcttccttctccctttccattttattctcaactctgctgattcttgcccaactctgctgattctttgcttatagctagaatgactgtttcccatctaggtagatcaagattctgctgaagtcagactttcagtttgccttgcttgacatctctaattttgacctctcccttttctgaacttgggaagcaatcatataatgtaagggacctgaatgttgtggtcaaaacaacttaggtttgaatttaggctttgccattttactttcttggtgaacttgaacaattaacttttctgaggctcacatttcttgtcttgcaaatggaggcttgtggtgagatttaaatgagaatatgtgacacctgtttgtgctcagatgttactttctcttccccttttaaatagggcacttaaactgttactgcttttgttgcttaactacagagtaagcctcaggagcaggagagactgtaactcctgtaaatatgtttgccatacccaaacacttgcttatttgttgaaagacggttaaacttagttactattttcatttgtgattaagggaaatgaaccaataagaaacttttagaattaaaatcaaggatagatgagcacctttcttatgcaccatttatgacttgatttctttgagtgtttgctcttttagctactcctggatttggaatgcatatgctggcagtttatctttccttccttagctctatacttttatcacatttttctgctttccccataagctgatatagaaagggaggcactttagaatgatatagttgggaggaactttagctcatctagccaatagtcattttactgttgtggatactgagtcagcaggcactacgagtagaatccaggtcttttagatttctgtgctgatgttctttcccaatatacagtggtattcatgttcctcacaaattgcctaattactactaacacagaaggaagtttatttttattttttgagacagggtctcattctgtcacccacgctggagtgcagtggtgcaaacatggttcagtgcagcctcaacctcctgggctcaaacaatcctctctccattgcttcttgaatagctggcactacaggtgcatgccactacacctggctaattgttttacattttttgtggcaacagggtgttactgtgttgcccaggttggtcttgaactactgggctcaaatgatcctcctgccttgacctcccaaagtgttgggattacaggcatgagccactgcacctggccagaaggaaatttaaaagaacaatttgaaaaaatatttaagagaatacagtatttttgagttttcttaagcaatataaatgtagtaaagaattacaagatctgtagtatgaaatacgttccccattgactccttgagggaagatagatactttataagcctcaaatctgaggcttaattttgtggatacttggatgtctggatttacatactcccttatcagtttgtaagagtattcaggaagccaagtgatgattaagttatagtttgggaaataggttgtgaaagtaatcatgcagacttttatttttagggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcaggtgagtacagtttaactgcacctctaggcgaatttgtaaaaaggtgaaataggtagtgactttgaaaaaattattaaccagaattgctaatagctaataggatagacacagacaaaatgagtactgctactctgggtcaatgactaattcatcacagttaaagcaaacttctggtgatttgtactcaggatatatttaccaaattaagatggccattaaggtaccatcttaaacttttccgttgtatcttgctgagaatcttcattttttccaggctaggtctcaccattataaagttcttggaagggttggtatactgcagaaaagaattggaagattgaaaacagcctagatactttctagcgactaagagactttcttatcaacgagagactttcatagatagtaatttttaaaactgaagactcagttaatttgccacctctttgttctgttaatggaaattactgtttatttcttgtctccaaaccttttttacactgggatgcatttagaaaaatatgatgctggcatgttccctggaggatgctgctgaaggctgaaggctcctcagggatgaaggtaaccattctggggttctggtcattctaggacctgccctgccagcctaccccaaggactcattgcatcactgattgggagtctgtgatcatcttcagtttcagatgcatattgtctgtggtccaattaaattacagcttttgataattttatattagtttgtcttcatatcaatgccacagaaatagatgttggcctctaagtccaaacttgtgaattgttgaatgctccccaccaccactcactttttaaaatttagtttcttttatttgtatatcttttaaaaggggtctttttttcaagatgtatgaattctaagtttgtttttcttagctttgttactagatcattttctttcatattcactagctgaccctcaaaaccatctctgattttttagtaccattcttgacactcagatttattttactgattggcacattctcctgtattaattttgggggcactatgttatcattttgtcttaatatatggtttttaaagtgacagaacatacttggcttttccactttcaattttgatggagaaatgttttctggtcttttatagggttgaatctatttacctttccctcccttttaaaaaaatccttttgtgatcatttggaggaaggagagtggaacatagctttatgtattaaacatgcaataaagctttacaaagtggaaagctaattaatgggctttctggctaactatacttgtagtttattagaatattaataaagttcccgtttcaatttttattttgttttagcatttaatctgtatttctgctgttagtatagtaaacatcgttactcttacatgtagaattatcagaatcagacatactagtggctttttcacccacctcaccccctttctgttcctttcatgaatcttgtttcttatgagaatgatcatattcctcatcctcagatgttgcagcattgaaaaagggttgagaaccagtgcaacagtaaatcggagtttttattcagaaaatctatcacatctctcctgttttgaagacagagaagattgggccaagctttagttggcattgttagagctttctctgtgcagatcacaactttgtaaactccacattgtttctctcttgagtgagggtctttatttatgagcatcgcagtttaaaaaggttcttgtctagttagcaagtattcaagggggttaccctggagggtgtacagggtatacaaaccatctcaaattttaggagactgaagctttttaggctaaagaaactaaaaaagatataaatacctttaggtcttcgaaatgctgtctggcagaaggtaaaagaggtgtgaactcttaagactaatggtggaaattaggagaagtatctttcaatttaacatagctaatagatttctccaacaataaatctatgtttgggtaaagatacattttcttgtaaaatggggatgatgattgtacactaatctcagattaaaatgtatacatgtacacacatgcccacatatatacacatgtgtgcaagtgtattgttactaataatattcatgaaattaagtgtgacttttacaattaaacctttctccccgagcaccctccgcccctcctgccctgcccagttttcatggtgtttgtgtggaaaaccagtctctgatacgatattatttccttatggaccaaaaatctttttcccgagcacttaacatagcaaaactttcagttatctaagtacgttagttagctgaggttttaccttaccttttctcttcatactctttcctaggatgcttttagaacttctttgagcaaaggaggaggaggatgaccaaaaccagaaatcacttaaaattactctagcacaaaatgcatattatgtttattattttgggtgtgtcttatggtgatcgacatgcataattgaaaaatgaagttcaatttattctttgatagacatctttaatgctcttttagtgacaaaatgaatgtgagctgttttttgcagtttctttatattctggttcttttatctacgtatggcctttcccttccttggcttcctctattcaaaagtaggataatgagttttccctttcctacttttttgggatcgtttaatggtaaaatgctatttttacataagtgactttgaattcttttaatacacactgatgagcagggacttggtagtgtccctattcagcctggctactgtatgtcaggtaatagacactaaatttcaccactaagaaaaaaagccccgtgtaacttattttaaatcatatatttaatgtataataatatattaagcataacttaatatataattctgatcaggtgattattttgtgggaggcccctacctaaattgtacgtttgtttatatttgtatgttaaaagaagcaatgtaggttttctgtagatgtcagatgacttgacccatagtggtaggtcccattggaagatctctgagacctgttgtcggagaagggaagaagttatttgtttatactcattgtttcctcctggtcagtgactgtgcagagatactttttcattcatgcttatttggtgctctttaaaaagctccataatcctatattcataagtttttgccaagtaggagttcctgttcaggctgctctacaaaaagagctattgttttggagagcagtcccagctatttcttattttataatagttctctgtaataattttaagaacaacaatttaccatttatcacatactgatgctattggcattttactttcaaatattagaatggttttaaatattgtttcataattgtatggatggttgacattgtggttgctttttaaagaatggagaaagagggttttcttgtaagttgggaggagagaaaagtgttatccccagtaaagaactagttacaggctttctttgccctttgagcacagtaatattaatagtaacattcgagaacttagtacaagcattgtttttttttcttttgaggtttcagtctaattaactgggtgattttgaaatcttggtgactttcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggaggtacacatgtatatatatatatatatatgtatatatttgttgttgttgtttgttttcttcatataaaagctatgttaacaatgttttatggatttaggaaataacagccttcatttgttttatgccactctatttaatagtattttaaatggctttgtttctacataatcagtatattttgcaaaaatgtatgaattcaaaatataaaatgttatttcaaaaacttgtgcttgtcttgttggttttaactctgctttaatttttataccatttgctgttctgttttactttgtctagtattgcattaagttattgctatcagccaacttattctatgtattttggcttaatggtcggatttcaggattaaatgtggtccaaaacagaattgttttcaaatttactcattgctccaaaattacttgcatcctggttgggcatggtcgctcatgcctgtaatcccagcactttgggaggccgaggtgtgtggattgcttgaggccaggagttcaagaccaacctggccaacttggcaaaaccccgtctctactgaaaatacaaaaaaatcagccaggcgtggtggtgggcgcctgtaatcccagctactcgggaggctgagacatgagaattgcttgaacccaggaagcggaggttgcagtgagctgagatcacaacactgcactccagcctgggtgacagagcaagactctgccaaaaaaaaaaaaaaaagaattatttgcatcatattgctcttgacttctaatagctgtataatctcataagatttgtacatgtctgtgtctagatttgttttatagtgtaagggatgtaaattgggggactgaatttttttaatggataatgtttagtaaatttttttttaggaggtttgtgaccctgttaacattttgaatatgatttatgtgagaatcatgctttaaactaactttcttctgaagttaagaagaattgctgtctggcagcgtcatcctcataaaagtagagaaatgtattcagttattggtagttttgagaagttcatgatggaattgtggtgggcttctttttctgatgtttttatcctgtcaagttagcttgtttctgcctctcattccctagaaacttgccaggtggtatttctcctgtgtcaaacctttgaccagctggctactctgtcatgacaatttagaggcattgcagcctatctgggccagtggggactccctgttgctatttttcatcaccagactttcaacaagtcccattgcttactcccttacctgaaataccagtgccgcagtaaatattggtcagtttcttagtttatttcaacttggtgataagggtagagaaaaaggtaccagtaaagttggagttttaatttttgagagacatgactcatagaatcacttaaagtaaaagtgatagactctttttaaaaaaatgctttttgggataactaaaatcatctatatcataactcaacagatataaaccagacacatttatgagtcatattttaaaatcaaagggcatccaatctataattgagcttatgcctatgcattaaaatttttttgctgtatgtagtatctatagcacctctgaagaaccaatcttaaatggcttaatttttttaacagctttacagttcaccattaactgtagaactataaaatgatttctgaagtgtcaagataaatgttaattctggtaagatgtgttctacttgaccctctagtataaaaccaaccatttctaagtagtgttgtaattataggtattattaaaaattatttgagtataaggagatgagaaaaagactgaagttgccaaaggctaagttaattacatgtttgcttgtatctgtcagcatccctttcattttttttttttgaaagtattaagggaacatcagtcatctttattccttggttttgtgtacttatatgagattttgtcatagctttcagtgatacctttaaacttagcctgttgcctttataactttaacttctgtttagagaagctgaaaacattcttagtatattgtactcttgctagaaactattatagaatagattttgtaataaagtaagagagtcatagtctctcttcaaggtgtttgagttactgaaggatccaaagacctctatgagctgaatctcatcagctgttatatgggatcaggtaaggtgaaggaatcagctttgatctaatgttttacacatcttacttccttttttttttttgaatggcagaaagatttgctttgctgttgtccttaacatcccagccctgttgactcacttgatatcttttataatttgctcgttttttctaacttgggctttgtcaaagacaatttttgatttttgttactggtttgtgtattcctgggcaacttggaggatctggtctataattacgcacttcagacctgggctgtacgattctgttttctcacactagacagctgctcatccccttgatgcagttcttttcagctgcatgggataaaagcacaagattcattcaggtcccaggaatttgtggggctgaaagttacccttttttctcctaatttatacttttttttttctcaaagttaaaaaaaaatccattgtaacttttttcttggagacattttcctgtagtatctcaactttccttcacctacccccacccaaacaaactgttcacaatacatacacacctcacatctttcttttttctgtcttaacttgccacatatttgggtaaaatctaaaaaaggaagaaaaaaaaaagagtggttgagagcagacagaaccagaggactggggcatgaaacttatttcctcaggattgtgcaatggatctaactacctactcctttcaaatcacgatttacattttaaattgccataatacagagtgaatctctttggtattgtttactgtttcataggtaagtttcctcctatgttttccgttgtctttctgtattctaaccctttacttgaacgccctgtagaataaccatatccccattactacgtttcctgctaatgaaggcatagaagcacagatcttggtgtgcagcagtctttcgtttggcttgtttttttgttgttgttgttgttgttgttgttgttgttgttgttgctggagacagtcttgctttgttgcccaggctggagtgcagtggcatgatctcagctcactgcaacctctgcctcctgggttcaagcaattctcgtgcctcagccccctgagtagctgggactacaggtgcatgccaccatgaccggctaattttttgtattttagtagagatgaggttttgctatgttgcccaggctggcctcgaactcctgagctcaggcaatttgcccgcctcggcctcccaaactgctaggtgtgagccagtgcccctggccttatttgactcttaactccattagttgctattgctgtgtgaccttgggtaggtttcctcgttttaaattgtggattataaataccttagaaagttgttttaagtgagagaatttatgtaatgtgacttgtacaataactggcacaaagtagttgctcagtaaatagtagtagtcaacttattgaatgcacctactcaaactgccgtaacagtgaaaataatgtgcacatggtaggtcaaaagaagtcaacccaagcacagttaaactcttaaacacccagtgatgtatagtattagaatcagtatactgatttatgcagtgctaataataaaaacctggtatattgtatagcttataattcaggtgtctttttgcctgtcctttatccttagcacctctaagggtacctaatacgtagtagatgattttttaaaaagccctataaatctgttaagtgaattaacatagtcagcatattgtctgattaaataggactctccagtgtgtaagaagtattaatgggcatctcatagctcaagtaatatatattgaagattaatctctgttaagatatttttataacctaccatgtgataagcacttcctcacatatggtttattttaaaagccctcacatggccctatggggtagctaattgccattttataaatgaggaaaatctcacattttacccagctctcctgactctacgtctagtatgcaggccacttcccattattgtctaggattactgcatgagtggttaggctgatctggtcattctgagcttcacacagagtctcaatttcttttggtgcttgtgattttaaattagaaatatatttgctattgaagggggtgataaattatctgcttatttataatgcagtttgaaaccaggtggataaggaaactacagagacacttgtggcttagactaagagacacctctctcctcagtactggggtggattttcagggactgtcagagaagttgcctcagagtcccttcatattggtgccagtgtgaactcgcccttcttggcagaaattcactagcatgtgtcttgctagggtcaaggcagtaggttttacagtacagccatcacagctgtgataatgatgggctttattttcctgccttccctagtttctggatctacgttatccagggcaaacttttttttttttttttttttgagatggagtctcgctctgtctccaggctggagtgcagtggtgcgatctcggctcactgcaatgtccgcctcccgggttcaagcgattctcctgcctcagcctcctgaatagctgggactgcaggcactggccaccacacccagctaatttttatgttttcagtagagacggggtttcaccatattggccaggatgatctcgatctcttgaccttgtgatctgcctgcctcggcctcccaaagtgccgggattacaggtgtgagccaccgtgcccggtcaatccagggcaaacttttaggcactgtctttccagtggcagactgccactgaagaaaagtcataccgagtgacattagtcacataaattaggagaacagtgctttctctgttctaccttattgctacatttatctgtttatgttattatgtgcctgtgttttgcatggacagtggtttggggcatgtcttctctccagaaagcttcaaggaattgagagagaaggggctgccaggatattcttaggctaattagaaaattctgtcagcatagacttagtagctcagtttcatcctgattgtcaaggagcccctcatgatactgagctcaattattttaactttgaagagcctaggttccagacatataactcctgtttaatgcaatcatgttttgtttttttgccagccccatctccaggctggtgttttgttaacagggacagatagctagcttgcatgtaaggcattgagagaaactgaccaacatttcctgtggtatggtgtgattctggtcactgatttaacctctaaccaaatgaacatggttaggcatagtagactttctagtgcttctgttgctagaatgttgtatgtaccttcatgccctgatgctaggttactgagtaatagattttcttaaaagctgtatttctggccgggtgcggtggctcacacctgtaattgcagcactttgggaggctgaggtgggcagatcacctgaggtcaggagttcaagtccagtctggccaacatggtgaaaccccatctctactaaaaataacaaaaattagcagggcatggtggcacgcacctgtagtcccagctgttcgggaggccaaggcatgggaattgcttgagcccgggaggcggaggttgcagtgagccgagatcatgccactgcactccagctgggctacagagtgagattctgtctcaaaaaacaaaaaacaaaacaaaaacaagcaaacaaaaaaatgctatatttctttgcttttggcatttttgtcaccttccaactcctgcctcccatgctgtttcttatctgtttcactggtcattctaggagataatgaaatggctcacagttctattgtttctaattaagaactccaagatgtgttatcaggaaagttttgatcctcctcaaaatttaaacgcctacattaaagttcagaaatattaaagttgagattctgctaccaagggtagcagtgttttcccagcagcagctttgcgattgccacattaaatgaagttttttcaaaggaatgaaaacatacataaaactgtatattattaattatataaaggaaacaggcaatctatgcttataaatagcactgtactaccatatgaatttgtattgttttaatattaagaactttgaaaaagataaaatgagatgaattattatatctcctctactgttttctacctcctgaatattgaagccattttggatcttttgcttttctgactatcagagcatgaagaaacacggtcattctgatggtgatggaaaagggaacctggtgcaagtcttctgttcagtgcctgtccctttcatctctttttcatagaatgtgttgtcttcaaatgttgactgtctgtagcaagccagtgtctcagttttctaaaataagagtttgtggttacaatctgactttgggatgaaataatttatcaaaatatttttgccattgtctcccattaaaaatatctgtgttacaatcagagtaagatgctaattacaacctctgatccctggatgaaagtattagaaagtacaagaagaattttggcttgccttgccttttcctatcctctgtgttacttccctcttccattgtctccctcttcctgacattcctacttggtaagatgatggaataaaatttagcttgtcatagtattcatttaaaaattgacatcttaaaaaacaagttccatactatttattgggattacattacttagtagttagtcaacctttgttacgtctaacttttaagagaatgtaaacattcatttacagtagtttgttttatctgatatgtgagctttacacagatgcttgtattgaccacagttaagcattttgacatagaaacattaaagtgagctacttgtatattttgtatcactataaagacaaaattgagctatatcacctatgaaatgaatacccgtggtacatttgtttatatttataaatcagagtaataatcctttttgaggcttcccattttatgagtaaaagggagtaatgaaacattgtattctgattttgttagcagtggttaatgggaaacaatgcaaataactggtgtagagctcacctggtcagaaaataagtgtgtagcacttcagcctttacagtgtcatggccagtaaagagaaccacagttcttcctttaatagatttgtttcctattggcattatgccttttttaatgacatttcatcagttagaataaacattggctgggtgtggtggctcatgtctgtagtcgcagcattttgggaggccaaggcaggcacattgcttgagtccaggagtttgagaccagcctgggtaacatagtgagatcccatatctacaaaaaaattagctgggtatggtggcacatgcctgtagtcccagctactcaggagggtgaggtgggaggatcgcttgagcctgggaggaagaggttgcagtgagctgagatcgtgccagtgcactccagcctgggtgacaaaggacgaacctgtctcaaaaaaaaaaaagaaaaaaaccacagaataaacattgattgttgtaataggatcctctgataactgaagaaatcaaaaagtatctttgttattgtctcccatttagaaatatatacattgtattagttggcccacacaaatgcgctacctctatccgatgttactatcatgataatgctgggaagaagtgttagtgggctgtcttatatttaagagaatccttaaaaagaatggtaaatccgacttaattgtattaaacaaagaattattactcaagaagcatttgcatattgtgtgcatttatggaatgtaccaatcccaaaagtttaaaagcctacttttcagtagcttagaggagataaatttggctgtctaaacttgactttagtgtcatgtgacatcttctcaaatatggatatttgctgctttgggccatttaatccaactttaaattattaaggcaagctgaatagccataattaaatagtgttctttgttgctttttatttttaaaaggcatgtaaaacttgaaatgtagttcactgtattttatatttgtaattttaataattttggtttagaatagggaattccaaactgatacttgagttctcaatcatggggtggagtttctgttaatggttatcttgttgaattagtttatctagtgtaaaaaaattgtcatcctcagtttatttttagtatatctcattgatatgagacataattgatttccagttttccttaaagatggttagagattaaaatttcttctgttaaaaaaattgttaatgctattggtcccagatttcccttctttgcatcctgccaaaggaaaaagtgctctgtacttattttgtgccctgtaatgttatagatgcttaataagatcccagattttaagtagcagctgtcattgatttgtttactgaatgaatttttcatgtttcattgtatttgtgcacagaactactctgatgactgtttacttaaataataatcatagtgcacataatttttttaaaaagcaacacagccaaatgaggaaattttctgggagtcttattagttcactcaaatgctgttattctttttattttttattgtttgataatttgataggaatcgcttggtcaaattgtatttgtctctctttatcccattttactgttagaaaatgtttcgatgaaagatcctccggacttattggacaggcagaaatgcctgaacgccttggcgtctcttcgacatgccaaatggtttcaggttggctttttcttactatcttattgttattaaagtttgtccaagtttcatttggaacacctgccacttaattggtttctgtgtactacataaaatgaggggtgctttctagctcatagtgtggttgttggagtaattgagttaatttagatatgtgcctagtatagcttctatagttcatgatgttttattataattctttttggcttagtattctgaatttcagatggttgcttataaaatcaaacatgactgagaaaagctaaaggttaaattaggtagttgcctggagtggggttgccatgagactacgaaattaattttaatattatggtccttttatttttaaaatgtacctttttaagccttaattttactacttgtgattaattgatttttttgtttgcctgataactgatgaataatttgctacttagtattcacttgaaagaacttgcccaaaatgaagaatagatctcaatagggatatctggaatcattttgtttgttttaggcaagggcaaatggattaaaatcatgtgtaattgtcctccgcattctgcgtgatttgtgcaacagagtccccacatgggcaccattgaaaggatgggtaagtacttaaatatggctaaaagcaaatttggaagctgtagcagagaaaatcctgtagaaatgagatgttactttaaaatggctatctcctaagttagctaaggcatgcattatgtatgtttgccatgaaaaaaaaataaagcatctttttaagcgaattcttcttttgtgcatataacttgcctcttctacctcattgtattcatgttacagagcttgaaatattttttgctgacaaaaaggttttataccttttagaagtgagtgtcttcttacacttgactttgcactggtggttaatcacttagtgttcacctgctgcccacaaaagtctccttggctgacccacttctcttttggtgcccccttgcattaccatgaaaattacccaataggccggtataaggatcctatacctctgtagctttctctttgagtggagacatttacaaataagttcatgttagtaattaaagtcaggcaaacagtacacttaaccccatatggatatcatttatatatattgtaaaattgacttaacttggaaattatgcctgctccaatcaagacaacttaagaacattataaaacaatttaaataaagccgtgaaagatcattttataaatgaatgtagcaatgattactttgacaaaatatgagttcttagtttattgaacatggacatttggtcgtttgtttattctaatggtaatacttgagacaagctgtctgaaacgaagtcttattattatattgaaatatttgtggtttgtgtgcttcctaagtgggagattaagtgggctgggttttgtacactggctagttattagctattactaacttatatgaggacttgttaagtctttattaaatgaattagagaccatagtttctctagtgatcctttctgggtaaataaatgtaaagtttttgttacaaaaatgtcttctgaagatacgatcttaaaattgcttgatttaaaaactcttcccagggtaaaggttgataatcatggggaaaatgttaagtgggtcctaaatgttaaattgaatttcactctttggcctcccttgtagatagaaatgttagctcacatttaactggaatccttttaacacttggtgcatgtactaatttgtaatttaatatcttctagccactagaacttatatgtgaaaagtctataggtacttgtaatagacctttgggcgctggggaggccttgagacgagtaatggagtgtttggcatctggaatactacttcctggtaagggtttcaaactctggaagcagaacaatcagcaaatctcagtttagtttatttttctaaatatatgctaagtttgttctctacacaggaaaatgatgcataggagttcttttgcttggaattttgacaactagaatgcgtgttggaaaagtgctataaaactctttttcaataattataatttgtgttttatatgtactaacataaagggtactaataatatattgtgtctgctttgaatttgctttacctcgaactctgaatttgaaattgcagatgtttagttaaaatgtatgaagttcattctgtttgtagtctggttttaaatttggaaaaattaaatttggtcttattttccatatgtaatcccttttaagatttgggctgattcattgtgctgtttctaaattctcagagtaagactcagtttgggccttagatatacaagtgacttccagtataaaataaggacatacaagtgctaacatgttgaaaatgagagtgtgtcctttttactccacttaactgagcagacttttaacttagttcctcagttttttttttcattttctcttcattctccccagccatctctcttttgttttagtttaccgaattctaaactcagttctaaatgatacttgtgtttttcctttgccaaagggggtcctggtcttcatgatccttgtgagcgagacccaacagatgctctgagctatatgaccatccagcaaaaagaagatattacccacagtgcacaggtagaagattgagcatgccactctgacttattagtgaaataacataacttaattttctcaattgtgttcaaacacttttttcttgtgtgttgttagggacttctgctgttataatgtcagaatttatgagtgtctttttagctagatgttctaagggctttatgaatggctattgaaatgtgattaaatataatactttgttctttagcatgcactcagactatcagcctttggccagatttacaaagtgctggagatggacccccttccatctagtaagccttttcagaagtattcctggtcagttactgataaagaaggtgagcatggaagttttttattagggttgggggttggcactggtagagataatcatgggattcatctctcattacaacttagggaacttaataattgtgcatccaaatcatatataaaaagctttcttcctgactgatataggttggctgtgtccccatccaaatctcatgttgaattgtagttcccgtaatccctaggtgttgtgggacagaccggtggaaggtaattgaatcatggaggcagttacctccatgctgttgttgtgatagtgagttctcacaggatctgatggttttataagaggcttttccccaacttcactctgcacgtctgccaccatgtgaagaaggatgtgtttgcttccccttctgccatgattgtaagtttcctgaggcctccccagttatatggcactgtgagtccattaaacctctttccttcataaattacccagtcactggtatgtctttattagtagcatgagaatgaactaatacaataaatagaatggaccaatacactgactttcttctcttctgttcttattaggtaacgtcagctaatgtaacataatcatgttttcttattagtgactaactcatttggctatgttggccagatgccattactgcatagactatactttcagaacccctggtctaaggagaagaaatcagcgataagctaggaggagacgttatcactatcactaatcagtttgattatctttctcaagcttggaaatgttatctaactgagaaagaaagaaaaatacagaggagaagaaaagcatattggaaaattcaggaccatcttccatttgtattagtctgttgaattcagagtttcagcagaaaaaatgtaggttttgggctcagtatgacctgggttccaatcatagctccaccacttcctagttttaggccttgagcagttagctcatctctctcactagggatattaccctctttcttatttttttgactcttgtccggttaaaatgcctgacttgttgcctagaatacagtggatactcaaatgtgaatccacttactgccttccttaggcctcaaaaatatttttttttccctccctttctcttcttttaaactagaaagtggaatatttaataccggatattcttcacctggaatgcagcctacctctaacaatggaaattactctacttttagatatcacaaaaatagtgcagttgcccagtctgtttatttagatgacagaattccagtgggtctgaagactttcagagagtctacaacatcaaagctgttgaatagtaataataatattaaggggtttttttttttttttggcctttttctctctttctttcctaagtgtatagttttccagaggctacatgtgacatgtgatgagatcgttgctctgatggctaatggaatgttttattttctatatccttgtgtttaaaattgttttgttttatttttaatatgctcaatattgacagatattacccacaaagcatagcacttcgggtgcttaataattttttaagagtgtaaagtactcctgagctaaaaagtttgagaatcagtgcctcacactgtaaactcctcaggagaaagaatcctccagattctaccctatgattattataaaccaatgcttaatattacttgaggaatgaaggccattttcttcctgcaggtgcttgcttagtggtgaagaaattattgaaagggatttacatacccatgtgacatcaagcattgtctgtgcattgaatgattgaataaaaatgttatatatatatttagattcttatgattagtatcagaaaattttatttcaatcaccaaattcacaaccactctttcggttttatattttccccttcactagatagtaaaagtatgtttactattatgtgacttagttttttttttttttaactttaaagatctttctcaaaagtttgggaactgctggtttgtcagttgatagcataaaatagaaccagactgccagtgttcctgttctagttctgtcaaagttatatggcctgggcaagtcactttaccattttgtgctttggctatacaatgatctctccaatactttcatgcttttagcacctagcttcctgacattcacgtttaaactttattcgtgttattctcggtgatttccttatgcatctcaggtgatttttttcaacactaatgtctcagttctgtgacttcttctctcacaaatattttatcctctgcctttccttggttacttattctgtgggcatagcctagttcttgtcttcatcaataactgtacctgtattatttccataatcatgttttcaagaatcccactttccaatctcttgtcattactgtgtctcctacccttatttcagctcttgaatcttgtcattttttccagtaccattgcatagtccttcatcctcctcgtgttctcccttctgtccttaccgtgcttgtattacatgatccttgattaccactctctagcacgtacctttacttccttgattctctgtttctggcaaaattctaactggttgaaatccatctctctaccttctctgtgtctgtactgggttgctcaacatggttggagaacagccgtcttgactgttttccctttaagtcggtgacactaatttaatagggctgtttgtgttgctgggcaatcctgtaagtttgagacttctccagtttcctagataactgtttcacattttctcacatttcacacctccttctctacctccttattcatctgatgagcttatttgcttccattttctcagataaatattaagagataacttgtatatgttctcatcactgtctccaagccccactgcatcaactcgtgtctttgcttttccctcccttgcctctgcagaaaatgcctcgcctcttaagaccgacctttctacttacccactatcacatcccctcttgcctaccaatggacattattccagcaattatctgttctctcaccagcgtcagttcctccctgtctactgaatgcttctcatcagcgtaaaaacctgctgcagtatctcccatctgaaagacaaggccaaaacaaactctcccttgattctgtaggtcctgcaacagagttgcatttctctcctctttataagcagcactttgggaaagagcagcccttttctcttttctccatttcctcactttgaattctcattgaacctattctaatcaggttttcttcctcaccacttgcctgaagtatcccttgcgaccttcacgttactacattcactggttagttttcagtcctcatcttagccattttcagcaacatttgatacagaggaacacttttctctcccatatttattttataatgagatatagcacatatatagaaaagtacaaaaaatacagtttaaaaaataattatttctttcaaacccataaaaccagtgccatgggtaagaaacagaattctatcagtgccccagaagccatccgttttatccttctcattaccttcctgtaccaagaaataccatttctgactttctgaaaatcatttcctagattttctttcccactttcccacttgtgtatgctttcctaaataatttgagtttgcctggaactttccagaaatgggtcctaagtttaatctttcgtgactggcttctttctgttcagcattctttgggattgatttatgttgctgcacatagatatagttcattttaataggtatatagtatccactatgaatatgctagtttactcattctacttttgaaggacgtttaggttctttagttttgacaaccacttaccgtgttgccatgagcattcttctgcatacctcctgaggtatacacataaacaacctagtaaatggttgcacataccaatttacactcccaccagcagtatatgaaaattcctgttgccctgtatcctcaaaaacatttggtattgccatgttttctgaaatgaaataccacttttcatttgacttccaggtcatcagcttcctttgttcttctagctctgttgccatctcctcagctgtctttgttctttctcatcttcctgacttctgaatgttaaagtgtcctagggttcagtcctcagaccctttctctttacactgatgctttaggggacctcatttagtctcttgtcttcaaatacctttttatactgaagattgtcccaaattaatacttccatcccagactaccagctcttgaactcagaccaaaatatcaaaatgcctcctcaatatcgctacatggatgtccagcagacatctcaaacttaagatgtctaagatctaagctcctgccctcgctctccctttgctcttctctttctatagttatccctgtcccagtcattggaaactctccgtttgctcaggccaggattctctgagttgcccttgaatcccctctttcattcacccatatcccaaacgtcagcaaatcctttttgcttttaaagtgtgtccaggccgggtggtagctcacacctgtaatcccagcactttgggaggctgaggtgggcagatcacttgagaccaggagttcaagaccagcctggccaacatggcgaaaccccgtctctactgaaaacataaaaattagctgggcgtggtggcatgctcctgtaatcccagctactcgggaggctgaggcaagagaatcgcttgaatccgggaggcagaggttgcagtgagcccagatcatgccactgcactccagccttggtgacagagcgagactctgtctcagaaaaaaaaaaaaaaatgagtctagaatttagcttcttcgctgctgacatccttatctaagctgccatcatctctcacctggattattgcagtcacctcctggtctggtctttttgcttctgttcttgcccctctatctgttctccacaaagaagcaattctctttatggagaacaccacccctcttcaactttttatcttaaaatacttgcagattcatagttgcaaagatgataaggagagatcccatttacccttcagctagtttctcttgatggctgcatctatgtaaatttatagtacaatatcaaaaccaggaaattgacagtgatacagtgcgtgtgtgtaagttttatgccattttattacgtgtgtagatttctgtagccacctccacaatcaacatacagaactgttccaacaccattaagatctgcttcatgctgcccctttatagtcgtacccgcctctctctgctcagccatccctaatcccgggaaaccactaagatttacccatctccataattttataatttcagtgattttatataaatggaattctacaataagtgaccttttgcgatttttttttttaacactcagcataatgcccttagggtccatccaagttgttgtgtgtgtcaatagtttgtaccttcttgttcagtagtattccatggtatgaatgagctagagtttatttaactgtttacctattgtaggacatttagttagtttccagtttgggctttttacagttgaagcttctatgaacaatcatatatatatacacgtgtgtatatttatatataaaatttaggtttttgtgggcaagtcacaaaaacacaggtttttgtgtgttagatttgtcaccaattctcctgtgtttcggcttcaatgttatgctggcttcataaagtaagttaggacctattccttctttttctattgtttggaaaagtttgcataaatttgatgttagtttttctttaactgttggaagaattaatcagtgaagccattggtgtgtgttttctttgtggaaatgttttaaattacggatctgattcccttaataagcataggacttccatcttcttaggacagttttggtaagctatgtttttctaagaatttatccatttcaactaaatttaaaaatattttagaataaagtaatttataagatcctcattttattgtctgtagtatttgtagtaatgtcctcttttatacattttgtaccttattttattttgctaatgactctcacctaggggattattatttttattaatctttataggaaaattaacttttggctttattcattgtcttctgttgcatgtttgtattctgttttattggtttctgctcttttctgtagttttccttccttatgactttctttgggttcaatttgctgctctttttaaactttatgaggtggatgaatacatcattgatttttcatcctcttattttatatactattaagatggtaaatttccctttaagcacagatttatgtacatcacagtctttggacatttgtatgtttataatcatttagttaaagctattttttactttcttttattcctaattttttgacccatggggtatttagatgtcattgcttaatttgcagacaaatgaagattttgtagttaactcttttgtttttgagtttttacttattctgctgtcatcgaagaacatgtgttgtatgatttctgtcctttgatacttcttgagacctattttatgccccagcacatggtcgttttttgctctgaaaatgtatattctgcagttgagggtcataatatttttttcgtgttaggtcatgtcaggtcacttgttcattgtgcttttcagatgttgtttgttattaattgctgagagagctctgacagttcccatctattgtggatttgtcatttccccttgcaggcctgccaggttttagtttatatttttcatttatagatttttggctcttttatcgtttcagattttctgcctgaaattatttttaagaaagtttgtttttgaaaggtccatcatctgggtccattttgggtctttttctattgtgtgtgatttctcttgatttttgatcatgatatcttctcatgtgcctggttattatgagtgctggatttttaaaataagaaattgtagataatttaaagtgtagagtaatgatatcttcctccagggaggatttatatttgtttctgggaggtgactaatgaaattggcagtcttagatcatttcagtgtagtcagggattaagataatttgaagctgggctttcatccttgtgagagccacaaggatgaagaaatatttcccgttcatcttacttctagtgtataacatttcagaggcccaacccagtgtgtggggggttcaccagcccttctctgcttggaccttgaacttagttttggactccttgagacctgggagcctgttgacattactctcttcagttcttagtgacctcttctggattaggaagatgcccctagggttaatgtaacccccaatgcagagaatttctttcaccttccatatctttttttgtttattttaattaattaatttatttatttaagaaaacacggcttggctatgttgcccaggctggagtccagtggctatttgcaggtgcagtcatagcccactttaacctcaaactcctggactcaatgaatcctcctgcctcagccttctgagtagctgggactacaggcatgtggcaccgtgccaggctcacctcccagatcttgattttaaaattcttcattgcccaggaacagatacttattgtttgttttgcccagtttttctaattgctctagttgggaagccttttttgacttatttactctctcatactggaagtgggcccttgatattttgtcaattaatggcaccggggtttgagaactactgcctggctcttctcacctactgctagcaccctctccttgtttgtttcactccaaccactcaggcctttgcatcatttcttagcatgtttctgccttaagacttttgtagttgctgtttatttttctctgcctgggactctttctccaaatggctgaatagttcactgttttactttctcaggtcttcatcaaaaggtctcctcattagtgatacctttctgctgagcacgacatataaattgtccttcattacactcactacccatagtatatgttgtaattagttttggccagtatatgtaagctctttgagaaaagggagattattttgttacttgctatgtgtctagcgcctaaaattgtcttgcacatagtaaatgtcaattaatatttcttgtttattgttgaatgaatatatgaatgaatttataatggggacagtaaaggtaatggcttcatgagggtgctcatgaggattaaataagttaatacctgtaagatgttaacagtgtcaggcatatggtaaatacgaaaatattatttttaaaaattgttgcctcagaaatgatcacttctcatcactagatattgtgaaggttgaataccacctgctttttgtaaagcaagaccctttttctccttaggttgctattatgattagccccacattttacagcccctttccaatggctgctatgatagaatgaagcttaatccatagaactctatgtagctggaggatttagagaagagatctctgcatttaagctagcttgtgatttccaggcaatcaagaagctgcttttaatgtaacttaatgagcagaagagtgattgaatagacatagttcctttttaacttttatctcttaaagactgcattctgggagactggcatactcatagttgtatgtaatgcaaatgaaatataatactcagccaacgttgccttctgttgaagagaacatcaagattgattaacctgagtggtaaatattgacccaagcaaatgctgaagtcagtgtttacctcaagggacaataaatcttgatcagaaaatacatagttaatctcattattattataggctttcactagaagaatctggaaatcttgtggcatgagtatcttgagcataattttccttaggaaaaacaactaacttttaaagtgaagacataaagagatgagatctttaaagtacttgaataggttgatgaacttttctctaataatttttaacttggacagcaaaactgctgccttttgcttgacaacattataaattggtggcttctttatccaagaaactgattattaatcaattcagttagtttttgctcagtgcccattatgttgcttctaagtcttgtgttaaggtagtttgtaagatacaagacaaggaaaaaatatctttgaccttcaaagagcactgaagacacacaagaatatatgaaataggcaatgatacaagactttacatttctgatataaaatctctgatatgagagaacatttttatagaggaggtgaactgtaaataaaattttgaataggatttgaagaggcagaagaatattttatagttggataatcagatttctaaaagtataagatgtaacgtggacttctaaagtttatacaagtcataaatgttaaattatagagatgtttgaaatgatattaagtaaaaataaatcctaccagaggtagctactttttaacattttgatatatagccttctagactttttctcttcatgcatataacgtgaatatatgctgtctgtgcggctgctaaaacaaaataccttagactgggtaacttataagcaacagaaatttattgccctcaggggcttgaaagtccaaaatcaaggcttcagcagatttgctgtctcgtgagggctcattgctcatagatggtgcctgctatgtatccccacatggcagaagggacaaacagtctctgtcaggcatcttttataattgataagggctccaccctcataacctaatcaccttccaggttccccaccacctaatcccactgcactggggattaagtttcaacatatgaattttggggggacacattcagaccatatcatagacatagatattggtgtgtatatatgaataaatgggaaaaaataaatataaaaagtgataatattgtttcaagatttgctgtaaaaaattttgcttttctagattataaataatggtaatttaactgatcagtgaaaaagttgtatggtccttggtgtgattcctaagattttcctacctgaacatgttagatacatatggtacggtaaggggattgttgttttgactgataatgaatccctcataattttttttaggtgctgggtcttcagctctaaagaggccatttgaagatggattaggggatgataaagaccccaacaagaagatgaaacgaaacttaaggaaaagtgtgtaaaacctttattcttatagatgcaaactagagaggacttgtagcttcagatagaaaaattaaaagtgaagggttttttttttttttttttttttgagatcggttctcattctgtcactgagactggagtgcagtggcgcgatctcggctcactgcagtctccacctcctgggctcaagtgatccttcaacctcagccttctcaaatagtagggatcacaggtgcgtgccaccacgccctgctaagtttttgtatttttggtagagacaggattttgccaagttgcccaggctagtcttgaactcctgagttcaagcaattcaccccccttggcctctccaagtgctgggattacagatatgagcgactgtgcctggccaaaaagtgaagaatttgattgatttgaattagagttttgagactagatcttaactgagcaattgataattggataacttttttgtttccaagcttttttgcttaggatgcatttatattgacaagcgaaaattaatgtgtagttaaataatgcatacaatttttatagtgatattagcataataattttagaattacttatgaggttaatctgtgtgttttgaaatcctcatttaaaaaaattttggtgaatttacagtagttactaggaaccccaaaaacgcataaagcaaaattactttctagttaatttctgacctcattcctctttctttaacagttctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtacagtatttgttttactttgcaatgctttcttattttatgttccaaataatatgcttattttcctataataaattatcatttttaaaaacattttaatagcaataatattatatatagacttttgttacttctggataacaaagttgtttttgttgttgtaaaataatatgtggtagtcttacaaaatttggaaaatacggaaagaagtaaagaattaaaatatgtcaattgaacatttttgaagcaaagatcattcgtatttgtatctagtatgttggtttatttcccatcattttctattttgctgtttattttttaagtgagctcacagtatatatgtaattttatcttctgattttttttcatgtaatgtttcattagtgtttttcctcattatgaaaatcttcataaataatttttaatggcggtacgattaacatgctacgggaaactatttgtttaaacattctcctatcattggatattttgcttattccagattgtttctattataaatttgatcagtatctttgtatatggtgctttgtctgtatttttagaatatttccatcgggaataatatccaggattggaccaattatgcatgtaggtttgtagaaaatttccaagtaatgggatctctctataagtatatttgacctcttgcagactagtgcaaaaatgttaaagatcatgtagactgaagatcagattcacttaaaagttctttcatataacagtatggcatacgatataattgctctattttcatggtcatttcattttgtatgtattattagtgtagatgcaaacaccatcctagatactggggatatagcagttaatgaaacaaagttcctgctctcatggagcttacattctagtgtgtataggatgggaagatagacaacaaagtgtgtaaacatcagatagtgatcagaacaatgcatgcagaaaaacaataactaagctgtaaaaatgtcaaacactatatattacttatgctctgtcttcattggaaaagggatatctaaagtatgatgaaagagtatgaatttaaaatgaggcagaaaaagaaaaccaacaatgaggggaaaagtaaatccaggaataagactaaacatatagtttagtaacaacatacactgagaatgtgtcacaagtttagagctaagttctgtagcagctgacacgaaaagcttgtgaaatatacaattcactctctcgtcttaagaacagagagtttggttatgagagtcacagttgtggcatttgatcgggtgggcatttctccttgggtagatcttcacaaaccaaggatatcagtgatctcttttaaatctatgatgcagtgatacattttgtgggttgtttcgtacagtaacctttaacataagctagtggcctcatagcaaattccaattcagtaaaatttgggagagctagtagagtggcacattttgcaatgtgacaagatttggatgctgctttcatttgatgcagtgatatatttttatgatataatggaacttggttggcctggatttgcttttgtcttcaattcccaatattatgttttattcacctgagcttttggtaaacacggaggggctgtaagcttgggattaagttaagctccctgacaaatttcggaaatgtagatatcagttatgatctgaatgacactggatttgaggaaattgttaatggtttcttgtgacttgtgtggcaggtagatgaccttcttacttttatttaccttgagtagcattttgggtagaatgtgcagtaactagtaaatttgaaatttgtgaagagtttaagatttgcccttttcgaaaatgggataaactaaactttgatccatccaggtagaatgaattaagaatcagagtaaactagctttgaagatttgaaaaactctgcttactttatttggtttatcagctataggatatgaaaacctattactagctgtcagtcttaagtggcctgcagtcttttctaggcctctaacatctcaggtttatgactctatagctttattccataatttgctattttgaggtagtttgttctccctaaggtcttcatagatttttttgtgttatgtcttgttttctaaaagttacttttggctttttaaatcttattataaatgtataatgtgtgtttgttataaatggtttagaaaatgaggggaaaaaattcatagttctaatacgtagaaataataaccattaacattttggtattttttcttccaagccttcttattttaacttgcaattctaacttcagaaagcattaaaaatgaaaaaaatttccctaagtttgatgcaaattcactgggtggcaaaacatgacctgaattgatgcggggctatttttagtctttagtattctatttagtgggattattttatatgttcctttgcataaacatggggcagcacctgagaatccactggggatttggaaaatacgtggtatatgtattgtattagatgtcagaattgaaaaattatgaattctcaaaacaacctggcaccaagggtttcagataaggaatggtgaacctatataatgtctgtaaaaatatgttttttaaaaataggatctttctttctttctttctttttttttttttttttgagacggagtcttgatctgttgcccaggctggagggcagtggtgcaatctcagctcactgcagcctctgcctcctgggttccagtgattctcctgcctcagcctcctgggtagctgggattacaggcgactgccaccacgcccagctaatttttatatttttagtagagacggggtttcgccatgttggccaggctggtcttgaactcctgacctcaggtgatcctgctgcctcggcccctcaaagtgctgggattacaggtgtgagccactgtgcccagccgatactctcttcatctaaaaatatattatgaatgtttaaatagctaactcaaagattgctcttattgttagtgatggtctaacatttcattattagcagatggtctgttacagtatcataatgtaactaatcattttagatttagatacttccattttattgctttacatctttctgaacttgtctggtgatcccttaagatatattctagagatagaattattgggtcaaaagataaatacattttaatgattcattaatttgttaaaaaaatgcattggaattcttattctatgccaggcatatattgccaaattgttatccataaaagttatatcacatgttatgcgttgtttataattgagcgagaaagaattttgcatctaacgtgtttatgaaagtaggtccaactgaataaaaatccttttagttcttactcaatcgcttggtgagggttttgtacctattaagacaaatcacatcagagaatcaaatcaaaagaaaagaagaaatcagtagtttcacatgagtctggcctggctgcagagcagcaagcaccctaaagtggtggagaattagtggccaggcttcccttcactcttccacttctctatcctggcagccccccacaaaggatacctttagggtcataatcatccatattacatgaaaagaatcttagtcattgtgaggaaaagatcagctagaaggggatgaaggtgaagagaaggttctttggagaggttcttagagacatcagatttcctgagaatctgatgaaatcagatctctattatacagaagccatggatgttactttcttttgagtagagagccatgatgtagaaagccatgttttcttttcattcttggcccctagtattcgagggtatcatctttctcagtcacagcctttcctaacctctgccctcttccaggaagaaagggatttggttacacacagatgatttcccagtcaccttgtttccatgagtgatcttgtcatttttaagctcaattgatgtattaggtttgaatttgtttgccagatacttgaaattcacttttctttggtatactggttttttagcattaacatggattccaaacaaacttggttctgccaaagaaaaccagagctggacagttgttaaaacagtaaaaaaaaaaaagtgtgttatcaggaactattattgcaatagggaaaagagacctcagtatagaactgggctcaattctgacttcaacatggacaagtgaggatttgtagccaaggaacagggatggatcagtggatggaaaattactaagaggaaacatcaggatgaagggggatttctggctaaacgggacccattaggattcttgctcagagcaggccagggtgatcagataccacctgggcagtgatggacgtattagtccattcttgcactgctataaagaagtacctgagactgggtaatttataaaggaaataggtttaattggctcacaattctgcagactgtacagaaagcatagtgacttctagggaggcctcaggaaacttttaatcatggtggaaggggaagcaggcacatcttatgtggtccgagcaggaggaagagagaagggcgaggaagtgccacatacttttaaacaaccagatctcttgagaactctgccatgagacagcattaaggggatggtactaaaccattagaaactgcccctatgatccaatcacctcccaccaggccccacctccaacactggggatttcaatttgacatgagatttgggtggggacacaaaccatatcaatgggggatgaggaaatttgatcacataccaagggtgatggagggtgattaaatattgagggtgagggattctggctaaaccaatttagcaggattcttgctacaacatggctcttaaggacaaggccaaaggatggggccttgatgaaaacatggctcagaggatcctgtctagagtttggttaagagaatctttatcagttgcagaggtctgagaactccctgcttttttgacttcttagcatatgctagtaaatactgttagaataactgttcataaaaaatgatttgatttgaattttttggttacactgtgttggacacttccctgagatataatccaccagttatataaaatatttgtaaatgtattgaaatatgttgctgtaataataataagtgaatctgatatgtgagaaaagggtggagagaagtattaaataatttatattagcctatttttattgtctatgttgagtcgagaaaagatgactgtccttagtttttattggaataaacaaatcaaacttatttgtgatgtttggctttgacttgcagcctgtgttggctagtgttaattcggaatgatagctgttcttggagatgagatttctcagggagagcatatttacaggactcagacagtggagaaggtgtttttaaaataaaatattaataagtatataaacaaatgatgttaatgtgcttagtgtaaagtattacctgagcacttttagaacttaagatgttaaaaaagcgttcttggctttactcccaagcaaatacaagacattttatttatgataagaatgccaagttctccatatgaattgtgtgaattaatttcgagttctcttggtacagacttctatgtaggtcgattttttggtttagggtaacactgtttatattggcaaaatcctttatacaagatgcagttgtttataaaggctggcttctcatttgtgtggccaccataaccattttttggagcacctattatgtacagttgttactataaagaaatatgatgttgcttttaaatctcagcaacttaaaacagttaaaaatggaaacgaatgcaagggtctttaggaatctgtccctatatcctctgatgtaaacctctaattagtgacaaagctatatcaacctcctttgaaagaggcttacaaaaagtgaacatattctcttgtaaacatctaaaaagcagtataatcaggaaggtattaaaaggcacgtgtgtggaggtgtgtgagcatgcctgtgcacaatcatgcacacacatatacacattcttctgaaagctttatttcaaaaaagtaagacaaatcctggggatcgactgaaagtataagaagtttgaacgttggaggtagccataatcagcccttgagagagagggatggaaatacaagactaaaattgttcctggcttatttagtatagagaataaacctagagactgaatcttgtttttttttgtttgtttgtttgttttgtttgtttgtttttttgagacagagtcttgctctgttgcccaggctggagtgcagtggcgcaatctccgctcactgcaacctccgcctcccaggttcaagcaattctccagccttaacatcccaagtagctggaattacaggcatgcaccgccacacccagctaatttttgtatctttagtagagactggtcttaccatgttggccaggctggtctcgaactcctgacctcaaatgatccacccgccttggcttcccaaagtgctgggattacaggcatgagccaccgcgtctggccgagactgaatcttttaagttttgattgtggtctatgttggaagcaaagtagaaagttttagatgttattttgtaattgacaggcaagttggttcaaagataaaaaatttcttgattgcctttctgggccaatttctcctaatggattgagtcatataacttagaggtcaaccagtatagtcttcctgttttgtagattggaaaattgagggccagaggagaaatacaggattagactctcagattttttcctttctagaccagggtactttttatagtatgctacttctgtccttatcctattggtttgaacctagctatcctgtttgttttctctacctctcacctccaaattaaatgaactaggaatagcatcaggtttatatttgtcatcctgtatttaaactcaattatcctgaggaggttttccccatttttccatggtgctaccctggtaggtataccatatttaaccaaggacttacagatttagtaccatcttgctcttcctgcaaggtgttttatggttcaaacactatggatttgaaacttttgttctcaatattttgtctattctctggtttctcgtgtctgaataaaactgcattttaatgtaatttgtacaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtatacttatttttttctcagaaaaaaaataacatatatgtgcattgtaggaaatttgagagatgtggaaaagtataaataaaatcaaaagcatatgcaaacctgtacataaattacagagacagacataattattattttggtttatttccatccagtttttttcatgaatctctgtgaaggcagtcatcttttcatgcagttttacatcttgatttttttcactttaaaaatatctgtaaactgcacaacacttgaatataccctaatttaactagtgtttcctggttgctggccatggaagctgcttccaatatttcagaatataccaagagtatcagcagtaactgatgggcagaaaactacaagatgtagaggaggaaattgggattatttgaagtttgtgctaagctgcggggtacattgggtcatcatttagttggtccagccctgaaggaaggcatagcctgacacagtatgtatctcagaccctaattaagtcccgactggaacttattgtcgcagataatagaatgggatgaaatccaagtactgagtatacacagtacattggggagttcatggaacccatgtttactgcattctatgtaaagaacattagctttaaagtaacagcaagagcttacattagaaaaaaggcttagtttgtcatttgtatgaataagtagttattaaggacttaattaataaactaattttttcagtccataaatcccttttaatacctgcttagtgccaggtgtttcagaaattgtgtgcagagcctggagatgctcccaggctaaaagggcaaaaagaggtgtttatgacaaatggtaatataatgcgataagctctgtgatggcaaaatgaacataataatgtcaaatcttgaaggaggaaggggttgtgagactcttagacataacttacacaatcatgtaaaatcaaagggagtccactgtgagcaaggcttcagatgatgagctttgccgtgtggggaagagaaagcattctggactgaaggacgaggaggtgttatgactttgagttgtgaaagtaaatgtttaagaagtgccaagtgggccagtgtggacaggattgatggggctgaagcctgagaaagccacacttggcactttgtgtgatgctgtggaggacagatgatgtcatggctggctgctcagagggaccagtcattcacaggtggcagtcacaggtcaagatgttgttttgctgacaatgttacatatactaaaagaaaaaagggctcattaattatgaggtccagaccattaagtacaaaggtaattagaaagggagagagcagtgtgggctgcactagtagcagctacactgacataaaaagttttggtagtgactacatttatactttgtttctgtatattgtagtaatggtgggaaggaaggagaaaacaaagcccttatttatttcttcgtttaaaataatagtactttattaaaattcagatatttttatgtctcgactcatttttgtagacatgatttcaggtttggaaagcatagagtgattactatagacctagtttcaaaaatcactcattatcttttaaagacagtgactagaaatttgccttgaaattcaaaaaatgcagattataaaaactcatcaagaagagatgtttattgatgttactgatgtttttaaacttgtccttaaaaattgtcctttgatgtttcacgtctgaagcatcaaccacttatccaaactgcacggaatactttactaagagaatcttgattttcattaggtttatatatgtaatacttaatattttgggctgggcatggtggtgcacacctgtaatcccagcactttgggaggctgaggcaggcggatcacctgaggtcaggagtttgagtgcaccctggccaacgtggcgataccctgtctctactaaaaatacaaaaattagccgggtgtggtggcaggtgcctgcaattccagctacttgggacgctgaggcaggaattacctgaacccaggaggtggaggttgcagtgagccgagattgcaccactgcactccagcctgggccacagagcgagactctgtctcaaaacaacaacaacaacaaacaaaaaaaacaaaattaacacttttggacatttattttgtgtgttcagcatttcttgtgtggtggaattacagacatgatctctgacctcaaaaagtgccctatcttttggtttctcctttctcaaaattatagttgtattttgtgggtttatttgttagtttgcttttgatgctagcctctgttttcatttgcaccttcatgctcttgcatgaattatttcactacttctattcttatccttcctcaaatcagttatttccatagcatgtatctcctctttaacatacgttattttgcagtgatgatatctgtccctcccactacactctagctccttgagggcagagagtgactgcctttattgttattttaaaatttcagaatccatagtctatagccaactgtttttaccttaggtccccttaaatctgtttagagtgactgagaggtgtatgggaacatttaccctctaacatcccaaattgagagttatttcttcctaaccctaaagaagaaaaatgatgaacccttaggcatcacgtgaatccaaactgttctattctcgttattagtaatttagagtattattcttagatcacgaacactacagagcagagcctggagtggcccacagtggtgaggttgcattgattggtcttgaatactgcttcgaaggaaggctggccagatgactgcaatgtttactgcttgtagagtttttacagctttaatgatattttgccatttgtgtaaagaggtgactcattctagcccctgagtgctttgaagtagaatttttgagcctccttcttagcataattgtattaataagaaatgtaatattctaaaatcttacttgattgaaccttcagattccctttctcttataggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtgtgtacccagacacaagccagccttatctttcttctcaaagacataggatatcctgaacttaatgtaaagttttagactgagtcagttcttgtggcactatttgatttttggtgttttctgtgtcataatctatttaaattaaaaggacatagaggaattgcatgggataattgcaaggtgttattcttgattgtaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggtatgagtaaacattaaacctttgcagaacctgtgaaaaatgttagaggaattaaattttctttcctgtccatgtggcactttagctttttctgaagttgtttccttttcttggacttggtgacctttgctttgggttaggtcacgaataatataaatttgattagtggtttcatgttctatggactttctaaacaaaatatatatgtacatgtatatttatatttatatgtatatatgaggctattagcattatttggagggttgaggtcattcttgatgaagtcaggttttgaggtgatttggaccttagtgaggtctaagcagtttagtttggggaagctgccaggagcacctggggctttgctttcatcagcctgcgggtgctcttccagttcctttgcagtttcgtgcttttgcattgtttattttgggtttcctttgccgaccgcataaaatttggcgctgtattgtgtctgttcattactgacactgggaatgtcagtgctactgaatgtccaggatcttagcaaggtatttagaaaagatggccctctaattacatgcttgtggatatgagattcttccatccattcatttatgcattcaaaaaacattttctagtcatacatcatatgcctgatagtgagggaaagagtaagtaaatataagacacattgtgcctcatagagagtactggtataataacataacatctgaatatattatatgatagaaattaaaaatgcttaacgtaataaaaagaagcttagattgtttaattctacattaaacattatatttagattccattatgtatgctatgtccattgtaggagggtagaattgatcttattttacaggtaaggaaacaaggcccaaagaaatggaaatacttgcctgtggtaacacagctaattgatggtgggggttccttctagaaccaggtagttctcccaaaggccatggacattttactattgcatattgtatccatctcaaaatttgttttgtattcatttaaatttcttgtatttgctataataaacactgcttaaattctaggatccaaaaggtagagaaaacttattttaatgagatgaaaaaatttttaaagcctttaaattacgcatgtcgaaaacaagtagattttattttctaaaatcttctggtaaacatagaacaaagtatgttctaaattagttgaaagatgattcttgttttatgagcttgttttatggtgttttttcccatattacatcttatgtttggtcagttaattttagtttaaaaagcccatgtgcaaatatttattaggtagttaagtttgttctactagacatgagctagatttgtgtggaatcattctgctactgccagattgttgcttgctgactacttttgactaagtcatgttaaaaaaagaaagatgtctacatgaagttcactcatttttagaaattttccatactataagctataaaactcatgtgttcaatgtgcttgacggccaagaagcaatctattttggatatgtgggttggtttatttcagagaaaaacaaaaacggcagtccctgtgcatgacacagttaaccttgaaactgtctcctgcccattcatactagaggtagaggttcctgcccattcatactagaggtagaggttatcctggaaagaataaaggatgttgcattttcaaagtgagataaaccaatgtgtatgtattctgactctttcagcttcttagacactgttgactttatcatagagtacgctttgaggctttgcaccactttcttgcaccttggttatagtggggaatcttaattgtttctagcttgagtttttgttgcatttctataagtataatattcaatttgaaactagacaccttttgattttcttaaaatttagtttggaaaagaggtttttcaacagtcctgtttactgttactcccggtgttatctgttgtatttttagaatgtttttatatctgttctctcgttgttctttctactctaaggaaaacaaagtatcattattctcattttataattctcggttactgtttcaactctaaggaaaacaaagtgggtatcattatccacatttttaattagtggggagatttccatagattatggcattttagagaaagaaggggctttcaaagtggtatttatttatttaataatggggccaggtgcggtggctcacacctgtaatcccagcactttgaaaggaagctgaggtgggcagatcacttgaggtcaggagtcaagaccagcctggtcaacatggtgaaaccctgtctctactaaaaatacgaaaattagccaggtgtggtggcgggtgcctgtaattccagttacttgggaggctgaggcaggagaatcacttgaacctgggaaggtggaggttgcagtgagtcgagatcgcaccattgcactccagcctgggtgacagagcgagactccgtctcaaaaaaaaaaaccaaaaaaagataattagtagtggatacatacatacacaaacagcagaggaatcgggctccaagaaatcatattaccttcctgaggtcacagttacttagagcaggaactggcatcctcatctttggtcctcctgtcttagtcctttatgttttccccccactagccccactcagattcgcagttaattctatgtaattagttgctcagatattttctgcctgttggcagataatttactggatttggaacctaggtaccaagtgtgtatgattactttagtaaggcctaaaatgactttggatataaattgattactgaaatttggtgtagaaaatgaactctttctggataaccctcaagcaaaaagaagttatttgcatattctcttaacatctctgtaaggtaggtatcatttttgtttttcagatgataaattgaaggttcaagatcacagacagctcatggtctcacccacgtgctcacagtttctcatagttgttgtgcgttgaagagatgatagaagaaataaaatggttcttatttctttcagtaatgaaaatgtgttattttaacaggcaaagggcgttgtgaatacagctgtgtctgcagcagtccaagctgttcggggcagaggaagaggaactctaacaaggggagcttttgttggggcgacagctgctcctggctacatagctccaggtatagtacaaactgcaagagattggccccctttactgggccgaaattcaaagaatagcatctcctgcattttctaaggttgtacagggtttgtggaaatataacacaggcatgaatgtacacagaaatttaaaagtagagaattggcagaatgtcataggtgttctcctggaatctgctgagtgaggagaggctacctggagggagatgacagatgagcaaattgcatttggttgtgggactgtattttgacaaggaattaaaggatattccatagattgagaagggtgagcagggtgttttcatcgaggacatagatgacaggttgggtataacaggagagaaaaactgctaagaggttacttaattagggtgaagcctggcattattagtgtttgttaaacttaatgtttgggaaccatcaaaggctaaagaaatacacaaaggaaaaaaaatttatccagagcttactatatatactagatattttcatgtaaataattttacctattaaattgtttttaatttaatttaatttaatttgtttttaatcttcacagtgtttcatcaggtagaaattattttccaaggaaggaaactggtatttagggagataaggcagctagctcagggtgaagcaaccactaaaccacagagcaaggatttgaatgtaggtgtttgcatttccaaagttcatattctttccattccaccacatagcttaaagaagatttgggagaatgccctctctctgccttcccttctaattcttatgtcattttaacagtagattatccagctgtcttgttaaaatcaagttcttcacaatattgaaagtatagtactttaaactggacaagtaaaccacttgtagatactgatcaagataaaattgtcatgaagattgggtcttatccagtcattgttttttaggtaacatccctaagggttcactttgtgctttcctctaagaaagaataagactaggccatttgggaaattttatgatgtggctttggaatgattcttctagaagataatcctagtaggtaaattgctcaaggagtgtgcctgctttggcacacagcagacatggattttgttctcatgcagcttacagtctgaagggtgagacgtagattaatcaagtaataacaacgagaaactgagatgagtatgatgaaaaagaaggacatgctgctgtgagagcatgtaacagagaaacctggtctagtttagtgggtccctggaggcttcccagaagaagggacatttgaattgggctttgaagaatgaataggagttaactcaaagaagactgggatgggagagtgttgcatacagaaggaacagcatgtgcagagaccttgtgttgctgttggggaatttggctcaattgaagaagcagaagtccagaatgtgtggaatgtggtgagcactgagtggcagaagtggagagactggggaatgatgtgaattaaagctggatgactcagtcccagacctggaggccgttgtttggattttggtcttagaaccctaagcacagtgttaagtcttgatgggttcttaggagaatagtgacaagatcagactttatttgtgaaggttagtctttctatagtgtgaagaacaggaggtagggataggtgtgagcattgacaagatcagttagaaggcatatagtttacagtaatgtattgtacatttcaaactggctagaagagttcaaatggttctagcataaagaaaggacaaatatttaagatgatgggtatcctaagttcactgatttgatctttataaattacatgggtatattaaattatcacacgaaccccggaactatgtacatctattatgcctcagttaaaaaagggctactgaagactactaacccaggcaagagacattgatagtattgctactggaggcagggaagaagaaagggggagaccagaagagaacagatgggaggaatataaaggaagcaaaattggtgtattgaatatatagaaagaagagtgatgtttcaaggatatctcagctcctagggtttttagctggagcattgggggaaaaggaaaaggttatgaatttcttatggtgtgacatagtttatgagtctaaaattaagacagtcttctgtgtgtctcactatttctactgatatttaataattttagccttattcagtgtattattgaaagggcaaagctttcattcacaataataggcgggttatagagatgaactatctttcttgtctttgatgatgtgttctattggggcttaatctggtcacgtctcttgttgccgcggaccatttaccacctgctagagtggtaaatggctatggtccagtggcagtaatcatgaaaggaaccgtttatggccactcgttgccaggctttactctatagtgactcctctcttgtgtcattgcattgacctccctgaaaggcctgtgtcccgaagcttttaaaaatgaagttattttatggccgagacaagattcagattaggtccctttagattatgaataggttatataccatttgcacagtatattctgtgcagcagggactgttgtcagtatatttacatgtattatttaattaaattcccctggcaactcagttactgtacatagaacactgaagctcagagaggttaaataacaggtgccattcacagataccttgctaggaaaaggtgaagttagaatcaggactccagtgtcctgatgaatgacctagttagtacttgtggtctcatttcttcttaaggaggttttggtataatccttagaactgcagccttagccaaacagcttctgttttctggaataaatttgatagctaaccttttttaagcattaatttcttttttggcctctgatctgtctcctcttcctactgcttatttcagctacatgtgtcctcttgaatatgatttagtgagcactcagactgagttatatgacttaactatagactaaaaagtaaaaattgttcatccctcagaactgtttcagttggtccctaaaagcagtttacttcttcagcatacatttgaatgcgttgtctcaaacaggagatttagaacttggcattcagagaagacctagcctctgccccagtgactgcctggggtaggaccagataattgaataaacacaatgcaatatgatgcaagtataacatgggttgggcaaaagagagaacagcaagtctgggagactttgtaggggaggtgataattgatcctgttctcaagggtgagttgcagttggtcatccagagaaggagggagtgaaatcattctgaatagcagaagtggttacaaaaaaaggagtggtaatgtgaaaaagctccatttgttttgggtactgtgtaaaagtgccatggtgattttgtgcccttgttctactttagaaatttttttcatttataaatgaataagttgttgttattattattattattgagacatgatctctctctgttgcccagcctggagtgcagtggtgtgatcatggctcactgcagcctcgacctcctgggctcaagtgatcctcccacctcagcctcctgaggagctgggactacaggcatgcaccaccatacccagctaattttttgtttttctgtagagatggagtctcactatattgcccaggctggtctctaactcctgggttcaagcagtcctcctgccacagcctccaaaattgctgggattacaggcatgagccaccacacctggccccaagtaatttttatctacatattacctatatctaagctgttttactaaaagagtaaaaagattgcagcttctgttaatataggtaatatttctaatccctactaatatggtataaaaacttctttgtacttgcttttacttaataatgtgagcctttttcataggtaccagaggctgatgtcaaattcaccagcatttacagagagaccctgtacttgggccagaaattgaaatatcagcaagtcatagaccttgcccttgggctcacgacctgactcatgtgcctgttttaatggccattgagacctcagcctgctctctcactactttctgaagatacttggaaagttctgtttgctaactttgagagattggtagtttgagtggttttaagtattcttttgttcaacaaattatatttagagagtggctactatatatatcatacattctgctaggttcagatgatgcgacgacggataagtttgaccaggtctatgctactctagtggggaacccagacaaggaactgatagttaatagagtgtggggtcagtgagtgcagtgagaaagagatgtaggacagtctggcacatctaggagagccttgtaggccatggtgaggagctcccacatcttaagcaggcacacagagagtggctagactgggaccattctggcagtggttctcattcatccaacatctggaagaagtcctccgggcccagggtgctgagcaggtggtgcttgtgaattgggccagtgatgattgccctgggtcttggactgatctgccttcttcttctttgcactaggctatggaacaccatatggttacagcacagctgcccctgcctatggtacgtacaccatcttactgatatctcctcttagcgactgtcacagcaatccaaagcacagtttctatctagggtttttgtaaattaattggaggatctcagatttattcattctagtgacccaacttaaattccttttgaaaatgccacaaccttgtggttcttggtttggttggagttgctcttctctccgctttgcctgattgaaggactgcttgttctaattgcctgtttctgaccatattgaaattaaatattttaagtagttcttcttacagccaactgatactccattcaaaggctactgaagggccatactcagttgctagcttggctgcctaccagttttaaagccacacttaagtttctggtttggaaccgtgtgagttgtgggtaacttaagtcaagaataggaactgctcacttcaaatttgtagccttcattcttttccataactttgctttggggttgaagtaaatgggtatcattggccctagagaggaagtgatagtgggtttcaccagcagtcttacttaagtgctcgctgcaggaagtctgtagtacatgctagaatatcataggtgtttctcttctcccctctaaaataaaaaataaaagcaaatgcataaatgaactccagtggccctttggataacttttgaatgaggtttatgtggcaatggaggcaataggtttggagtcagtgatatgctcttagacacttttttctactcaggtgctacatgttatagaatcagccatctgcagggtgttgtcagagaagagagcatgagagtgtgtgtgtgcaagagtgtgtgtgtcagcatgccccaggctgggtgtgcatccacacagaagggaaaggcccttcctgtattgccagttttggcattagtcctctacatgagcctcagaccttcgcattgtgcattttctcttcatgcatctgctttgccatttttgtttggatgaaaattgtgttcctaaaacactgctgaactgaaccttcatctgatttcgtaactgtggacataagtagaaagtgaatagtttgaccactttgcccattaaaatagtttatatcctagaaagatgtgaagctacaagggtcacactttcggagcaaattttcttttaggcaaagtgcagagcctggagctacatcctttatatcctctggcacactcgggtgtggtcaaggcttccccatattttgaactgagccgtatgggtaactaggaattggagactaatgcaataataagcttacgcaggtttccttctaaattcaaactctctagttcctttgggtttgggtttggccatttgcttttaactattcagctggcttctgggtctcctgaccatctcatcctctctgtgacttaggtctggtccatttatccaagtacattttggctcactagactcactgtactatgtcttgtataagtgccaaaacatctgccgcttggggcagatatttaaatctgtgtctttcttttagacatacagtaagtttcagattcttcagtaaaggtttgctagagctcgatttttcctttgaaaatactttaatatctagattctaagttacattcatgtttttccttggtctttttttctctcttgttcctccctttcctcctttaacattatactttcaccctgtgccctctgagcccccacatcagaaagctcctctcttccacgtgccatataactgacttccaaagctggtgaaatttgatgcccccatttttcacataaaagatttggtttttaaatgttactgtgatgcaaacctactaaaacgatgctttattttggctgtaaggtaaatatgtcttttggcctttgtaaagctgttgcatgtggggtaatttccctctgatcatctggtgctcttgaatacctgctgttgctgctttgtgatttctccataggttaaatattagcataggaagaggagcagatttcaaatcatgctcgactatgcagaagtctgtgaggccacaagaacgtattaattacaaattcagaaagtaattaatctttccagatttgccatgccaatattggccatagccattaagaagttaagtaaacgcctggccatggctccagctggagctgaggtctgcatggaaagctatgctttgaaccttgacaacccgtttctcctggaatatgtgatatgccacattgagaaccaatatggatttctacagtcgattagaacatgattcaatagcattgcttttgattttcagaattcatggtagctcactcaatgaaattgcttcctagatgtagccatcctgattttgagagtggaaaatattatttatcaaaatattaagagcaatttcaaaatagatctgtgagcgatttatgggcctcttgcaaaatggtatacatgttgactgactgatctggaaaaggttaatgataattactgtcagatatttttttacctgaaatttttattggagtattaaaacttatttggagtcctctccgtttcttttctctgtaggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaa

SEQ ID NO: 112 - DNA, 37388 bp, Homo sapiens
aaccacgatgtctttggcacagcctctcatctgtcagatgggagcggggaccccggagagggagtcagccgaggtcctggcattccttgtgaacccccgtctgtgggtttctggtccagtgtcccttctccagattagatggcttaggcctcctctaagggggtgggcgtgcacatccggagagctgtctggtgtgcaggactgggctgcaggttaccctgaactgcaaccatcttagagcaaggcccagcttgcagcaggaggagctgcaggccgcccaccctagccacggcccctgccctggcaggaagcttccaagagtaaacactgcctaatcgtcccgcccagtagtgagcaggcctgtcccattccatactgaccagattcccagtcaccaaggccccctctcactccgctccactcctcgggctggctctcctgaggatgcaccagcgtcacccccgggcaagatgccctcccctctgtgtggccggaatccttgcctgtggctttctcctgggctgctggggaccctcccatttccagcaggtgggctcatttgcaggagcgggggtattctgggagcctctgggtggggtattctgagctacctggggcgaggggagtgccaaatagctgactacatcagctttggggtttgcgctgggcaggggagtctgtacttggggctttgggggatgaagtgtgctcactgaagagggagttggtgtctcagtacgacctgctcattcggtgaagctgaacagacagatactagtttgtcccaaactgtgtaggttgctcttctctgcctctcccttcctctccctgtctctgatttccccctctccttcttggttggcctcacccacctcctgcctcctgtctccctcttcatccatctctttttgttcttttttctttctctctctctctttttttttttttttttttttttaagacatggggtcttgttatgttgccccagctggtctcaaactcctggactcaagtgatcctcccacctcggtctccccaagtgttaggattacaggccagagccactatgcccggccccatccatctctttttgtcttgcagagttgtcttcaggctttggagccacaggccgtgtcttcttacttgagccctggtgctcccttaaaaggtacttgtcctggtgtcttctctcccggggggagtttctcaggactttcaaggggtatctcaccactgagtcagtggtctgggatttttggtggatctggaaggagaaggtcagagaagctgctgtcaaccctgttaattaactctgttacttcctgccaagttgatataagctggtctgggtgttccagccaggccagggttctcaccctagcttctgttaaatatcacaagggaacggtcaccgattggctggcccctcctgccccatggcctctgctgagctggctgattttcaggagctcttgtggtttctgaccgtggatgtaaatatttattccttctgtgggaaacaagataggtactggctcaggctacctcctaaggccatggatttccttatgataaaggcctgtccccattgcccacaggcccatgtctgtgaccttctccggtgcgagcccccttcccagtagggccattggcaacttgactaatggctgatgggggccagaggcaggtgggctagtggtcaggggcaacaggagggcaaggcccactttgtgacctggttctttgtggtctaggccagaggcacactgaccagtgcctggggccacgctgggggctggatgcagccgacgctgtctgggtatcccatagcctgggtccttccagcgctgccgctcctgaaaggctgggagatcattgcccagggtccctgaccctctaagggctcccttgggagaggacagtgagggctggcctgggcccctgcttcccaagagaccactgggctccactcgtgttcagtttcctgtcggggtccatgatgttacttgtgaaacacctgtgcccagagcagggtccaggaggcagggcaggggctttcccctttgggcagagccaccagggcagtgggaatcttgtcttgatggggtgacccaaagcacacaatagcccaacagctcctcctgggccctgccctttgcgtgcctagtcactaatggggtctggctcttggggtgggggtgacacgcaatgtcttgacttcggaaggccatccttccaagacctgccagcccctttcctgttagctttccactgcttgctctctagaaccatcgccctctgctctccctctccccctccaggccgccctccttcccctggcttccagaggcagaggcagaggcagaggcgggctgcaggcggcatcctacacctggagctgctggtggccgtgggccccgatgtcttccaggctcaccaggaggacacagagcgctatgtgctcaccaacctcaacatcgtgagtgccccacgctggactgtgcaggtccccacggccagggctggtgaccaatgtctgtgggctggtgtatctggtagtctgaatacagtgggttaaactcaggtagaatggctcggggttcttcctcttctccctccctcccctgggtggaggtgggtgaggtcccacaccctctctaggctccatggcacatgcacaccctgcagcctctcactactcaagtcccttcacctggggccaccctcaagcctggcctcttccccagtatccatttgacccccacaaagctcagctaaagcaaccctggcaaatgggatacgggctgctcacactgccctctgcaccccgaccctgccctctctccattctcttgtcccccgctcagagtggcgaggacaggtcacccgtctgaagtctaaacagagactgctggcaaaggagatgcccaccttcatttcttgctagcacctgaatccctgcagccccccttcacttgaaagctggggaagggcgggcagggaagcactcccccactagccgccgtctcagaaagacaaacaaggccaggcgcggtggctcatgcctataatcccagcactttgggaggccaaggcgggtggatcacccgaagtcaggagttcaagaccagcctggccaacatggtgaaaccccgtagctactaaaaatacaaaacttagctgggcatggtggcaggcgcctgtaatctgagaggagcctgcgatctgagaggagcagcgtttgaccggaatatccgactcgtgaccatctgtgtgctctcatccccttgctttggagtttgttttccttgcgttagttggccttcctgagccatgagctgaggagcaacagaggcacggctgactgtgcagcacattttaggagccccccgccccgcccggttcccacacatgctggtggagtagcctctccagctcttcacactccgggggcccctgggagtcagcagctgcctggggctggcaatgcccacccgacgggttacctctctcatctgcccttgcacagggggcagaactgcttcgggacccgtccctgggggctcagtttcgggtgcacctggtgaagatggtcattctgacagagcctgaggtaggcatggagctggaactcagcacaccatacagagcgggaagcccaagtcatcgcatctccatcctctttaacctcttgtcccggatgccccaagcagcatggatcacagaatgcattcagccagacagaccagctgccctcccagctctacccagcactcagcacaggctgcctgactacttctctgagcctcagttgtctcatccctaacacgggctagtcatagggttgttaggaggactaactgggaaacaaaccgaccgcagtcagcaccgtgcctggttggggtgtcctaaatgcaggctttgctgtgggtccgcagggtgccccaaatatcacagccaacctcacctcgtccctgctgagcgtctgtgggtggagccagaccatcaaccctgaggacgacacggatcctggccatgctgacctggtcctctatatcactaggtagccgagctttctgatgggtgctggccagccagcctgggaaggctgctccctcagcctcctgccctctgcaaaggtgaccccagggcaggcacgtgccttggcaccacccaagtgactgttttctctcaccgaggtttgacctggagttgcctgatggtaaccggcaggtgcggggcgtcacccagctgggcggtgcctgctccccaacctggagctgcctcattaccgaggacactggcttcgacctgggagtcaccattgcccatgagattgggcacaggtatgtagccccaccagctgtccccaggatctggcaaggagctgacctgggtacccagggtggaggtggtcttagcaagcagtgggtccttgtagagtttctccagaggagcctgtacccctcaccccgacagactcaggtgtgaggacaggggaacctgatactgtttgattaaaagaactttttttccaaaagacgagcaagacacctttagcaggtagaaaataacttctgtagaaaattcaggtaaagaaagagcaggctgtaaaaattatctcaaatcccaccatttagagataatgtctcttcacattttgtatttaatttcagtcttttctttacatacacacacatatttcttatttgcaaaattgggatttagtttggatccctgaaaaaaaggaaaattgtgattatgctgtgcattgctttgttacctgctatttctttttcttttcttttcttttttttttttgagatgaagtttcgctcttgttgcccaggctggagggcaatgacgtgatctcagctcattgcaacctccacctcctgggtgcaagtgattctcccacctcagcctcccaagtagctgggattacaggcatgtgccaccacgcccagctaattttgtatttttagtagagacagggtttctccatgttggtcaggctggtctcgaactcccaacctcaggtgatccacctgcctcggtctcccacagtgctgggattacaggcgtgagccactgcatccagcctttcttttttcttcctagggtaagtgcaggatttacctgttctttatgtaataatatatcccaaacattatcccaggtatcttagaggtgtgcaccgtaatttatttaatcagtcccctcttcttggatgtctaggttgtctgaacacgtcttcctgttgtgaatgttatgcattcttgtgggcaaaccttcactcttacctataaccatttacctagagtgatgggtttcttttcatttctttagttttttaagtatgaaaataatacccaattgttgtaaaaattcaaacagtgcagagatttctaaagtaaaaagtgaatttccacattccttgcccaccaacccccacccgacccctttcaacccctctgagcctgggagggttgaggcagggttcctgggtgtgggacaaggcagggctccttctccctcagagggagcatagttcccttctgctcctgtgatgcagaagacgtgagcccccaaactggggcttagcctgggagggttcttggcttcaccgaggaaagaattcaagagggagcaggtggtgttagacagcaactttgattgatgtggcagtgggcagagtgtacagccctgtgactgtatacagcacagcatagccccttttgaagccaggctaccccatagacactgtgcccaaaagagcagctcaaaggcagggctgcagtcctagttaatacccacttctaattatatgcaaattaaggggccagattatgcagaaatttctagaaaaagggcagtaacttctaggttttcgtcatggaaaaggggcagtaacttctgggttttgccatggcaatggcaaactggtatggcacactggtgggcgtgtcttatggaaaggggcttcccacccctccctgttttagctagtcctctggtccagtgtccaagcggggcctccagagtggagtccacctcctacctcaccggtgcctggcctctcccaccccattaggagtcctccatcagttccgctttgggtaaagcaagctctgttgtgacagtttggaaacggttcaccttcctggcctaggaatgcaaacaatggccaagggcaagcacgttttaactgaactttaaaatcgtgctttcctcacagtaggtgaatttcacgctcaacacatccatgtaaacagtccccagagcagcccttcaaggccccggccagtccccacctccccacagactcctaacaccatgatttaatgtggcttgcacatttttaaaggcttttgatatttattagcaaaagatgcgagagccaccctgctgggctagcgctcccttctgggggaaactgaggcagggcgcacgcgaccctctccactgcgcccagttagcagatggcggcgtcaggggtcgacccgggtcggaaaactcgctggcgctgcggcactagggcgccgggccgctgactcgccgacccccgtcccgcccccacccccgcccccgcccctgccggccgccttagcgcaactccccgccccccgaccagcttcggcctggagcacgacggcgcgcccggcagcggctgcggccccagcggacacgtgatggcttcggacggcgccgcgccccgcgccggcctcgcctggtccccctgcagccgccggcagctgctgagcctgctcaggtagcggccgccccgtgggaggggcgcgcgagcctccagccagcccgctgggccgccagcgccacctctctctacgtccgtccccactccgcattcagccctccttcctgtcccacccctccgtccaacccacccctccgtccaaccccgcgcccaccgctccgtccgtggaggggcgggcgcgcgagcctccagccagcccgctgggccgcccgcgccacccctccctacgtccgtccccacctctccctacgtccgtccccactccgcattcagccctccttcctgtcctacctctccatcctgacccactcctccgtccaaccccgcgcccacagctccgtcccatcccgctgcgcccactcctgcgcccacccctccgtcccaacccctgcacccacccccccgtcccacccacctgccccaccccctgcacctccccccgtgctgtcccactctgcggccacccttctgtccaacccctgcgcccaccgctccgttccaccccctccctgcgcccacccctgcgtcctccctcgcccccttgcgcccacactttcgttccagccaatctgggcacgcacccctccgtccatccccatcccgccccttgactccacatacactccctggttctctcccacttgcctacacccacccctgcatcctaccctcctccatccacccctccatctcagccccctgcacccaccccgttcctgggcccaccctgttcctgcacccaccccctcacttcacccccttacccttcgtctgcctccacccgcccctacccctccgtccactctccacgctccatcagtcccacacccctatctcccccacccgcgtacatgtatccctgcgtccccttcccgccgaccgcaccgctcccgggcctaacctgcatctgctccatcccactcagacccgtccctccgtcgccgctccctctgctggccacccacctctgcgccggcaggagccttagtcttggtcccagccaagagccggctcctggtggggggcgcgggccgagaactcctgttcccactcacaaaaggccacgcttccaaacgcttccatcctcgtgcccactcctccgtcccgcctcctcccggtgtacaccccgggactgagccgggcctgagccgggccttgtcgcagcgcaggacgggcgcgctgcgtgtgggacccgccgcggcctcaacccgggtccgcggggcacccgccggatgcgcagcctggcctctactacagcgccaacgagcagtgccgcgtggccttcggccccaaggctgtcgcctgcaccttcgccagggagcacctggtgagtctgccggcggtggcctgggattggctgtgaggtccctccgcatcacccagctcacgtcccccaaaacgtgcatggtgagaacctgctgggtgccgtgctaggctgaggtactaagccagggcggcttagtttaatgctgtctgtgccctctagaaattatttaaaatgtttgaacaaaagctccaacatttttgtttgactgggccccacaaattatgtagctagtcctgggagggcccctgtgcccaaggactcctggctgagtgaggacaccaatcttaaacagttaccaaggacttccccatctattgtggctggagtcagactggagggcttcctggaggaagtggcctctaaactgaacccacagcagaagtggggctggtagggggaggggagatgaaggagagcaggcaccccaaaagacagacttcctcgcaggattgcataggacattcatgggctccaggcacttttgccttgatgggccccttcctccacaaaaaaattgagaattatgttttaatattcttatacaatgtataaagttttatgtgttactataaatacaagtctttttttttcctttttttttttttttttgagacagagtctccctctctgctcactgcaggctccgcctgccagattcacaccattctcctgcctcagcctcccgagtagctgggactacaggcgcccgccaccacgcctggctaattttttgtatttttagtagagacggggtttcactgtgttagccaggatggtctcgatctcctgacctcgtgatccgcccgccctggcctcacaaagtgctgggattacaggcatgagccacagcgccccgccaagtctttttttttaaattattttgagacagggcctcgttctgttgcccagggtggagtgcagtagcacaatcatagctcactgttgcctcaacttcttgggcacaaacgatcctcccacctcggccttggagtagctgggactacaggcacatgccacaatgcccagctaatttttaaattttttgtagagatggggtctccctttgttacccaggcttgtctaggactcctggcttcaagccatcctcccacctcggcgtcccaaagcactgggattacagacatgagccaccacccacgcctgatcagcaaatctattaatattatatattacaacattaattttgacctggaagttcattttttcattttttttttttttttgagacagagtctcactctgtcacccaggctggagtgcagtggcacagtcttggcttactgcaacctccgcctcccaggttcaagtgattcccgggcctacgcctcccgagtagctgggactacaggcatgtgccaccatgcccagctaagttttgtattttttagtagagacagggtttcatcatgttggccgggctggtctcgaattctgacctcaggtgatccgcccgccttggcctcccaaagtgctgggattacaggataagccaccacacccagcctagttcatttttttcttctgattttattttatttatttatttattttgagacggagtctcgctctgtcacccaggctggaatgcagtggctcaatcttggctcactgcaagctctgccttcagggttcaagccattctcctgcatcagcctcccgaatagctgggactacaggtgcctgccaccacacccggctaattttttgtatttttagtagagatggggtttcactgtgttagccaggatggtctcgctctcctgacctcatgatttgcccgcctcggccttccaaattgctgggattacaggcgtgagccacagtgcccggcctttttccttctgattttaaaagaaattaggccaggtgtggtggctcacgcctgtaatcccagcactttgggaagccaaggcaggcggatcacctgaggtcgggagtttgagaccagcctgaccaacatggagaaatgccatctgtgctaaaaatacaaaaaattagccgggcgtggtggcgcatgcctgtaatcccagctactcggaaggctgaggtaggagaattgcttgaacccaggaggcagaggttgaggtgagccaagatcgcgccattgccctccagcctgggcaacaagagcgaaactgtctcaaaaaaaaacaagaaagaaaaagaaattaaaacatttgcctcttgagcttcaagtcagtgacaagttaagaaggaaaaaaagaaaaaagacacaaaaaacacatttccatgggcccccaaaagtgtgacaggacctggtcatggtcccggttccccatcgatgggtcagtcatgccttgtcctctgagggcaccagtgcccacggtgcagagtgttggctgtgtcagtgtgtcctgcagtctgggagggacagttaaggttggacactggcctggaaggccctggtggcccctgagctcgccacccacctgtccaccctcctaggatatgtgccaggccctctcctgccacacagacccgctggaccaaagcagctgcagccgcctcctcgttcctctcctggatgggacagaatgtggcgtggagaaggtcagagccaagagtgaatgagtgggctcctgtgagcacgtgcacgtgggtgcctccagccaggccgccctattcctaggtcaggaggcaggaccagtatggggcagagagtcttggagttggccttggggactgtcctttgggttggtggtctgacctctttcctttagcatttgctcccatgcagaatgggaatgtgggctgcctgttgtatggggggtgcccatgggtgtggggttcctttgggtggggtccctgtgtgaaggtccttgtggatatggggtgtctcggggggatccctgtgtaaggggtccctgtgagtgtagagtccctgtgggtggggtccttatgtgtgtgttggaggatccctgtgtgttgaggggtccctggggggttctgtgtgtatgttggggggtctctgggtgttggaggatccctgtgggtctgggggatccatgtggctggggtacctgtgtgttggggggtctctgtgtgtgttggagatccctgtgtgttgggggatccctatgggtgagttccttgtgtgtgtttgggggtcgctgtgggtggggtccctgtgtgtgttggggatccctgaggatgttgggggactctctgtgtgtgttgggagtcctgtggtggggtcactgtgggatgggagatgaagccatccttgccttgcagtggtgctccaagggtcgctgccgctccctggtggagctgacccccatagcagcagtgcatgggcgctggtctagctggggtccccgaagtccttgctcccgctcctgcggaggaggtgtggtcaccaggaggcggcagtgcaacaaccccaggtaccgcagggagggtgcttttctgtcagggagtgtggccataccatagtccctagttgaaggcagtggtcaccctgctgtctcaccctcctgtctgctgggcattttcagacctgcctttggggggcgtgcatgtgttggtgctgacctccaggccgagatgtgcaacactcaggtaggcctgcttcctggggtaggagggggcagctggtggcaccgggccctgggggagccaaagtgaccatctgtggttcacaccaggacacatttgagaaggacattggggccaggtgaggtggcttatgcctgtaatcccagcactttgggaggccaaggcaggtggatcacctgaggtcaggggttcaagaccagcctggccaacatggtgaaatctcgtctctacagaaaatacaaaaattagccgggcgtggtggtgggcgcctgtagtcccagctactcgggaagctgaggcaggagaatcacttgaacccaggaggtagagcttgcagtgagccgagattgggccattgcactccagcctgggcgacagagtgagactctgtctcaaaaaaaaaataaaaattaaaaaagagagagaaggacattgggaccccagttcataaaccaggccagtcctgctgatgcccacagagcccctgaagcgtcccgcctccctccctgagtgccactttgccctccagagcgcatctctgcagggagaacctccccactaggaatacagtgcgctgctgcatgcctgcaaaggaattttttaaatattatttttatttttttagacagagtctctccctgtcacccagactggagtgcagtggtgctatctcagctcactgcaacctctgcctcccaggttcaagcgattctcctgcctcagtctcctgagtagctgggactacaggtgcccgccaccacgcccggctaattttttgtatttttagtagaggaggggtttcaccgtgttagccaggatggccttgatctcctgacctcgtgatccgcctgcctcggcctcccaaagtgctgggattacaggtgtcactgcgcctggccgaaggagtcttttatttataaattgaggtgacattcatgtagcatgaaatcaagcattttaaagtggcaactcagtggcctttagtacactcacaaggttgggcaagtactgcctctgtctagtttcagaacgtttccagtactctggagtactctggagtgaaccccatatggtaggctgtcactccccatttctcctccgccactcagcggccattggtttcccttctgtctctgtggattgacctgttctagacatgccacgtacctgaggccagacaacaggtgtgcttcctgcctgccttcctcccccagcggcacgtccccaaggctcacctgtgttgtagcctgtgtcagcgcctcattcctctttctggctgaatcatattccactgcagggatagaccacattttcatccagtcgtctgctgatggacatctgaggtgttttcaccttttggctcctgtgaacagagccgctgccaatgtgcttgtacatgtttgaatccctgttttcaattcttttggcagtatgctgaagagcggagttactggatcgtatgggaattgtatgtttgacttttttttttcttttttttttttttgagacagagtcttgctctgtcgccaggctggagtgcagtggtgcaatctcagctccctgcaaccttcgcctcctgggttcaagcgattcccctgcctcaccttccggagtagctgggattacaggcacgcgccaccatgcctggctaattttttgtatttttagtagagatggagtttccaccacgtcagccaggatggtctggatctcctgacctcaggtgatctgcccgccttggcctcccaaactgttgggattacaggcatgagccaccgctcccggcctatgtttgactttttttttttcttatttttttctttctttctttatttttttttttttagagatggagtctcgctctgtcgcccaagctggagtgcggtggcgcgatctcggctcactctaagctccgcctcccaggttcaccccattctcctgcctcagcttcccgaatagctgggactacagacgcccgccaccacgcccggctaatttttttttgtatttttagtagaggcggggtttcaccatgttagccgggatggtcttgatctcctgacctcgtgatctgcctgcctcggcctcccaaagggctgagatcacaggcgtgagccaccgcgcccagcatgtttggcttttaaagaaactgccaaaccgttttccacagtgcctgaactgtttcacattcccaccagcattgcgccagggttccagtttccccacatccgctgcagcacttgctgttttctgttgttgttttttcttttctcttcttttttttttttttttttttaatagagatggggttttgtcatgttggccaggctggtcttgaactccgaccccaggtgatccgcccaccttagcctcccaaagtgctgggattacacgtgtgagccatggcgcccggcctgttttctgttttttgattttggccatctcggtggtatgaaatggtagaaagattctttttacattgagttaaattctatctcctgcttcgatggccctgggtgtgggtttgtccctggctgtattacagttctgcatgtggtgagaccctccctttcctccttctccaaatggaccaccaagacctccccagaccgtgaggggagggtctttggctggagcacagggtggtgggatttcgtggaggcagtgtggtcagtgtggctgtccagggagtcaactccggttatcttctgtcagcccataaaagtccaagacgcctgcctgagtgcagaggcttcggtggtgaggtctttgctccatgctttggttacctgcctctaggtgcactacctaaagaatacacatccccgtccctgttttattgagttcaggccttggaagcagaggctctgagcgtaatgctctttcctggctttcttcttcgttgctgccctgtgttctttacggattccccggggttttcccatcaatagagagaggcaggcacttttgtcaccccagtttacagagcagggaaccgaggcacggcctggagctgaggccacacccacatcttgatcctgtactgtagggtgccatgtagtctcccagtgacaacacccgccccccgccccaccgccatccccctcctctgcctcctcctggccaggcctgcgagaagacccagctggagttcatgtcgcaacagtgcgccaggaccgacggccagccgctgcgctcctcccctggcggcgcctccttctaccactggggtgctgctgtaccacacagccaaggtggggcctgcggagtgtggggttgggggaggagccagccctggagaccctcggacagggcagagtcataggggggttggcctactatccctccagcactgggcaaagtggttcaggctctggcatcccacagaccatggatgacatagtggccaggcctcgctggtagatcaggcactgacatcccatctctgagtctcaatttcccatctgtgaaatggagataatagcagtaggtccctccctgggcgctacaaggattcagggagataatcggaaaatgccaagtgtgttccttggttcatgatactttttttgtgagacagagtcttgctctgtcgcccaggctggagtgcaggggcgtaatctcagctcactgtaacctccgcctctgggattcaagggattcttgcccctcagcctctcgaatagctgggactacaggcttgcactaccatgccggctaatttttttgtatttttagtagagatggggtttcgccatgttggctaggctggtttcaaactcctgacgtcaggtgatccgcctgcctcggcttcccaaagttctgggattacaggcatgaaccattgcgcccagccttggttcctaattcaataccattaattattagattagattaggatcgtgattaggattattgccttaggaggtgggatgtggggaagatagaaacccttgccccagatgcaaaggatgaagctgggtgggggctgggggacttgcccctcctgctcggttcaggacaccctttttcactctgccctcccaggggatgctctgtgcagacacatgtgccgggccattggcgagagcttcatcatgaagcgtggagacagcttcctcgatgggacccggtgtatgccaagtggcccccgggaggacgggaccctgagcctgtgtgtgtcgggcagctgcagggtaggcgtgtgtggacattggcgatggccctggggcctacctgtcctatcggaaggctcctgggggcaggttggtgggtgctggccctgatggagctgcagtgccctctgcaggggagtggtgctggggaaaaggatctggacttggagtcagcctgggttaagggctgcagtgtgaccttgggcaagtcactgagccctctaagcttgcttcctgtgtagatggtggggtgctatagaagtgttgctggttttgtggatcccagaatctcagagctggcagggctgcagagtcattgaggccagcaccctccagtgacacgggccctctgtccttccctttgcatagacatttggctgtgatggtaggatggactcccagcaggtatgggacaggtgccaggtgtgtggtggggacaacagcacgtgcagcccacggaagggctctttcacagctggcagagcgagaggtaggcggcctccctcggggcagaggctgggcttcccccagcctccaagatggccacagcccagagcgttggtgcaggggctgctcaggtcacagggcctgcacactcactcagccctggatgcctcctgtggtgtcagcgtctccctcttccacttcgccacccttctgtggcaggctcaggttttggccttgatgctgctgggactgtggtgcctcagtaatggtcactcactgtagccgtgctgcaaaaaaaacacagacattggccgggcgctgtgctcacgcctgtactcccggcactttgggaggctgaggcgggtggatcacctgtagtcgggagatcacctacagcctggccagtatggtgaaaccccatctctactaaaaatacaaaaattagctgggcatgatggcgggcgcctgtagtcctagctactcaggaggctgaggcaggagaattgcttgaacccaggaggcagaggttgcagtgagccgagatccctctgcactccagcccgggcaacagagtgagacactgtctcaaaaaaaaaaaaaaaaaaagtatggacgttgtgcattctgtggcagctaccctcttctctcctgctcaagaaatcccactgagagggacacaagtgaatgagagggatggtagttacatttggaaaatctttgactttggtgtatatatgaggtcaaaaaccatttgcaaatgccagtgcttctatggagagcagagacttgagccctgcctccctctggcttgccccactgtgctggagaaccttggacccggtcccttctcccagccagggcagagccttggcaggtggtcctccagcctgcttttaattgcccccatgacaggggactcactgctgctggagccagccccatggcattgttcaatttttcccgaccagctaagatcagctccctttgtctgtggtgtggtggctgtgaggtccacgcatctctccttcttttcttctttctagaatatgtcacatttctgacagttacccccaacctgaccagtgtctacattgccaaccacaggcctctcttcacacacttgggtgagttgactggaggactcccacccagttagctagactgcaaaggtgcagagcactgttgccaagatgccctcacttctgacatcacccgcaagttcagggggttccccaaaccaccctcaggcttgatagttgactaggaagactcccagagctcactgagagctgtggcacatggctgcggctccttccagaagaacacaggttagaattgtccaagggaagagatgtaggcagagtctgggagggtccaaccaggaggcctgatgtctcagggatgtgacacccttctagcattggagcgtggccatacgcatggagtattgcccacacagaaagcccactgagtgggagttgagagtttttcctggggtttgagtgcaaagacatgattgactaattggccaggtggatactctcagtctcttggtgacccagcccctatcctaaatcacatagttggtctttctggtacagccagcccctgccctaaaggaggacacttctgcctggtgtgacccgtgtttcctcttggaagccaacagcaaaagctggacttctctttgggcaaggcccgcttctttgctattgagggccacagtgggtctttctggagtgtgtctgcacctaacctttgaagccttggttgccggcacttgccatggggtccctgagccctgagcctgttgagttctgtgcgtgagtgcacttggtcatagcactcaccaggttgtggaaagaggcctagagcctccgctgtggggaagcctctagctcagatgcctgtggctccttagaggagggctggggaccccgggaaggagagtcactgacatgtgcctgtgaggaggatgggtgctcagctccacacggctaacagggctggttccccgacagcggtgaggatcggagggcgctatgtcgtggctgggaagatgagcatctcccctaacaccacctacccctccctcctggaggatggtcgtgtcgagtacagagtggccctcaccgaggaccggctgccccgcctggaggagatccgcatctggggacccctccaggaagatgctgacatccaggtcagcaggagagcctgggggaggccagtgggggcttcttcttgggggctatggctgcttgctcgtttgtctatccatccattccctgattcgttcatttattcattcagcggtcacttacaggggacccactatgtgttgggccctgtgctaggcaaaatgtagctagctcctccaggggcttagggtcccacaaatatccaaatgtgtctgtgcccagagcccgtgggagaaggccctgcagttctgggatcaggtaaggttggagggcccaatgcaggggtccagggctccctgggaaagagtgatggagctgaggtgtcagatgagcagatgttgctgggccaagcagggaaggaagcgtatggctgagggaacagtgtcagtgtgggagggatgaaggaaggtcctactgtgtgggtttgtggggagatgaaggcatggacgcaggtgcagtggcatctggggagtaggccttggtgctgaggaagctgagaacagatgctggctctcactgcttctttggtgcagtgtgtgtgggaaccggaaggccttgttcaggcgtgtcctcagtgacgtgtgctcgcccatgtatgtccccattggtgcttcgctgaggaaggcacgtggagggtggagagacataagcgcaggctgaaacagacctgagaaccttgggagaggggcccagtctcagcggccggagcagcgtcctctgcccctacagcagccagagacaggagggcctcccacagatcaggccaggccgggccaaagcaagcccctgtgagcggcttatcccttctcttcccctgatatggttcccttcctcccctccccttgcctgggacattgtatccagatgctagctgccgagtggctctcccatcatcctctgcagtgtgtaaaaaagcagattcccgggtcctctgcatattccctgaatcaggacttccctgtgttgggcctgagaaaccgcaccgtaaccaacacaggcttgcggcactggccagatgtgggcatcgagggggcaggtgcggaatgtcacctcgccctgggctctggccttcaggctggcctctttcttgggctggtcttgggcacaggacccagttaccctcctgaagagccttaggcccaggaacctgctgaagttcttcctagtgctctccgggccagtcccaagccagtagctggccacaggtccccagggatccagtttcttcctgccgaccctaccacaggtccccagggatccagtttcttcctgccgaccctacgggcctcagctctggctccagaagcactttctgtgctggccctgccctagcccttcttgggctccttagcccagcctaaggtgggcctgcctcctccactgcactttatcctctacccagccagcttagggaaccttctctgtgctgcccaaataccctatcatgtaacccaccaatgacttggtaattacctccccgagccctctatcccaacccactgagagctccttgcagctcagccagtgtcctgtgcactgtgctatccccagagcctggtacaggtcagtgttggtgattgcttcccgttatttttgtctttgttgtttttttagagagggtctcactgttggccaggctggagtgctatgttgcccaggctgctctgaaactcctgggctcaagtgatctgcctgcctcaggctcccaaagttttgggtttacaggcatgagctaccgtgcctggccagtgattgcttgctgaacgaaagattatagggatgcaagaagaagttggaaggcttcccaggggaggtggccatgacagtgaccctcagggaacccactggacaaggcctgaagctctttgtctgcaggtttacaggcggtatggcgaggagtatggcaacctcacccgcccagacatcaccttcacctacttccagcctaagccacggcaggcctgggtgtgggccgctgtgcgtgggccctgctcggtgagctgtggggcaggtgagacctggggaaggctcatccacagcacggcttgcccctgcagggaggcggcctagccctccctcttccctcccagggctgcgctgggtaaactacagctgcctggaccaggccaggaaggagttggtggagactgtccagtgccaagggagccagcagccaccagcgtggccagaggcctgcgtgctcgaaccctgccctccctagtgagtgtggtgctgtctgcgcagctccaagggggagagagggttccgctggggctgctgggctctgtccctggcctatggggcccatgtggcagggccgggctgagctgctcctgtgcaggctctcattacccctgcccacagccctgcaaggggggctctgtgagtgcccccattctgcaggtgaggacactgaggcttggggcagacatggtgacaatgtcagcccagtgggacccacacctgctgccaccttgtctgggccaccgaggcctctcttgagctcaggtactcatggtgagatggaggtgattgcctacctggagggttgtagggagacttgcggagctcctggtgcaaagcccctggctgtcaccacacctgacggggcacactgttagggacgaggccattcctgctgggtgcaggacagggcagctgctcaccagcctgtgattcggttgtcctcaggctcagccgtctggcagcctgggaacacctggagaggctaggctggccgtagtgcccattgcttgtcccagaccgggggagtacatcagcacctgccaccccatcaccccaggccagcctgggacctggccagggtcccgacgctctgtctccttcctcagctgggcggtgggagacttcggcccatgcagcgcctcctgtgggggcggcctgcgggagcggccagtgcgctgcgtggaggcccagggcagcctcctgaagacattgcccccagcccggtgcagagcaggggcccagcagccagctgtggcgctggaaacctgcaacccccagccctgccctgccaggtgagcccagggctaggtggggctgggagagggccttcctggcagagctcgtccctgcgctgagcccccatccttctgagaatcccctcctcctgaggcctccggcggggcctcaccatccagggtgatgggcagtgtcacctggcggttgtaagtgctgctgtcagagttccttactacccaggagagcctgggcccattgtttccctctctgagcttccgagcccctgctctgaaatggggatgccgacctgcctggggagggggggcttcgaggatgaggtcaaactgaacggagtgggagatgtcactttctcatcaccaccatctcccccgtgcccacgtggctgcatctcatcccctcagtgtccaagttgacagtggcttatcatcctgccctgccactaacgagctgagtgacagggcaagtcccctcctctgtgggcttcagttttgcgacctgtccggtgggaggggattggtctggattgttggtggcccactcatagctctggactcctttccccgcctcgtcatccgtggcagacaaaacagtcaccactcttccccgctgaggccagatagggcctcagaatccttctcacacagctctccaggcagccactttagcgcagggctgactcacagctgaaacccattggccacccttgaacctggtgatccaattccatgtggcacctgtttctctgcacctgctatggtgcatggagtcagtgattacctggctggaggtcggcctctgcctctggagagtaggagggatgggttctcttttttttttttattaaaagacagagtcttgttctctcacccaggctggtatgcagtggcatgatcttggctcactgcaacctcctgcctcagcaagtgtgcgccaccaagcccaactaatttttgtattttttgtagaaacagggttttgccatgttgcccaggctggtctccaactcccgggctcaagcagtctgctcacctcagcctcctaaagtgctgagctaccgtgcctggccagggataggttctgtctctgcaccctgggtgcaggtggggtgcctgactgttgagcagcgagtgcttgttgaatgggaacctgctggctgatgaatggggaacccggtgcttcagggagagaccctgagcttcacttctctgtggggctcctctttgggctcctggatgttggggagcaggtccccttcctccctgcccctagcagctgggctataccttcccctgggtggcagaggcagggcctgatgactgtctcatgccatcctcaggtgggaggtgtcagagcccagctcatgcacatcagctggtggagcaggcctggccttggagaacgagacctgtgtgccaggggcagatggcctggaggctccagtgactgaggggcctggctccgtagatgagaagctgcctgcccctgagccctgtgtcgggatgtcatgtcctccaggctggggccatgtgagtgccctgggcatgagggtggctggggctgttgagtcctttacctggctgggagaacgaggagcacccattgccaccgtcctccaggccagagcaagaacaccatccttctgtgggaatgctgtctgagggccacccctgctcagaaaagaagcttagaaagagggctcagggcccctgggaaggctcccattccccttgcaagccgggctgagggaagcatctgaggagagtgtaatgcagctgctgtgcagagaaatgctgccaggctcccgcctggcgtccaggggctggaggctgactggccttgctctctggcctgggtgctggcaaccctcgcccctcatggctggggggattgcagggccaggcatgctcccatgtcccactcttggtccccagctctcggccaggcccacagtgagcactcatgctgctgaggagcctgcaaaggtggggtgtgcagcaaggatacccgctgcgagaccggggagccgatctcgccaagggaggaggggagggagcccctggtgcacacacgccacttcctggtctctctgctgctgcctgagaagatcgagacggggatcgctgggtcctcagaggaggcccagacccaccagcttgttgctattccccacagctggatgccacctctgcaggggagaaggctccctccccatggggcagcatcaggacgggggctcaagctgcacacgtgtggacccctgcggcagggtcgtgctccgtctcctgcgggcgaggtgagggcccccgggatgctcctggggaccagcactcatggtaactctcctgtccacttgcatcttgcctcgttctgaaaagcatttgaggtggattgcagaaaatccagactatatgggaacacgtggtaatacacaaggagactaagcatagtagctgacagccacttcaaatgtgggtgttgattggctgaaaggtaggaaaagacaataacgcccggcagtgtggcacgagagccattccttatggtcctagcagagcggccggggggtccccaattgatgacccgagcagagaaaccttagctttaagatacacagcgttcttctattttcccaatcttgttttattgcagtataacacagatattataaaatttaccatccaaactgtttctccctgtgcaggtcagtggcataaaagcacagtcacattgttgtgcggccatcaccaccaacctctccagaacttttccagtttcgcaaactggagctctgtccctgtgaaacacgaactcccatttccccctccgcagcccctggcaacctccattctcctttctgtctccagattccacaattctagggaccttgtagaagtggaatcatatagcatttgcctttttgttactagttttcactcagcatgatgtcctcacagttcatccatgttgtagcatgtgtgagtgtttccttcttaaggctgaaaaagattccattgtgagtgtatcctttacaggtttatccatttattcatcagtggacacttggcttccttccacactttggctattgtgaataatgcttctgtgaacatgggtgtgcaaatatctgtttgagttcctgctttcagttcttttgggtgtatatctagaagtgtggtagctgggtaagatgagaattctatgtttaatttttgtggaactgctggactgttttccccagtggctgcaccattttacatttccactaatggtgcataagagttccaatgtcctcccatccttgccaacactttttatttctatggttttttttgtttttgtttttgtttttgagacagagtctcattctgttgccgaggctggagtgcagtggcatgatcttggctcattgtaaccttcgcctccggggctcaagtgattctcgtgcttcagcctcccgagtagctaggactacaggcgtctgccaccatgcctggctaattttttgtttagtagagatggggtttcaccatgttggccaggctggtcccaaactcttgacctcaggtgatctgcctgccttggcctcccaacgtgctgggattacaggcgtgagcccccacacctggcctatttctgtgttttttttataatggccatcctaatgggcttgagaagacacaccatgttcttaaacgaaaaccctgaccacttgctcagtaaaatgtcagcctgtttaaaaccgagaccaaaaagagatttctttttctctcttttcttttttgagacaaaaaagaaaacctctgtcaccaggttggagtgtagtggcacaatcttagctcactacaacctccaccacctgggctgaagccatcctcccccctcagcctcctgaatagctactataccctgctaatttttgtagttttggcagagatgggatctccctatgttgcccagcctgatctcctgagctcaagcgatccttctgcctcggcctctcaaagtgctgggattataggcatgagccactgtgcccaaccaagagattttttttctttttcttttttttcttttttttgagactaagagttttcctctgtcgcccaggctgaagtgcagtggtgtgatcttggctcactgcaacctccgcctcccatgttcaaacgattctcatgcctcagcctcctgagcagctgggactccagctatgtgccaccacacctggctaattttttgtattttattttatcagagagggggtttcgccatgatggccacgctggtctcaaactcctgacctcaggtgatccacccgccttggcctcccaaagtgctgggattacaggcatgagccactgagcctatttcttttgaggatattcctaaaagagagacttgagaaaactggccctaataacatctttatgatagacacaatcagagattttcatattgtgatttttttttcttttttttttttttgagatggagtctcgctctgtcacccaggctggagtccagtggcgcagtcttggctcactgcaacctctgcctcctgggttcaagtgattctccgtctcagcctcctgagtagctgggattacaggtgcgcaccaccacgctcagctaatttttgtatttttagtagagacggggtttcaccatgttggtcaggctcgtctcgaactcctgaccttgtgatccgccgcccaaagtgctgtgattacaggcgtgagccactgtgcctggcccatattgcaattcttataatgcctctcggtcaacaataacagctaccatttgtcaagtgtctactgtgtgccaggcacttgttatcttcccttttaaaaatctttataaatgattctgcaaggtagatgccattatctttttttctaaatctaagattcagagggttaagtcagttgtctgaggtcacacagctggtaagtggcagagccgggattgaaacccatgcgggccttatgtgctagaggtgtccagtgagcctgggctgcagtccttgctgagcctgtcccttggggctctgggtctctgctttgtccacgcaggtctgatggagctgcgtttcctgtgcatggactctgccctcagggtgcctgtccaggaagagctgtgtggcctggcaagcaagcctgggagccggcgggaggtctgccaggctgtcccgtgccctgctcggtgagtgaggggagcaagactgtgtgctggccttctccctgtaagtgggagacccgagccttggctccatgcccggtgacctgcggaggggggcaggtgctgctggctgtgcactgtgtgaggctggaccatggccgccccatccccctgcctcactccaagtgcaggccagagccccggcccagcccctttgaggactgcaacccagagccctgccctgccaggtgggccccttcccaaggagacagggggtgctaggtctgcatcctggctctttcctcacctccaagccagaccttttgaccctcagtgtcctcaccagtgggagcaggtcattttgtgcccccagaagactgggggagtttaatgaaaggattagatgcatgtaaagtacatgctaaatgcaatgagtgtaaaatgcatgctcgatgcaacgcgtgtaaagtacattgcacaggatctgggatgctgtgggtgcacatggttgctggtgcgtttcttcatcgcctgctctttatggagcacctaggccccggggccgtcctggagctaggggacacagcagagaacaaggcagacaaatgtccctgacctcctggagcaaatgcagggggaaagggggacagataataataggacaggcggggaatgcagtttgatggatggtgttcagtgcgatgcagccaaacacagcgggaggggaggaggggagggctggcggggtgggctccagggcggtggtgctgggatcactgttgaagacagacatgcagggcccttgggtgcccggacccctgcccccactgtctctgggatacgacatctgtcgtttgccctcacctttctcttctgtaaaatgggtttgtccaaatgttctgtccactctgccaagcctcttggtgaggacacaagggggcctccagaaagagaacctctccgggcccttcccagcttcctgtctcttcctagtctggggaaatgaaggggagacctggctcccctgggttcccaggccctggggctgtttggggtccctgactccagtttgctccaggtggcagtacaagctggcggcctgcagcgtgagctgtgggagaggggtcgtgcggaggatcctgtattgtgcccgggcccatggggaggacgatggtgaggagatcctgttggacacccagtgccaggggctgcctcgcccggaaccccaggaggcctgcagcctggagccctgcccacctaggtgagtcagccggtgatgggaggggcagctcctggtgtgtgcagatgccaggccaggcgctgtggtgtgtgcctgtaatcgcagctacttggaaagctgaatcaggagaaccacttgagtccaggagtgcaagtccaacctgggcaacacagtgagacctcatctctaaaaaaaaaacaagacggggccaggtgtggtggctcacgcctgtaatcccagcgctatggaaggctgaagcgggtggattacctgaggtcaggagcttgagaccagcctggccaacatggtgaaaccccatctttactaaaaatacaacaattaggctgggcgcggtggctcactcctgtaatcccagcactttgggaggctgaggcgggcagatcacctgaggttgggagttcgagaccagcctgtccaacatacagaaaccctgtctctactaaaaatacaaaattagccgggtgtggtggtacatgcctgtaatcccagttacttgggaggctgaggcagaatcgcttgaaccggggaggccaaggttgtggtgagccaagattacgccactggactccagcctggctaacagcagcaaaactccatctcaaaaaaaaaaaaaaaaaaagaaaacccacaaaaattagcctggcgtggtggtgtgcacctgtcatcccagctacttcagaggcggaggcaggagaatcgcttgaacccgggaggcggaggttgcagtgagccgagatggcgccgctggcactccagcctgggctacagagcgagactccgtctcaaaaacaaaacaacaaaacaaaacaagacggggtggggggctcagtggcccaagagccagtctgtaaggaatagggctacctggcaggctgtgctagttgtgggaggtgaagtttaagcaccatgcaggcagggtgcagtgtggggaggcctgggggacagaggaggcagcatttgagcagaacctaaagctgtgagcaccagcattctgatgtggaagacgggagggatggaggtctccacagggacacacacagccacactaggacacgggacagaatcatgttcaagtccgtggggtccggagcccagtggtaaagggcgaacatttgcctacctcatttacaattctttaatggtttctttttgtaggtttgcatttttagtaaagaaatacttttctatatcatacagaaacgtccagaaaagaatgtaacagacatgtatgttccagcactccagtttaatagatagcatcctactgccatgtttccttcctgtccacttacttttatttatttaatttatttattttgagacggagtctcgctttgttgcccaggcagtgatgcaatcttggctcactgcaacctccgcctcccgggttcaagccattctcctgtctcagcctcccaagtagctgggaatacaggcacccacaaccacacccagctaacttttgtatttttagtagagacagggtttcaccatattggtcaggccgatcttgaactcctgacctcaggagatctgcctacctcagcattccaaagtgctgggattacagatgtgagccatcacacctggccagcctccttagttttaaataaatccagttacagataagatttcacttaaatttaggctggtcatggctcacgcctgtaatctcagcacttcaggaggctgagatgggtggatcatttgagcccaggagtttgagaccagcctggacaacatgccaaaaccttgtctctactataaatacaaaaattagccgggcatggtggtgcatgccagtatccccagctactcgggaggctgaggcaggagaatcacctgaaccttgggaggtcaaggctgcagtgagcagagatcacaccaccactgcatgccagcctgggcaacagcatgagaccctgtctcaaaaaaaaaaaaaaaaaaaaaaagattttacttaaatttaaaccctgtactaatctgtgatttatttggagtatgttgcaaagtagggaccaaaggatttttttttttttctaaattgttaactagcatctgttggacaagccctgatgcctccaggtggctccttggtggtattggtgtgtgttagaatctatgtctgggctttctactgggtttttttcttctccttttttttttttgagacagtttttctctgtcacccagggtggggtgcagtggcgcgatctcagctcactgcaacctccgcctcctgggttcaagtgattttcatgcctcagcttcccgagtagctgggattacaggtgcccgccaccacccccaactgattttgtgtttttaatagagacagggtttcactatgttggccaggctggtcttgaactcctgacctcaagtgatctgccaggttctgttttttgtgctttttttttctagctattctcttgcccatacaaaattgttttaaatgttgtagctttataaccatttaacatctgtgtcactagtgtgtcctgatttctttgcctatgctaaagtcccttggctgtgtgtcccatttatttttccacatcacatttagagatgatctgggattttatgggaattgcagggtttttcacactgcacgctgcctgcatggtgcttaaacttcacctcccacacctagcacagcctaccaggtagccctgttctctacagaccacctcttgggccactgagcctcccctcacttttttttagagatggggtctcactatgttgcccagtctggacttgaattcctgggctcaagtgatcctcctgcttcagcctcccgagtagctgggatgcaggcacacactacatgagctctggccatccctctgacgttgctgtagccacgctggcctcattgtcctggaacattccagggatactcccctgacttagggcttctgtgctagctctcgctgcctgatgtcttctgtggatatcctcgaggccctggatatccctcccccaggctcggctcagacaccacaactccaaagtggcccagtgccctccctgagcgtcggtccagaacggcactctcgtccctcctgtgacgctctgcttggcactttgggaggctgaggcgggaggattgcttgagcccaggagttctagaccagcctgggcaacatagtgagaccccgtctctacaaaaaatacaaaaattggctgtgcgcggtggcttatgcctgtaatcccagcactttgggaggcgaaggcgggcagatcacgaggtcaggagatcgagaccatcctggctaacacggtgaaaccctgtctctactaaaaatacaaaaaattagctgggtgtagtggtgggtgcctgtagtcccagctacttgggaggctgaggcaggagaatgacgtgaacccaggaggcggagcttgcagtgagctgagattgtgctactgcactccagcctgggtggttgcagtgagctgagattgtgccactgcactccagcctgggcgatgagtgagactccatctcaaaaacaaaaacaaacaaacaaaaattacaaaaattagccaggcatgatggcacatgcctgtagtctcagctacttgggaggctgaggtgagaggatggcttgaaccctggaggttgaggctgcagtgagccgtgatcacaccactgccctccagcctgggtgacagggcgagaccgtgtctcaaagaaaaccattaaaataaaataaaaaataaaatttctgcgatgcacacgacagcctccacagcaaatcagcatccagttgctcatgccagtgatgccccaatggagaacaatccacgctctgagaggaggtggggtctggtttggttcactgccacctcccagtgtcatgtagaacagtgccaagccgcggaaggcacgggtccaagaggcagcgctgcagggtcatgggggagcacagtattgcgatgaagatcccagctcccttgcaggctgcctgggtttgtgtctgggctctgaagaatgcgggccataattagttattgattgattacagatcaacatgggcagccttcccttgcccaagggaagggaactcggccttcccttgcagaacgtggggtgttgagatctgtctcctgttacccaggggctcgcttcctgttgctgttacttgggtccataggcaacccctggggtgctgacaggtgttctgtgataaaggcgactagagggggatgtgcaattagggaaacaggggcctcttccccctagggccttttggtagctctcctgtggccgtgagccctggccccagacaggaggggctcagtggctgcactttccatcttgcctggccacggaagctgtctaggcaactgtccgagtacacgtgggtggagaggggcctgcgtggggcagtactgtctctggggagacctagcctctctctggggtcttctcttcctgcaggtggaaagtcatgtcccttggcccatgttcggccagctgtggccttggcactgctagacgctcggtggcctgtgtgcagctcgaccaaggccaggacgtggaggtggacgaggcggcctgtgcggcgctggtgcggcccgaggccagtgtcccctgtctcattgccgactgcacctaccgctggcatgttggcacctggatggaggtgagcacagcgggcactcggaatccctatggggctggggtgggcatcagctgtggctcctcatgtgtgagggagtctaggaggcattggctcatcgtgtcccctgaaaggaaggagagagctgcgcccgttggtgagggggcacctagaggcagagagacagagggcctagagacctgcgggcagctaggacttaagaggcccttaggtttggggacgctggaagatgaatggcaggccactcagctctacacagatgagggaatgccagctgtgccacgcacctggcaaggcaggacagacaagggtaaatggggttcaggctgccccctggaggggctcgctcatggtgtggagggggcataggggcacagcagacagagatgagccgcagccccgcagacctgcttgctctaaggcttggagggacagagaggccgtgagggtgacagggacccagacttgaattatggctcctcccacctatatgacccatgcaaggtgccctctctgagcctcagttttctcatctgtggaatggagacacttaactgcctcccagcttgtacaaggattatattggatcactcctggcctgtggttaccactgtccttgtcaccttctggcagggtcagctgtgactcctcctcccctctcttggcagtgctctgtttcctgtggggatggcatccagcgccggcgtgacacctgcctcggaccccaggcccaggcgcctgtgccagctgatttctgccagcacttgcccaagccggtgactgtgcgtggctgctgggctgggccctgtgtgggacagggtacgcccagcctggtgccccacgaagaagccgctgctccaggacggaccacagccacccctgctggtgcctccctggagtggtcccaggcccggggcctgctcttctccccggctccccagcctcggcggctcctgcccgggccccaggaaaactcagtgcagtccagttatgtcctgtcctccttcctgtcaggcagctgctgcaggaggggtgggcaaaggcatcttcctctgggaaggactggcacaagcacttggtccctgggttgtgtgcctgggaggccgggatcagggctggccctctttctccctggcaaagcaaaacctcccttttactactatcaaggggaagtaacttgaaggtaggaacccagcttgtgagccccctagcctctgggctgctctgcatgtgccccctcttgctggatcatctggtagcagccctgtgccctgagggtgatgctctgacctatgcagcccccctccctgtcctgagaaggcttccagctgggccttggaggacagggtccacccctacctcctggtctccttcctcagcttggaagccccggagcctgccctgctgggaatcggggaagcactgcttacctgtctcctgctcccttttcaggtgcctgtggcaggcagcaccttgagccaacaggaaccattgacatgcgaggcccagggcaggcagactgtgcagtggccattgggcggcccctcggggaggtggtgaccctccgcgtccttgagagttctctcaactgcagtgcgggtatgtctagggccatgcaagcgatgctgccagttatgggccctgccaggagccagcacgacgctgcatgccccattcctggcaggagcccatgtgcattcccacctgtagtttgcatcccatctcatgactggggagtgatgatctgcattttacagatgaggaaactgaggctaggagagattaagtgatgtgcccagttacttagagtcacatagccagcagtgggagaggtgggacttgaactcggctcagtctaccctggagccactcctctgctgaccaggcgtgggagtgctggaccctcactgccctgccgcttcctaggggacatgttgctgctttggggccggctcacctggaggaagatgtgcaggaagctgttggacatgactttcagctccaagaccaacacgctggtggtgaggcagcgctgcgggcggccaggaggtggggtgctgctgcggtatgggagccagcttgctcctgaaaccttctacagaggtatggccaggccttctccacctcccttgggtgctccagtcctggcagggaggctgggtgggtgctgctggggatggggccagtcccagtggggcagtgggaagatacggagggaactgactgagatggaaggaactggggttggccagtgtcagtctgcacgtgccagggaggggtcacaggatgaatgctatatccctcctttttgggaccgtgcagcaagatggacggatgtgggacatggtccacatcctcagtcagtccctcaggcctctgccccacacccacctgccccgcccccacccctccagcctttcaagggcttttagggttttgtggaagccactgtccctcagccctgtttcagtgcactggtgtaagcagacatgcttgtacatgcatgtgcacccacaagcacacctcaggcagaggatgccacctcagggactccagccttgcccgtggccccctcgatatcctctgatagccctctcggttgtcctggggggcttgccctctcccaacagcccgagctggccgaagttggcttccctagctggttccagaggttcctcggctcccccaggtgtctggggcttagtggcaacaggggcttagcctctgcagagacctagtgcgccgcctccttgccccagacctgcccgggcagagagccgtgtatgtgtcccagtgcacaggcgctgctgggccctgccaaaaggccacaagcccactgtcaccgttcacattgcttctcgcttcccggcccagccccgcccacacaggcatctgccttgaaagaggtgcaggaggtacaggcaggtgggggctccagtgagctctgaggaacagcagtggccgccatgggtggagcctatctttgttgccagtttcagtgttaaacactcttgcacgtgtgacatcattgagtcctaaagaccactctgctcagtgcatgccattgtttccttcagttacagaggagggaaccagagcccagaacatttagcctttgcctaaagtcactgggccaggaagtggtagaggtggggttcagcaggatttgcctgggaaccccaatattgaccacagtgccatgctgccctgcacggctccctggctgtgagttgtcctggcctctggcaccaccggtctgtctgggttcctatgtccctatgtcccacctgcagaatgtgacatgcagctctttgggccctggggtgaaatcgtgagcccctcgctgagtccagccacgagtaatgcagggggctgccggctcttcattaatgtggctccgcacgcacggattgccatccatgccctggccaccaacatgggcgctgggaccgagggagccaatgccagctacatcttggtgaggcccagcatggggacttgtgctgtgattctggacagctttccctagggcgtgcagggctaggggacccccttcagtttatttcagactaaaaccctcaaaatcattagtgaaagaatgggagaagatagcttcctccacatattcaccaagaaatgttttttgagctacctacaagagtgaaatagtggctcacaactgtaatcccagcactttgggaggcccaggagggcagatcactcaaggtcaggagttcgagaccagcctggccaacatgatgaaaccttgtctctactaaaaatagaaaaagtagccaggcatggtggcgtgtgcctgtaatcccagctacttgggaggctgaggcacaagaatcacttgaacccgggaggtggaggttgcactaagcccagatcgcaccactgcactccagcctgggcaacagagtgagactctgtctcaaaaaaaaaaaaaaaaaaaaagcgaaatggtaaagaatggtaaagacctttctgatgtagactgacagctaacccaagactgaagcataattttacagtctgatataacttggacagaatagcaccctgcaccctccccgaggtttcaagtgtcctgggagaactgtgttctgcagggtatcagcttccccagaggaggcagcctggccccgctctggcaccctgactgtgtgtccttggggaagtgatgtaacgtccctggacctcggttttctgggtagagtaatggcgtattcctagtagggctttgtaagcattaaatgtgatccggaatctgtgagcccttgcacacgaaggcttccgtgagtgctaattattacttgtggccggtccttctgggctgccccttttctctcagatccgggacacccacagcttgaggaccacagcgttccatgggcagcaggtgctctactgggagtcagagagcagccaggctgagatggagttcagcgagggcttcctgaaggctcaggccagcctgcggggccagtactggaccctccaatcatgggtaccggagatgcaggaccctcagtcctggaagggaaaggaaggaacctgagggtcattgaacatttgttccgtgtctggccagccctggagggttgacccctggtctcagtgctttccaattcgaactttttccaatcttaggtatctactttagagtcttctccaatgtccaaaaggctagggggttggaggtggggactctggaaaagcagcccccatttcctcgggtaccaataaataaaacatgcaggctg

SEQ ID NO: 113 - DNA, 56654 bp, Homo sapiens
cgttcgggcagcggcctcttgttacccgggaggaacccgaggcccagagaggggctgggacgcgtcgttagggcccggggcccgcttgcctcagcttcttgctgccgccagcacgctaagctccagtcggcgccgaaggagagcttcccgaccctcgtgtccagtagccgcaatcccaggctgggagggtgaggcgccgcgctctgccgcccccccgcccctcgctccctgtgtcctggcggatttgcacgtaatctatccgaaagcccagtcccacccgccacccgactctggagctcccattcttcaggaccctgctgaagtatcgcttctcagccgccttctccaggcgcagctgcattcgcttctcggtttttgcactcgctgtgcaccgagttactttcccggcccctcgttgacaccgtaagctcgttcgttagatgttatgccttgcctttttcatctctagatcccagggcctagcacgtgatgataatagtcatggcttactgtacggaatgatcacaaattgtcaggtgctactgaatgcattacacataagggcccatttatttatttatttagagacggagtttcgcgcttgttgcccaggctggagtgcaatggcgcgatctcggctcacctcaacctccgcctcccgggttcaagcgattctcctgcctcagcctcccaagtagctgggattgcaggcatgcgccaccacacccggctaattttatgtttttagtagagacggggtttctccatgttggtcaggctgatctcgaactcccgatctcaggtgatccgcccgcttcggcctcccaaagtgctgggattacaggcgtgagccaccgcgctcagccaaaggcctatttaatcttcccaacaatcctatggggtgagttctttctatagcttcacgttttacccatgaagaaactgaggtattcatagaaaaagtaatttgccaggagtcccacaactaataagtggatggagctgggaaactgtccccagggcatttgatgacttgactagattgcctttgggtttaatcaacgtctgttgaattgatctttactttggccctgggagttattggaggctaggcttgtgatcagtattttaccgcgaaggcttagaaaggagaactggtcccagatttatagaggtcacaacaaaaccaaggctactggtacgccctctgttcctttagttcttctatctttctttgctccttttcgatcagaaagctgcagacataggtgtcattatcgctcactatttaagaagtgcccctcacagagctgtgagttcgtagtccatgctttaactaatgtaatgttcatgctttaacagctaatgtaatggagagagtgtagaatttggaatcagattggggttcagtcattgctctgccactgaccaagctataagttatatgcctccccccacttttttttttttttttgagacctggtctcagtcacccaggctggagtgcagtggtgcgatctgggttcactggaacatcctgtctcccaggttcaggcgattctcccgcctcagcctcctgagtagctgggattacaggcgcccgccaccgtgcctggctaatttttgtatttctaggagagatggggttttgccatgttggccaagctggtctcgaactcctggcctcaaatgatctgcccaactcagcctcccaaagtgctgggattacagttgtgagccaccacacccagcctgtttttttgctttttatataggtaatagagctgttagcattttgcaagaccattggtgataatatggatcatgttacctaatgtcctataatagtcagtaataatgggcacttgttataaaccaggctgtgttttaggtaggagctgggaatacagcattcgataaaacaatgcttttgcacttgtggaatttgcattttggtaagtatattacataataattagatagggacagaaaaagcatggtaaggtaaataaaagtactagtgttatgtggagaggtgatagtattttatttatttatttatttgagcatcttgtcccaggctggagtgcagtggcgtgatcacagctcactgcagcctcgaactccttggctcaagcagccctcccaccttaacttcccaagtagctgggactacaggtgaatgccacacagccagcaatttttttttttttaatagagatgggaatctccctgtgttgccgaggctggtcttgaactcctggcctcaagagatcctcccaccttggtgaaactctgtctctactaaaaatacaaaaaaattagctggtcgtggtggcacatgcttgtaatcccagctactcaggaggctgagacatgagaattgcctgaaccggggaggcagaggttgcagtgagctgagatcatgccagtgcactacagcctgggtaacagagccagatcctgtctcaaaaacaaaacaaaacactggatgagattaccttggaaattaatggagatggagaagaggtctgaagccttgaggtttccaaactttagatactggggagatgagaaaaggcagcaaaggagactgagtgggagaggccagaggttggaagagagcaacagagaggccccacatgagatttaaataaggagctgcatgctaatttgtttttttcaggagtaagaaacaaattatgtctgtacacaaatgtctatactgtagtttctttctcagtaaataaaatgtttgtgtcctcaagtatttttctgtttttgctttaagtgacaaattctatttaataccattctgcatcttagtccttgtagcatttatgcctctattccaagtttaggtggtagtgttgcttctcttttaaactttatttaaatactccttttgtagtattttggatgagagaggatcaaatacataatttatctcactcttctgtcactttccactccaggttcacaggtggctgttggtctttagtaagggtgctgtcttccctgtctgatccttagcaaaagtaggaaggtaggtcttgttcatttctgtaccactgtggcagactcctgatactgagttgaaattcatgagtgtttatgggataaattaatgtacaaaagaaatgaatctttccctttttcctgcagtaatgataacattggctcagtggtttacagcttagaagtacactgacactcattatcttatttagatgtaatccaatttgttacagtttgccagctactgctcttttccctttctcaggcacattgaaatttactttccctttgggggctctgctagtttattcctagcagatctgatctggcagtgtgtttgtaaaaggatgctgaactgtgtcttgaggaagctcagaatgaaatctgaatttcagaaagattcctgagataatttttctctgtctcttctcttttattcttgttttaataaattttagttttatgaggattgttttggttttaaaaaactttaaatcattttttaaaactattttttacaacaattttagggttacagaaaaattgcatagtacagagagttcctgtataccttgcacccagtctccccttttagtatggtatatttgctataatgcaaatctttttttttttttttttttttttttgagatggagccttgctcttgtcgcccaggctggacagtgttggccaggctggtctcgaactcctgacctcaagtgatccgcctgcctcagcctcccaaagtgctgggattacaggtgtgagccactgtgcctggccatgcaaatcattttttgagataagtggggcatataaaaatataaacaaaatgaagttgctttatctctacaagcctcagtttccttatctgcaagatgaggggggtggactaaatttctaaatagctttaaaattttttaattatctgctaaagtaaaataattatataattgtaatataattttctttatttgcttaagtattactaataccaccttgccaaatcatgtttgcaagttactgacagccatatcctaaaagaaaacttaatgagaattcatggaactatgtgtggcaggactgcttattagagatattaggttgaatgatgtgaaattgccatttttgtagataaaaagtaatgagtgaggctgggcttggtggctcacacctataatgccattgctttgggaggcttggaccagggggtggctgtctgaaaccaggagttcgagacaagcttaggcaacatggcaaaaccttgtctctaccaaagaaaaaaaaaaaaagcctcggtggcacacatcttcagctcctctgaagggtgaggctggaggatcccttcagcccaggaatttgaggctgcggtgagctatgattgcaccactgtactccagcctgggtgacagagctagatcctttctctaaaaataataataataataggataatattagcaatttcatatggttcaacctaatgttttgggatagggattcaacaaagtgtgagggggcctttgagacctcataaactcccactgcatgcaaaagcccggctcagccctcaccatactaggagagaaaaggctcctcagttcccttggagtaacttggatctacattattgtaggtagagttgttggcagaaatcctgggataagagaatagtttcctggaagatctgtgcctccaaccagcagagagggattgagcttcattgaactcaacagagccaacatttcatagcaccatggtgagttggtcacacagccttggcaaaaaggctgaaaaggagggtgtaatagtatggggaaaggttgtattcccctggttcgtaggctaggaagaggcctggagtactggtgccaccaaacctttattggtgccattctattctccctactttatgcactttccttactgcctagtacaggctctgcaaactcaagtatcttcggttgttcaggaggtaatgtaaattagtaagccgagttttcctctttaatgctactataacagaaacaatagcacagttgcaatgataaatgacaactgaaatatgctatcattgtgagggagagaatcggtgtgtgcataggggaggccatgatgaactggagagcacatgccctgtctaaagggggcaggcactatacaactgtgcagagcacacgccctgtctaaaggagacaggcgctgttcaactgcacggagcgcgtgccctgtctaaacgggcaggcactattcaactgtgcagctggttgttgccttattgaaatatgggtcaagcatcactgggtattctgattttccaaaggagccagaaatatggattttatgtacattctcccaatgataaatgttggcacctaatttgaattcttaaaaactattatgtgggccacacaatggctgaaaagagctagcagggcactgatttgtcatctctggcttatggcttagctctgccaggagtgaggctcacatgcatttcttcactggacattgttgacaagttacaattaaaatgaattagacagctcctgcctttgaggtactcatggattagcagagaaaatagacaagtaatgatgataagatgtagagtagacatcagaacatatgtattctctctgtgtatatagctataaaagtgactaactcttcctgggttcatctgggaggacatgataggacgtggcatttgagccaggatgtgggaaatcaatagtttggtgcattaaagggatttggggcccttgaaatttctactgtatgtgcaaatgttaggtttgcattcgctgtatataccattttgttgataggtagttgaaaatacggatattccttagccctgctggtgagagtcttagggttaataaaatgagagaactcttcctctggcccaggttatgggataattgtgtgttttagaggcctaagtaactcagaggtcatgataccctcatttctggatgagggaagtagcacatctgaggtcacagagcccattggaggcagagcttggactaacacccagaactctttaccaccatgccttcccctgtcctgggtatctctgatgaaggtcaccgttaggctggccgcctctgcctgtggtggcccattgccctgttttggcccagctcctggtgggtgagggggtttggccatcctgctgccactggttccttctctcttttggatcctttgcctgaaatgcctgctaccccttttctttgtcagatagactacttgtgttcaaatctctctcaaccatatgccagctgtgtggcctggcacaagttttttaacctttctaagccccagtttcctcatctatatataaagagttataatagtacgtttggtgaagtgtaatgagaaggcattggaaggtttcaagatttttgtaaaaacaaaatgacgtaatgcatgtaaagcacttaaagcaacagccctccagaagcactcagcaagtgttaacaatgatgatgatgattcacacagttcacaggctcccaggctgggttaagttctcttcctttgttttctcatattatcttattatttcacatgctacattgtatgtattgtaatagtttgtgtctatttcccctgctagactaagaacaccttcagcgattcattcaacaaatgtttctgaaccactgtgccaggaactaaggatgcagtgataaaccaggagctcttggtttagtgcagagttccaaaagtcatgccaggagacactagtcctgtgagcttgtctcatggtcagttaaatttggggaatgatgctcatcatagcgcccttcagagatgagggtcccttttagtattttaaaggttctgaggagtcttgtgtgtagtaaaagaacagtcctttccatttgactatgtgctttggtccccagttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgaggcagctgcccttttggggaggggaaagagaacaacccccagagctaggtgctgaggtgagataagggttgcaggaggcagagtcttgtggtgggagtggcctacatctagcatggtgagataagacccagaccttctagctttcatgtacagcttctcttttgatgctcacaactgctccatgaggtacgtattatatccttttaatttaattttatttttgagatagggttttgctctgttgcccaggctagagtgcagtggtatgatcacagatcgctgcagcctcaacctcctgggctcaggcagtcctcctgcctcagcctctggagtatctgggaccacaggtgtacaccaccacttttggctaatatatctctttaaagatgaaattcacaagggttaagttaattatccaggtttcttcagctagtctagagccaaagcccatgatcttgcctctgtgatataaaaggcatatagaaagtatttatttatttatttatatatttttgagacagagtctcgctcatatagaaagtattatttaaatgcccaaataaggccaggcacggtggcccatgcctgtaatcccagaattttgggaggccgaggcaggtgtatcacctgaggtcaggagtttgagaccagcctggccaacatggcaaaaccctgtctctactaaaaatacaaaaattagctgagtgtggtggcgcatgcctgtaatcccagctactcgggaggctgagttagaagaatcacttcaatctgggaagcggaggttgcagtgagccaagattgtgccactgcactccagcctgggacacagagcgagactccatctcaaaaaagaaaaaaatgcccaaatagaaactataagatgttatggccttaccttactgtcaccacccatttcccctgttcatagcaagtttgcctaagatcctcaggggcctttgctttgggctgtttgtgccagctgtgttcattgcccagggcctgttctttttgctgcaggtgctgcagtaccgaagctggtgccaagagctggagaagcggctagaagccactggagtgagtgaggctgagctctctgcaccccctgggtcctcagtgaatatacttgttaggtttcatttgttgactgagggaggttggagtgtacaagtgaggtgtttggtggaaggctctctttctcagcctctgagaggtttatcacactgatatcttcattggacctagctggcctgtcagattccaacccttggttttcaaaggacgaaatgtaaattagattggaaggagtgtgggattagcaggaagaagtgcatgtttcctccagcaggtgtcagtgtttcttttagaaagatgcaggcctttgcgagcctacagcatgtctgcagcaaagggatgtctgtgctattagaactggctttgaaaaacccatttatttgcctttgttccagctgcctctcagtacctcctcacattttcctcagaaaagttctctcagaggaaggaaagaaccaaaacttattgagcaccctcaatgcagtccaggcagcatgaggcactgtcatatacagatggtcctccccaacttaggatggttgcaagttttcaactttatgatgatgtgaaagctatatgcattcagtatgttccttgggttatgatggggttacagctggataaacccattgtttggggttgttttgcttgcttgtttggttggtttttgtttgtttggttggttggttgttttgagacagggtcctacttactctgtcgcccaggctggagtggactggtgcagtcatgagtcactgcagcctcagcctcctgggcttaagcgatcatcccacctcagcctcccaaaaagtagctggggctacagatacatgcctcaacatctggctaattttctttattttctgtagacacagggtctctctatgttgcccaggctggtctcaaattcttagactcaagcaatcctcccactgctgggattacaagtgtgagccactgcatctggcccgaactcactgttaagttgaaaatatcataagttgaaaatgtcagccaggcgcagtggctcatgcctgtaatcccagcactttgggaggtcatggtgggtgggtcacaaggtcaggggttcaagaccaacctggccagcatggtgaaaccccatctctactaaaaatacaaaaaattagccaggcatgatggtgcgtgcctgtaatcccagctactcgggaggctgaggcaggagaatcacttgaacccaggacgcagaggttgcagtgagccgagatcatgccactgcactccagcctgggcaacagaactagactgtctcaaaaagaaaagaaaaaaagaaaacgtcgtaagttgaaaacacacctttaacttatgttcaacttatgatggatttatgggatgaaattccagcataagtcaaggagcatctataattgtgtctcttaacctgcacagcaactttctgaagggaacgatataccgctttcattttgtagctggagacactgtagctccaagaagttaagtgacttcacaggctgggtgtggtggctcatgcctgtaaccccagcactttgggaggctgaggtgggtggatcacttgaggccaggaattcaagaacagcctggccaacatggcgaaaccccatctctactaaaactacaaaaattatccaggtgtggtggcaggtgcctataatcccaactacttgggaggctaaggcaggagaatcacttgaacctgggaggcggtggttgcagtgagctgagattgtgccattgcactccagcctgggcgacagagcgagactctgtctccaaaaaaaaaaaaaaaaaaaatgaaagaagttaagtcacttcccaaggtcaaaccgttagtgtagtggaagttaaggccattagtgaaagatacatcacttcttaagttgaagattctatttactactgaaggccgtctttcaggagaggtcatcagtttacttttggagtgagggatgcagtgattgagaatagaagcatattgctaacaaaggggagaaagaataaaaagaaagtggactgccatggaagggagccttagggaactggtctgagtgatgttctctttggaggtaagtaaggcttgtctctgtctggcgcagggaccaatcccccagaggtgggaaaatgtggaggagccaaacctggatgagctgctggtccgattggaggaggagcaacagaggtgatggaccccaaactttctgacctgggtgattggccagttggtggagaaggctgatgggaaacttctgccctgagggctaatgtggacttcagccatagccctctaattcctgcaatggaaaatttcagtggttgccatcttactcccaggaggtccaagggttggactagacctttattttgcacccacttttacccctccccagtgcaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggaggtaggaagaacggggactggaactgtgagaggaagcctgtgtattctggatgctgccctggtcagtactggaaggagttaacttcaggacttggatgaaaactgagctgttgctgttaaagtccctgaccatccttacctgcgcatgctggcagcctcagccttcttgggccttcagcttagacctgccactacccgcctagtctaggttctgctgggaggtagcatgacactcagagcaactctgttcctgcagcagtgacgagcttaggtttttgatggatctgaaagcttactgattcctggtctggaggtcttgcatatctagatgctaaggaggtagatatgaaactgaatgggaaagaaagagctgttatgggccctggggaattttcaggtcccagctgaaggaaacaaatgtttcctgcatttttgctttgtgctcagtggtttatgtatatcattgactcctccttagaaaagtctgtggtaatagatcccatttgttaagcagctaccgtgtatccttttctaatctggcccagaggaaggcgatataccatcctaggccctctgacctgtcgaatcccactgccaactttattaagcccttcaccataacctggatagatacccattcataaactatctcctgtaagtccctccttccttccctcagtagtcaggaggaatccaagactcttgtgttggcaaaagatagccctctgcctttgggtatgacctgggtttctgaacacacagttcttcaagggctacctgaaaggggagcacggtcgccttctcagtctatggcgggaggttgtgacattccgacgccacttcctggaaatgaagtcagctactgacaggtcagtgtggggagaagaagggaggaggtttgcccctaccaattctggactaataacagtgggctgctatagaagcgggatcagctgtgggggtggggtgggtgggggagttggtagtattggaagcagatgatttttcccagccctgctcctcaggcttcactgggcctgatcaccacactccttccctggttcctagtggagtctgctgttttccttgcttgtactcagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccggtgagatggcctggggtcccaggaagggttcgctgagagagagctgactcctttagagggttagggacaggcagggggaggtgccaggaacattcctaccatggagggggagaagatgtgcccaaggaaatctactttgaaacctgatgccacagttggggcttgtactgacctctgccctcagcctgtcttttagcccagtttctttcctgttgatttatggagctagctatgactccatcctccatcaacaccaaagtgcttgccattcccagaacagccaagctcttccccctccctgtctttgtacctgctgaatttagtctggaatgcctccctcccttctctctctgccttatcctctaagacatagttcaaatattacctcttttttttttttttttttttgagacggagtctcattctatcgcccaggctggagagcagtggcatgatcttgcctactgcaacctctgcctcctgggttcaagtgactcccctgcctcagcctcccaagtacctgggactgtttacaggcacatgccaccatacccagctaatgtttgtatttttagtagagacagggtttcaccatgttggtcaggctggtctcaaactcctgacctcaagtgatccacctgcctcagcctcccaaagtgttgggattacaagcgtgagccactgcaactcgccgaaatgtcacctcttctatgaagccttctctgacctcagtagcctgctaagttactgtgcccttgtagtcttttgacctcttattacagcattgatctcactgatgatttagtttcccctaccttctttttttggtgaggctgttttactttttggattataatgaagtaggtttttaaaaaataatgacatagaagggcagggaaatgagcagagagccccattgaatctcaggacaaagttcatatatgcccatgacgagggttgtatcttcacctgttggaggtacatacataaaatgcagggctattttgttttgtttttgcttttggaggcactgagaagtacaaaagcaggccatgtcttcgtaagtttttatttctagtactttgtacttcacctgccgtatactagacactcaatacattttgtttctttgttttttgagacagagtctagctctgttgcccaggctggagtgcagtagtgtaaacacagctcaccgcagccttaacctcctgggctgaagcaattctcttgcctcagcctccaaagtagctgggattacaggcacgcaccactatgcctggctaactttttaatttttttgtagagacggggtctcactatgtttcccaggccggtctggaactcctgagctcaagcagtctttccaccttggcctcccaaagttctaggattacaggttgagccaccgtggctggccagtgaatgtttgttgagtgatgcaatacttaaacaaatgaccatacagtgtgttaaggttcttagagatggtatagaataaaattattaagacttttgctgagtgaggaggatcacttgagcccaggagtttgagaccagcctggacaacatagtgagaccttgtctctactaaaagtaaaaataaaaaaagaatagccatgtggtggcatgcacctataattctagctacttgggaagctgaggcaggaggattgcttgagagtgagctatgattgcaccactgtattccagcctgggcaacagagcaagaccctgtctcaaaaaaaaaattggaaaaaaatttaaacttttagatagcattcattcaagaaatatttatttagccactcacataatagcaagcagtaagctctaagatatagtgttaagtgtttggtgattttgctggactttgagattaatatcaagaaggttgaacataatcttccccaaattgcccttcctttttccctatcagagtcagaacctcgggctggagggaccttgggactatcccaagtgcaattctgatgttcttattggcttcagggtgcttgacttcaagatcaagcgaggcctggaagggcctgggccagggctttccttcagctcttgggcccccaaacacgtgttccagccttgagatgtggtaaatccctgcatgtgtctgagtggttttttgcttccccacttcaaggctatagcatcatgtggtattcagggagtgcagacgggctgggggtgcctaagggatttgggggaggctgcagttgggagtggttggggttggggctggggctggggtgtgctgcatcgtagctctgtccacatccatgggctgttctggtgacagtgctatgctcttctctttagggtgaccgagctctctgctctgttgacccagtctcagaagcaaaatgaagattatgaaaagatgataaaggctctgagagagacagtggagatcctggtacatgatcctttgctctggaaaggagttgggcgtgggcttgtaggttccttgtgctttatggacagatagtgcaggataccagttacatattccatgatgaaatcctctaaagctaaaaaataaattttggctgaatctgaaaattaattaactcattcatttattcattgaataaatactattgactgtctactatccctactgtattcctggggaaattgcaatggcatatgtatgcagtgtgtccttaccagagaattggcacatacattcagagacacattggcaaattagtgagttaccaggaagcggatatgtggagagatttaaaatctagtcacatgggaaacaactgaggagtatggcaatgtttagccgggagaagaaagagcttgaggccctgtgaaggcccttgaagacatgatagctgccttcacatatctgaaggactgacgctgggaaaagagagtttatgaagggccgggcgcggtggctcacgcctgtaatcccagcactatgggaagctgaggcaggcagatcacctgaggtcgggagtttgagaccggcctgaccaacatgcagaaaccccgtctctactaaaaaaataaaaaaaattagccggtcgtggtggcacatgcctataaacccagctgctcgggaggctgaggcaggagaatcacttgaacctgggaggtggaggttgtggtgagccgaggttatgccattgcactacagcctgggcaacaagagtgaaactccgtctcaaaaaagagaaaagagagtttacatatttaatgttttccagggcaaaaccaatgtcaatagctagaagttaataggggaatagattctggctcacagctagagctgttcagtagttgaacagcctgtcttgtgaaggagtaaggttttggtcattggcttaacatctgccagggatgttatcagagggcttctctaaggttggatgttagaaccctctggcttaataccatgtttcatctctataagttttcagatctctgattttaggtagctcctgaacccctattcatatgcacacccctagtcttctcatccaagctgagatcaacaggaattgtagctttctgattccctctttttttttcaggaacttgccaattcagaatatccatggggctcagataatgtaaataaatgaaatgggttcagttgtaagaattctggttttccagtgctgtttgttgtatttagttttcagtactgcaggggacacttgagctcagtattaaggaagccatgaggagcaatagggattgtgggaccctcaataataaatgtctcatctagatgaggcatctaccattcaacttcagtaaatcgtttccatgtaggaatgggggctgggtgtggcccatttgttaactttttgggagaagccagaaatttatatttttatgtaaaatctttccatttataaatgttgattcaaattttgtataagccaaataaaacatagttgcaagtctgtgtctttaggtcttcactaacacaaataggaaggaagagaggaactcttgagtcttcaagattatgtctagctttggggctagaggattctctggtttagtattaggtctcaagcatccatttactgttcagagacagcacccatcccctatctaataatagtttacatttattgaacatttgctttgttccagacactatattgaataatttacatgcatttttcatttaagcctcaaaacaactagttgctgtaattatttctattttaaagaaaaagaagtaagtgatagaagctagtaagtgatagagcaggaattctaatctgtgaagtccaatttggaactcataatcacttaatctaaacttgtaatcaccacatcacattgtcttcagactcttcagacaacattagcattgacatatggtcagggaaaaagtggggctgatagaatagacagaatgagactttggttgtttggggtcctggaataataaattcacttttgagagtttggctctgaggctctgttctattccctgttcaggagacaaatcacacagaattaatggaacatgaagcatctcttagtaggaatgcgcaagaggagaagttgtctttacagcaggtgatcaaggatataacccaggtactgggaagcctcctgttcatggtaaccaggttatgcctccactccccaggtctccatgtcctttcagtcctgcctagatttccagtctctgaggttcgggtgcttaaagtcttgtggggatgagttttgtgtgtttgaagaccagaaccctaagagatagctaagcattcacgtttagcactacctgatgggacaggccctctttcctgtttctagctgcagttctcaggctggaggctagattctggtattcaatatctcaatcgtttcttctttcatttcctcatttattgttacctcagacagtgttctagccttgttgttagtcctagacttgggtgaccaaaggtggagagttgaaggaaccagacttttatgctcagatactcccctccttcccccaggggagaggacctgagaaggaaaacatcaggtttgtccaggctatagggttaagtccctctatagactctaggctttggtcagtagggtggtgaccttgctgtattgggtttcaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggtaggaaccctcagcattccacctcagtcacaggggtttgtgtctaaactggtttgtgcctcaggtacctccctagcctggactatccctttcacttttttgaccagtcatgaggtgttctgtcaatatcccagagtaaatctgcctatgtctgctgaattgtgcttgtgagtagcaggcacatcctccacgccaatggcatgcttcactttgtgtacaatctttgcataacagtatgcaaagattgggaaccagagccctgggagattattgggtcaacgttctccaactctgagagtcttaggcacacttaccactcccccatgccactgtacatttggagatgacgaactctaagaatctagagccacagaagcccaatgacctctgatggcctgtcttcttgaatagttgcatctcccttctcagctttcttttgttgcaccagcccccgacccccttctccagccccactttcggggttctgacatccctcctttgcccttgttcatcatctggtttctcttgctctctctccacaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaagtgagcagacgggctgttcatcccaccctcccagcctggtctcagtctcagtcaccatccagccatttacccactcccatcaggtttttggggtgctgatcctgttctccttgagactcagggctgttttgcccagtgtttcacttgtttctccagaacaagcttttggggttggagtctttgtgatgataaaaaagttttgcactagaaacagaagatgggatgttgaaacagggtctcttggccctgtgatgcctgcttccagaaagaattttaggtcctatggtctctgctcatctctgattcccttcttccagggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtctgtaagtgagactagtctcctcctcgctgggccctggtctttcttcaattctacaccctccccgtctactcccctctgttacaaagtagagtatgtagaagtctggcatgcagtgggttcagattagcttgctgcttcttcctttgcagaaagatgaatatggaaagttcgtggttggttaagtcttagttgagcacccatatgggatgagacactgagggggatacagaaatgaataagacaaaagccctgatttcagggaacttgccagaagacagacaactcactgtgacatgaggctggatgaagtatgagttaaatagagtttcagaccaagtcctttgggagcacaggagtgacagctaattattgaagactaggaaatgctttatggaggagagagtagactttgagctgggcctttacctatttggttagcagagagtgggagaagagctcaaggaacagattagcaaagaaaaggcggcaggaaggttcatggcatgttcagagtaggctgggctggctaaagggtaagacttatacagggaagtagtgggaaatgtgctagctggtcaagaaagggaaatccagaatcaatggccccagctaatctgtaaattcccctatatgatgtcacagaaaaagcaaggactttgagctaggcagaagcttagtttaaattatggctctgtcacatggacagattatttgtagaatgatgataatatttaccttgaagggttgctgggaagatgagagcaacgttttggaaaacgccagcatagaacctggcatatggtaggtctttaataactgggagcagggatataccttcatctttgctgtatttccctcctctcctgtgccccagttccttgtacctggtaggcatgaatagtggaagcttgaagggctgccataagggtcatgacttgtgctaagaatgatctccctgtaccaaggagaagggcagacaacccctaacaacaaaaaattagctgtagctgaatgtggtggcatgtgcctgtagccatggcaaggtgagatgggaggatcacatgagcccccaggagtttgaggcttcagtgagctaagaagatacacagagaagtctcactctcatttgtgctttctccatcccatttcccttccccctttaggcaaccattttagctgacttcttgtttatcttgccagtgctccttcatgcaaatacgggcatatattctttcttcccccactttcttgcataaaaggtagtgtatcatgtatatactgttctgcaccttgatttttttcacttgacatgtcttagaaatctttccttatcagtgtttatagaccatcctcattctgttgcatagcaaaggtgattatattcctgttacctttggggttatggcccatccctaagagttcctctagacccctctctttcccatcttagtcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggtgcgtggcctcctctcctcacttgctgggtgggcggcttcgaaagtgtgttcccatgcagcctgcctcattcttcaccttcaagccaggatccctcatctttcctcaatcattagtctgcttctgggttctctattccaacataccctctatattggaattagaatgggctttctaaagtatatacctggttatgtcagtctcttaaaaccattcaacggctttctagctctgtggtgccacattcaaagctttttgtcatgtgcctcaaagtgtgttttagcctccccttctactgcaaaacccatcctaacacctcatatcctttgctcctgccacagcagtaattgccttctcagttattccatgttcttcatgactctaatactctgcatgtacttttccctttctctgcactacttctttcctcttcctttatgtgcaaactgttcctcatctctcagtacacaacttaatcgtcaactcctctaccaagcatatttgactcttccaaactatattaatattttttttagttcccagagcactttgtgcttacattttctgtggcatcattacaatcatagtcatttctctatcctaactttggtatctctatactgtgaggtcctgtctcactccttaatgaatgaatgaagggaaaacttgtttagaatgcaggagagggaatggagtattaactgatctctgtaccaaaaagcagcagtgttgggaatgtgaactgtttactgttccaggaaaattggaaatatgaaactctttaatcctttttgttttttaggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccaggtgagcaaagattttcctggtccccacagaagggctgggccctaactgagagcaagacggatcagctcccaaatgtaggtctgaaatgagcaaaaggaacatttacaatgcagaggagagcaaagactgtaaggattgggcttagccattataaatattcccctcccacacctccagcagaaccacctctggacttcagggtaagacaccaaggttgggaaggggcccatgtcctctggaaggaagactaggttttttgctggggttttcttgagatggatctccctctgtcacctaggctggagtgcagtggtgcgatcttagctaactgcagttttcatctcctgggttcaagcaattctcctgcctcagcctcctgagtagctgggattacaggcatgtgtcaccacacctggctaattttttttttttgagatggagttttgctcttgttgcccaggctggagtacagtggcacgatcttggctcgctgcaacctctgcatcccgggttcaagcaattctcttgcctcagcctcctgaatatctgggattacaggcatgcaccaccatgcctggctaattttgtatttttaatagagacagggttttacgatgttggtcaggctgttctcaaactcctgacctcaggtgatccacctgcctcagcctcccaaagtgctaggattacaggcgtgagccaccacacttggctgccctgggctagtttttgtatttttagtagagatggggtttcaccatgttggccaggctgatcttgaactcctggcctcaggtgatccatccacctcagcctcctgaagtcctgggattacaggcatgagccaccatacccggcctaagtctaggttgttaatcctgttgggtgagataatagcaatcaccagaaaagaatctgctgaagagcctaagtcccaaagaatcttttctataggttataaatttaacctataattatagcgagggaacctccttgcaatctctgtttccttgagtgttctctattccattattctgaattatttgagagcaggactttgccttgcatatctccgtccccagcatccagcccatctagtacctggaatataggcactagatcaaatgaatggattttcccccatcttataaacactcctttgttcatctttggagaatagattcatatctcacttggatttcagtcttagcatttgattcctaaactaaccatttgtctttgatgcttgtactcccttccctttttggccagtagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgaggtgagaagccaaaatggacaccatcatgtctaggtgtaatatatgctcattataaaaaattaaaacactacagaaattatctggaaagtgaaaaagtcttacttcctagaaatgaccagtgttactagtttgcagtatatcttccaattttaaaaaagaatgcctataacaattcttcactgaggctgggcgcagtggctcatgcctgtaatcccagcactttaggaggccgaggcgggcggatcacgaggtcagaggttcgagaccagcctgaccaacatagtgaaaccctgtctctactaaaaatacaaaaattagcccggcatggtggcacatgcctgtaatcccaactactcgggaggctgaggcaggagaatctcttgaatctgggaggcggaggttgcagtgagccgagattgtgccactgcactccaacctggatgacagagcgacactgctcaaaaaaacaaaaagaattcttcactgattctccactacttcattcacaccacccagtttgaattagaagcttctccttatactctgatagcacctcatgcttattttaactaccacattcctcatgctataattatctgtttatatgtctctaccattagaccaaaagctccttgaaggcaaagctatatcttatttgtttttatttctccagcttttagcatagtgcctaccacataacaggggccaagtaaatttttttcctgagccaatgaatgacctggctcaaaggtcatctttctcctctacaaaacctctcattgtcctaataattgtacggactctcccttcacagagtccctttctcgggacattgatgactttcttcccagtattatgtgtgcatcttctcaaggccaaaacctccttaggggcaggtcttctgctgtccctagcacagggtcttgctcacaggggagcattcttcctgggctgggggctctgtgggcggatcagggaaatagataaatgccacgtgctattgggtaagcaatccgggctcacagagctgggtccagaatctctgaagaggcaatgaccctaacctggtggtagcggccccaggggaatccagcctctgctccatctctcaccacattcttcccctcagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcaggtagggcccagactcagttcagccaagcacagagagagctttgcaaggcaaaggcgtgaagctaagctccctgccataagtatgcaggtcctaaattgattatgaatttataattgcccccctaacttctccaggtagccaatacttagaacccagctcctcttgaggaagggtaaggggcttgatgggtaagaaactcttctgattcctgaacctcacagctcagccaaggagctactggagagcagtctgtttgaagcccaacaacaaaattctgtgatagaggtcaccaaggggcagctggaggtccagattcaaactgtcactcaagccaaggaagtaatccaaggtgagaacccaactgggatgggatgcactccattccatggagatgttgaaaggcaggaagatggtgggagactattagaggtccttctccagcagggtgcagggcctctgagatgggagttgctcatgaggtcaggggagagggagaattttattaggtaaaaggagggggcggaggcctgatcctgtccctggcatgttaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggtaagtggtcaatgtggccgggtatggcctcccttccatgagtgctctacctgctgcctcttggtccagttattgctgctcgtatgagtgaaattttgtaaccaagctgtaaaatccaacttcctgctattaaatgagttaatatatgaaaagcactaagagtagttcctagcatgtggtgggctccctatatgtgttagccattattattgttgttgtgttggtgtgtacagagaattgagagtggaccctgggatttaggattattaaactggcctcaggatgaaaacgggggagaggaatatcttggatgcattcttgtgcagttcagaactgtgttttgtcttttaataatgtaatttagtccatttggttttattgtggttttaggtgtatttggatttatttgtgccatcttatgttatttgtcttgcttttttatatcttttttttttttttttttccttgagacagtctcactctgtccctcaggctggagtacagtggtgcattcttggctcactgcaacctccgcctcctgggttcaagcgattctcctgcctcagtctcctaagtagctgggattacaggtgtgtgccaccacatctggctaatttttgtatttttagtagagatggggtttcaccatgttggccaggctggtctcaaactgacctcgtgatccacctgcctcagcctcctaaagtgcagggtacagctgtgagccactgtgcctggccatttttatatcttttagggaggggaaatctcctttcttaacttcttttagaggattaagttgggtgattaagttgtattcttttctcacctcttttttctctctgcaactgtggatgatatatactttattttaaaaatcctgttagtggttacctttaatatttttaaacatatacttaataaaatctcaaggttcagtagttttacccttttcctgaacgatacaagggtcttagaacattttacctgggccagggacagtggctcatgcctgtcatctcagcactttgggaggctgaggtgggcagattgcttgagcccaggagtttgagaccagcctggacaacacggcgaaaccccattccctacaaaaaaaaatacaaaaattagccaggcatggtggtacacactgtagtcccagctacttgggaggctgaggtgggaggatcacttgagcctaggaggttgaggctgtggtgagctgagcaccactgcactccagcctgagtgacagagtgagaccctgtctcaaaagcaaaaaagaacattttacttgtttcactgctccctaatttataggctattttgttcagtgtgttcagttctaactagtttaacaccacaaattatgatttttttattgttttatacagtcaatatttgttcagatacaacgaattgataccttttctgttcaccataccttcttgcatgtcagactttctattcagattttttttttttttttttgcctgaagtaggattttctttggtaagggtctgttggtagttaattgtctgaagatgtttctattttatttttattcttttattgaggcagggtctcactctgtcgcctagactggagtgcagtcatgtgatcatggcctactgcagccttggcctcctgggctcaggtgatcctcccacctcagcctcccaagtagctgggattataggcatatgccatcacacccagctaattttatttttggtagagacggggtttcaccatgttgcccaggctggtctcaaactcctgggctcaagcgatccacccgcccttggcctcccaaagtgttgggattacagaggtgagccaccatgtccagcctacttttattcttgaaagatagtttctggctttgttcaggcttaaaaaatagatagatagatagatagatagatagatagatagatagatagatagatagatagattcactaagtaaaacattcagatataagtttctaggatgacaattattttctctcaacattgttggtattgagaagttagctttcattttaatcattccacagtttcttgtgtttattattatttttttgtttgtttgttttttgagacggagtctcgctctgttgcccaggctggagtgcagtggcgcaatcttggctcactgcaaggtccgcctctgggttcacgccattctcctgcctcagcctcccaagtagctgagaccacaggcgctcaccaccatgcccggctaattttttgtatttttagtaaatacaaaaattttttgtattcaccgtgttagccaggatggtctcgatctcctgacctcatgatccacccgcctcggcctcccaaagtgctgggattacaggcgtgagccaccgtgcccggctatttatttttttatatatttttttattttttatttttttgagacagagtcttgctctgtcacccaggcttgagtgcagtggtgcaatctcggctcactgtaacttccacctcttgagttcatgcagttcttctgcctcagcctctagagtagctgggattacaggcacgtaccaccatgcccagctaatttttttgtatttttagtagagatggggtttcaccatgttgcccaggctggtctcaaactcctgggctcaagtgatccacccacctcggcctcccaaagggctgggattaaaggcgtgagaccacgcctggcaatttcttgtgtttagatgtgtatttcttttatttggttggaatttcttagacatcctgaatttaagatttcatgttgaaatatcaattctggaaaattcttatatattatctcttcaatattacctctttcctactgtcctgcttttatttatttactctttaaaataaatttttttttggccaattgcagtggctcatgcctgtaatctcagtaatttgggaggctgaggtgggcggatcacctgaggtcaggagttcgagaccagcctgaccaacatggagaaaccccgtctctactaaatatacaaaattagccgagtgtggtagcacatgtctgtaatcctagctattagggaggctgaggcaggagaatcgcttgaacctgggaggtggaggttgcgatgagctgagatcgcgccattacactccagcctgggcaacaagaacgaaactccgtctcaaaaaaaaaaaaaattttttttttttaaatttattttattttattttttagagacagggtcttgctctgttacccaggctggagtataatgatacaatcatagctcactgcagcctcaaactcctgagctcaagtgagtcctcctgccgcagcctccgacgaactgcaactacaggcacatgccaccatgcccagctaattttttaattttaattttaattttttttttttttagagatgggtcttgctatgttatccaggctggtctcgaactcctgggctcaagctgtcctcttgcctcagcctcccacataagctgggactacaggtgcacgccaccatacctggctcttttcctactttcttctctctttctgtactctggttagttgtatgtcagacctttttactctatccttcatgtatcttcactgcctcttgcattttacatgtttacttttctctttgtatgctgtgttctggattatttttttcagatctctcatctagttactgattttccttttcagctgtgtcgaatctgatgtttattctattcaccaagttttaaatttcactttttaaattttttatttctagatattttatttggttattttttcatatcttcttggtcatttttttcagtctgttttccctaatttgtattttcagtccattcttttaaacatatgaaacatacttgtgtcctgtctagtaattccaataacttttaattaacgttttggggtctagttctgtaatttgttgtttctgttggctcttactcatgggcttgtttccctgtgtttttgtgattcttgtctatgagcatgtctttggaaattttcctttttttttcttttttctttttttcttttttcccccagagacctttgttctgaggaaggttttctgtgggaatctttttaggcctgaggcaaaggagtttttcctcagaggatttgtgcttctgtcaggaagctggaggactagcatcccaggaccaccttaaagtaaattttctgtttaaagttttttgacccacagtcaggcccagaccccatgtgcagctcagcttgtggttatgaattttcagaggagacttttttcctaccctgtatcaaagttgagataagcatatttccttgataatttccttctatagagtttattttgttttgtcccctctccacatccctccagtttctctttttctcccttcctccccatgtcctccttctttttgccttttcccccttaagctgaggtcactacagcccagagataggcatttttttttttctttctagagatggactatcactatgttgctcagtctgatcttgaactcctgggctcaagggatcctcctgtctcagcctcctgagtagctgggaccacaggcacagtccaccatgtctggctttttgttaaggactatatgctaggctttgcagaccatatggtctctgttacaattatctaactttgcaattgtagtgcaaagcagccatatataaacaaatgagcatgactgtgctcagataaaactttatgtatagatactgaaatgagaatttcatataattttcgcatgtcacaaaacattattgttttctaccattaaaaatgtaaaggctgggtgcagtggctcatgcctataatcccaccactttgggaggctgaggcaggacgattggttgagaccaacctgggcaacatagcaagaccctatctctttaaaaaaaaaaaaaaaaaaaggtaaaggctgggcgcagtggcttacgcctgtaatcccagcactttgggaggcctaggtggccggatcacctgaagtcaggagttcaagaccagtctggccaacatggtgaaactccatctctactaagaatacaaaaatattagccgggtgtggtggcacatgcctgtagtcccagctacttgggaggctgaacaggagaatcgcttgaacctgagaggtggaggttgcagtgagccaagatcgcaccattgcactccagcctgggcgacagagtgagactctgtctcaaaaaaaaaaaaaaaaagtaaaaaccactcttagctcatagccagagagcaacaggtggtgagccagatttggtccacatactataatttgttaaccccagtccagatttttgtttgtttgcttgttttgtttagagataaggtcttgctctggtcacccaggctagagtatagtggcacagtcatagctcactgcagcctcaaactcccaggctcaagtgatcttcctgcctcagcctcctaagtagctaggactacagcgtctgcctggctttttttttttttttttttttttttttttttttgagacagggtcttgctctgtcactcaggctacagtgcaatggtacaatcatggctcactgcagcctctacctcacgggctcaagtgatcctctccagcctcctgagtagctgggaccacaggcatgaaccaccatgcctggctaagttttttttttttttttttttatagagatggggtttcgtcatgttacccaggctggtcttgaactcctgggctcaggtaatctgcccaccttggcctcccaaagtgctggggattacaggcgtgagccaccacgcccagccacctggcttatttttatttttattttaaattctgaattacatttgcattgggtgaaagatagtggatttacttttttttttttttttttgagacacagtcttgctctgttgcacaggcagtggtgctgtttcagctccgcctcctgggttcaagcaattctcgtgcttcagcctcccaagtagctgggattacaggcgcatgctaccacacctggctaatttttgcatttttagtagacactgggtttcaccacatcagccaggctggtctcgaactcctgacctcaagacaaggtcttgctattgcccaggctggagtgcagttgtacaactgcactgtacaactctagctcactgaagcttcaagctcctgggcttaagcaatccttctgcctcagcctccagactagctaggactacaggcatgcaccatcatgcctggctaattttttttttttttggtagagatgtgatctcactttgttgcctaggctggtcttgaactcctagcttcaagcaatcctcctgccacagcctcccaaactgctgggattataggtatgaactaccacacctggcctacaccacaagtcttgctttgcttttggcttctgtggaatttttattattttcctgctggttctgtgatacattaaaatacatatttaatattttatccagcattttttgcgatttcgtagctggagggttcagagatcttgtttatcaagtatctggaaatggaagttgacttgtgctttatgtgtatttgtaatttgattgttattatgaggcaggcttattggcaagatgataaccagaagtttgcttatttttggaattctgtgcctagtctatagtcggtgcttaaaagtatttgttgaatgaacactgattctagcaggaatcagatgtataccatgtactgaaaactccataaataaaagatgctataaaacttctgaatgataagccagctacctacgtggccttggtttccctaaaaggattgactatagtggccatatctgggtcatgaaagagccttttctctcttttccttttctgtcattcagctaatcctcctgacttctgattgtcccactttattatttctctatgattgagcaggtcaactgccctcttaaaactctcgacagcctgttcgttttagcagtgactgccttctcctggaatcctggcaattagaagcactcttgggaggccgcgcgtggtggctcacacctgtaatcccagcactttgggaggccgaggtgggcggattgcccaaggtcaggagtttgagaccagtctggccaacctggtgacaccccgtctctactaaaaatacaaaaaaattagccaggcgtggtggcatgcacctgtaatcccagctacttgggaggttgaggcaggggaattgcttgaaccagggaggtggaggttgcagtgagccaagatcgcaccactgcactccagcctgggcaacagagtgagactctgtctcaaagaaaaaaaagaaaaagaaacactcttggcagttgtattctttattcttccatctactgtctgtctcccctttaagagtaatgatattggacacttgttaagcacctccccatgccaagcaccatgctgaatgctttattcacacaataaaggtgaataaatgcatggagaagtcactcagggctgggcgtggtggctcacacctgtaattccaacaatttgggaggccaaggcgaaaggatcgctagaggccaggagttcgagaccagcctgggcaacatagcaagatccccatctctaaataaataaaatataaaaagagaagtcagggttacatggctaataaggggtagaaaagggattcagggcccaaactcctaaccatttcttttttatccacctctgtaatgtcccttccaaatggttgcttagctgctattgtattccatcacttggctgcccatttattttagatagatctagttattaggaaattcatgttgaaccaaaacctattaccaggaacaaatgagccttagatttgcttgaaataccccaccaacatggttgctttcttctaggcatgttacaatttactcatgtcccagtggtgtaaaggtggcactttgaactgggcagaatattctgttcatggtcataccagcaatgctggactgttacttcctacacatcacagaattagctcttcttgtagctataacacacttctaactcacatagagcaaatagatcagtttttttaacacttgcaactgctattaacattcatctttttcatatttttacagttggctttggctttttgcagtcacatactctgccactgagctatacccgctgtctttggctttttgaaccagagggtaaaatgatttgtcattcatgactgtcctgtaactgacattacacattgccgggttttataaggaagaacaaaggaagacctcttttttttctttttattattattatttcttttgagacagggtcttgctctgttgcccaggctggagtgcagtggcgtgatcagggcttaacggcagcctcaccctcaaggccctcctgggctcaagtgatcctcctacctcagcctcccaagtagctgggaccacaggagtgaaccaccacacctgactaatttttgcattttttgtagataaggggtttcaccatgttgcctaggctggtctcaaactcttgggctcaagtgatcatcctacctcggcctcgcaaaatgttgggataatatatgtgaactaccacgtccagccagaccactgtcaattgtatggtctgggaaggcttcaccaaggaagtgttagtttaggcgtgaggaatgatggagtaggggggagaagggctttccaggtagaaggaagcatgagtaaaggctctaaggcatgaacatgttggctgggtgcagtggctcacacctgtaatcctagcactttgggaggcctaagcgggcagatcacttgaggttaggagttcaaaaccagcctggccaacgtggtgaaaccatgtctctactaaaaatacaaaaaaaatagctgggagtggtggcgggcgcctgtaatcccagctacttgggaggctgaggcgggagaatcacttgaacttgggaggcagaggttgcagtgagccgagatcaccccactgcactccagcctgggcgatagagtgagactctgtctcaaaaaaaaaaaaaaagtgcttagtgtgctcaaggacctgcaaggaggcaagtgtgtgtagccagggtgtagtgaatgagggggaaagctgcacaggatgacactgggaaggctgaaacactagaggcgttcccattacatgaataagcaacgacaaacttacaagcattttaaaggaaaagtgcagggaatactaatgtgatgatgatgctggctgttgtgtattgcccgctttctgtgtgctacgcacatttaaagtgattcacatgacttatctccatcctcaatacaacctgaggagaatgacactgttgttatccccattttaatagatgaagaaactgaggcacagagttgtttagaaattgagatcatgctagtagtggtagattaaagattctccacccaggcagcccaactccagagcccttcacctctatcctgtacacctaatagagggtcctgaactagtcagagagcttgggaaagctttggttgctggaagaccgctaagacaagcagcacccctatcctaatgctcttatataatacagggagacatcctcactgggccaggcctgattcttcaggggctaactctgcaactctgagtagaggagagcaggcagcagacagccagaattggccgcctcagttcattgttacaactgtcaaccacaatgtggctgctttaaagataacaaatacggagctgtgtgtggtgtcatgcccctgtgttcttagctactcaggaggctgaggcaggaggaccacttgcgcccaggagttcgagtccagcctgggcaacatagtgagaccccatctctaaaaataagaatgcctaggctaggcacagtggctcatgcctataatcccagcactttgggaggccgaggcaggcagatcacttgaggtcaggagttcatgaccagcctggccaacatgttgaaaccccatctctactaaaaatacaaaaattagctgggcatggtggggggcacctgtagtcccagctgctagggaggctgagacaggagaatcacttgaacctgaaaggtggaggttgcagtgagcggagatcgtgccactgcagtccagcctgggtgacagggcaagactccgtctccaaaaaaaaattaaaaatagaaatacattttaaaacccagatacttgtagcatatataagggacaattgcagtttggaaggtacttccacatgtattatataattttattttttaaaatgaatctcatttggttgtcatgaaatttggtaagatagataaggcagggaatattagccttgctttacagatgaggcaacaggcttagagaggtaccaaggtcaccccactagtgagtagtagagagactttgtttttccaatccagtacccctgcctcccctcctcacccatttggttctaatggtgtttccttcatgtggccaggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccaggtgggaagctaggaggattggagctgcacgtccagtcagcgatctccttaccttgaccacttccttttctactcccaagaggagtgctgcagaggggcttccagaagagagggtagctacccactttgctaacagtgagcagggtggtccgcaccattagccacagttccggcagtatgtcatacttcctgagggagggctgacatgtaccacatcctgtcagcttgcaaaccagtggtaatctttgcacttccttgttctgaacccatgggctcagaccttcctttgccctcagccccttcccatttgctaggagagccctagggcagctgggatgtgcttgtggcctcgttggtgagcatggtaatcctgagcccacaagctgttacccccctacccctccacagatgcagctggaaacagagaaggagagagtatccctcctggagacactgctgcagacgcagaaggagctagcagatgccagccaacaactggaacgactgaggcaggacatgaaagtccagaaattaaaggagcaggtatggagggtggtctcgggagtagggaagaaaggggcactcatttacccattcgaccatgaagggttcttgggcacttcttatgtgccaggccctgtgctaggtgctgacatatgacaagtacataaaggtatggcacaggctgggcagggtagatcacgcctgtaatcccagcactttggcaggccaaggtgggtggatcacctaaggtcaggagttaaagaccaacctgagcaacatggtgaaacccatctctactaaaaatacaaaaattagccgggcatggtggcaggcccctgtaatcccagcacattgggaggctgaggcggacagatcagttgaggtcaggagttcgagactagcctggccaacatggtgaaacctcatctctacaaaaatacaaaaattagctgtgtgtggtggcatttgcctgtaatcccagctgcttgggaggctgaagcaggagaatagcttgagcccaggaggcggaggttgcagtgagccgaggtcacgccactgcattccagccttggtgatagagcgagtctcaaaaaaaaaaaaaaaaaaaaaaaaggtgtggcacagcagtcagcataacagacattgcccctgctctcaaggaacttacattcctgtggcagaaatggatgacaaatgagcagacacaaagtaaatgagattattacagtttgtgataagtgctgtaaaggaaatagaatgatacaactgagagtgagtcaaaggaggttcactttgcacttagtggtcagggaaggcctcactgagaaagtaacatctgagctgagacttgaaggttagaaagaaaccagctccgtgatacaacataggtgaaccttgaaaacatcaggttaagtggaagagccatatattttatatgatatgcttccatttatatgaaacaccaagaataggcaactctatagaggcagaaaacagatttatggtggggaatggggtggggaatggggattgactgtgaatgggcacggggtttattttgggattgatggaaatgttctaagattgattgcgatgatagttgcacaactctgtgaatatcctaaaacccactacactgtatacgttaaatgagtgaattgtatggtatatgagttatatctcaagccatttgaaaaaaaaaatgcctgccatgtgaagaacactttaggcagaggaaacacctgtcgcaagggccctgggacacagaagagggcttgggaagttcaaggacaaaaaggaggcagtgtggctccagcttgataaactcaggggcgagtggagcggtagccagaagccctgtgtcagccattgtaggagcttggattttgttctaagagcaatgggaaactgttgggtggtatgtatgtatgtatttgtttgagactgagtctcgctctgtcacccaggctagagtgcggtggcactatctcagctcactgcaaccttcgcctcccaggttcaagcaattcttgtgcctcagcttcccaagtagctgggattacaggtgcccgccaccatgcttggctaatttttgtatttttagtggagaaagggtttcaccatgttggccagggtcgtctcaaacttctgacctcaagtgatccacccaccttggtttccctaagtgttgggatgataggcgtgagccaccgcgcctgggcagttggatggtatttaaaaagcaggggtgggatatgatttatttatatatacgtatacatatgtatatacatatatgtatatgtattctctactctcctgagtagagaatagtgtgtgtgtgtttttaggggatcgtggcatcaagtggaagtagggatatggttaggagactgtttccatggtctaggtgagagactattaccaattcatggactctgaccaagaaacctgggtgagccagtgcactttgtgagggaggagagggactaggaagtgagaaggtgaggtggaaacaatgtggattgctggctcctgcctcagcttttgccaccccaccaaaaaaaccagtatttctatgacacagatttcctctactcaatgatttcttatccctcttcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtcccctcctcctccccaccaagtcccatggtccttccccaacacagccaggctttcccacttcctcttgcaggacagggagaaccttggccctgctgcctggtttgggagggtagatgggtgggccacagtactgagtggaaaattagagggtgctcagagttgagcatgtgcctggcagagccctgggatagtaatctctttctctgtaatggtcacagagtttttgttttccctggctgtctcagtttcaattgttctttccgtccttgccaaaaatctaatatttttacatactaggttgcttctcctcagaatcctatatcaaatgatgttctgacttttcatttttaaaaaagcaatcacaatacatgttttgcctttgggagtagttatagtcagcctttttttccttctttttggtgggggagacaggatttcactatgtcgcccgggctgaagtgcagatcataactcactgcagtcttgacttcccaagctcaagcaattctcccacctcagccccctgagtagctgggactacagatgtgtgccatcacactggctaatttttaaatttttatagagacagggtctcactatgttgcccagactgatctcgaactcctggtctcaagcagtctgctcgccttggcctcccaaagtgttgagattacaggtgtgagccaccgcacccagcccagccaagatttttatttgtgcctgcctctatgcagcatatgtgaggctgggaggcagatgaccaggccgaattgtattgaggaagggggtggttaagaacagtgtgtaggaattggtagaatcgccagagcattggaaatggccactgactatggtaaacctcgaaggaccctgaagccctaggtgaggagcatcttcccaccggccccctgccctgccatcttggtcttcatgcccttaattttccaggtggaggacttgaagtctcagctggtggcccaggatgactcccagaggctggtggagcaggaggttcaggagaagctgagagagacccaggagtataaccgaattcagaaggagctggagagagagaaagccaggtaggctagataggccatggaggtggcttttgtctatctggctgccatggtcactgtgatattgacagttgtttgctcaggccaccttgcctttcatgtctgcaactctgggatgtacatgtagccatgtggagaggacatggttcctgtcttcaaagcttgaacttcatttatttagtaaatatttcgtgaacgcctgttatgcaccaggcaccatgcttggggatacagtgataaacaagactgtatggtccctgccccagtagaatttatagttttgtggggaagacattaatcaaataataactcaaattattacaggttatgacacatggaggaaacagggtgagagagagaagagactttagaaccattgttagggaaggcctttctcaggaagttgcatttaaactgagcactcagcatgaagtggagctacccatgtaaaagggtgagggggagttctattccgtaagaggagaaataatatgcaaaggccgtgaggcagataaaagtttacagtgttaactgaaagagtggttggagcctgattggattgtaattggagcctggtgaatgaggagagtggcatgagctgggcaggtccacagcattcaagatttggtaggccacagcaaggagttcgtagtttgagtttcataggaaacctctggagaattttaagcagggaaattgatacaatccaacttatgatgtatttgaagggattgtaatgccatgagacatcaggagtgaaagaagaccattcagagtgaagagcagcttgtattcttagtgctgtgggaatttgagaaggggatgggctgggtgctgtgtcccacgactgtaatcccagcactttgggaggctgaggtgggcagatcacttgaggtcaggaattcaagaccagcctggccaacatgtctactaaaaatacaaaaaaaaattagctgggcatggtggtgggtgcctgtaatgccagctacttggaaggctgaggcaggagaattgcttgaaccaggaggtggaggttgcagtgagctgagatcacaccactgcactccagcctcggtgacagaacgagactccatctcaaaaaaagcaaaaaacaacaaaaaaaagacacagtttgagaagggacacattattttggtggtgaatctagaggcaggaagacaagttaggctggtacagttgtcctgatgagagatcctaaagctaaaccaaggtagggtagtggggaagaggaggagagaagagaagaggtttaaaggatgttaagggagttagaatcaattgtatataattatagattggatgtaggtaggttgaagggagaactctggagtagtcaaggttctacgttaggacactgtgtggatggaagtgccattcactgagctagggaacatagtaggagatgattgggtggacaggggaggagaggaaagggatggggaagatttggacatgttgaacgtgaggtactaatataaggtatgtgtgaaatttgccagagaagaataaggttgatagctaggcatggtggcgcatgcctgcaatcccagctactctggaggctgaggcacgagaatcatttgaacccgggaggcagaggctgcagtgagccgagatcgtgccactgtaccccagcctgggtaacagagcaagactctgtctcaataaaaaaaaaacacaaaaaaacctgtgaggttgaaatggggcatcatctgcaggaagtacctaggagcacttattatagtaagtgctcaataaatgatagcttttattgttacatcataatcattatcattactatttctattttgattattaatgctatgtttagaatactcagatgagaaggtaatttttcattccctaagagaatggcccagcactctgacccctctctttttagcctgactctgtcactgatggaaaaggaacagagactccttgttttacaagaagctgactctattcgacaacaagagctgagtgccctgcgccaggacatgcaggaggcccagggagaacagaaagagctcagtgctcaggtacttcccactctggttatgagctctgcatccctggcagaagcctgattctgaagcggtggattgattgctctgagtcctctcatggagaggacccatctatttttcctgattacaggataggctggtgcctcaacacccctacaggagggggaagccaggactagacaaggcgggggcttgggaatctgacccagagatggacatggctcctgtgggaaacctgacagcccacagcaaagtgcacacgggtgtagcccatgcaggcctggttccagcacaccggcttcaaagtatgctgggtctggttggcaagatgtagcagggagaatgagcaaccagaaatactccagatcaggcaggcagcagcaagacttccagggactcagtctgcccccatcagaaccccagatattgtatacagagaaaagatggaactaggagggaaggaatggggtgtaagagccagatggtggcttgcaggggttaagggcacacaggtttggctgttcaatggtcttgagtttgaatgtaagctttctaattgtgtgaacgtcagcttcttcatccataaaacaagggtgaacaattcttgttcctaattcctataaccattataggaatatataaagtgtcaggaacacaataagcattcaatacatggtagctatgttattgtgactggtcttactaggcgcagcgtcgaggtttcagggcagagttctggtcatagcaaggagccagcatatctgcccaggaagccagggctgaagcccattagcatagcagcctgggcccatgtgttcagtagtcggcaggcagccaggtgttagatctagggtaacactcatttcagagcccctctacctgcctgagagctgagctgaaatcctcccagccctgatcagagtttgtacaaggattgagtggggtctggcctgggaaggcctgaggagagggtatccgcttcctgcttatattatgtaaaattcttccttgacagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccaggtgagacagcctccccagaactaggtcctttgggccaaagccaggcctggctcccaggggaaagggagaggaatgctatttgttagaccatattgcttcagggttaagattacatacttgggaattaattctgagtttaagccccagctctaccatttgctagctatgtgtccttgggcaagtcacctgtcctctctgagcttgattttcctcaactacaaaatgaggatgttaaaagtatttaccttatagtttcaccaaggagttatgaggttgcagatgtgaatcacttacacggttcctggcacttattaagtgcgtaataagtgatagctcgcattaatctagcacccaccatagtgcctggcccatacttatggagaaaatatgtgatgagtgaactgctgagaaaggggttctttgcggagaggagggaccagttggaaggacagggctgtgtctggagaggtctggctgtttcttttcatagtggcagccaggtaaggaggttttcctcattttttcagaccagaatggagctaggagcctctttaagagagggcccctgctgactgctctctccgctgaggcagtagcatctgccctccacaagcttcatcaagacctgtggaagactcaacagacccgggtatgtttctctgctcccctttcccgaactctttacatccctggaaaagcatgaggcaaaggggtgtgaagcagtttgacctgttttattcctgagatcaagttgggatgagtttcacctctatcacttaccacctggcaaccacaaatgaagcatttgaagttcctgggccttgttttcccttgcagagtagggcagatagtgcctgctcagggttttgaggattagatgagagaggatcttgaatgagccctgtaaaccaaaaaaccctgggtaggccaggcacggtggctcatgcctgtaatcccagtgctttgggaggctgagacaggtggatcacctgaggtcaggagttcaaaatcagcctggccaacatggtgaaaccccatctctactaaaaatacaaaaattagccagaggtggcggtgggcacctgtaatcccagctactcaggaggctgaggcaggagaatcacttgaacctgggaggtggaggttgcagtgagccaagattgtgccattgcactccaggttgaacgacaaaagtgaaactccatctcaaacaaacacaaaaaaaccctgggcagatgtatggcattgttttccatcatcttccactcagctatgaattaattcttggtacccaggcttccaagagaaaccctagaaatcagtgaccactgagatttgaggttggcatttataggcatgttctaggcctaggtctgaaagagctcataaattccacctcacagtgaacctatcagtcaatacaaattgagtgtcatccatatgtcagccactctgggctgggtatacaaaaaggagaaagacctggtctctgcctaaagaaggcttgtgacatggtggaggaaccaaactgcattctactggaaagcagaactgagagaattaattggatcaataacagacgcaagtgatgcactgttggaactaggaggagggggcaattcatcctgatttgggaagggtcagaaggaaagaagagatgacctttgggctgagctttgaagtaggagtgttgagagggaagtggtgacccctgggctaactttgagcaggagctctgtttcaaaagacatagataggtcagaaggggatggattctcacactccatccaagtggagcagagcctgtcatcacttcaggaagctaaatacacatgtgtttaaaggaagtaacccggcaatctgggagtaggtccacaatggcggcccaccacagaagctgagaatgaggagagagcttgagccctgcattgttttgtggaagatgaggaactcacgtttagccatgcccttcctttcccaggatgttctgagggatcaggtccagaaactggaagagcgtctaactgatactgaggctgagaagagccaggtccacacagagttgcaggatctgcagagacagctctcccagaatcaggaaggtgagaagctcaagacaggcagggagattgagagggagaagggataggtggggagcccagaagtggcaggcacaggcctagcagccactctgtttattttattttatttttgagacgacatctcactctgtcactcaggtttgagtacaatgtcacgacttcggctcgctgcaacctatgtcttccgagcagctaggattataggcatgcgccaccacgcctggctaatttttttggatttttaataaagacggggtttcaccatgttcaccaaccagcggagccaccggggtctctaggagctcctgcacaattataggattgggggctagaagggacctccagtgtcatctggctcaaccctgtctggaattgagggccaaggctctctgtgatgaggatgaggacatattgggatgattaccaggcagcgctggggctggcagcagcagggagtgcttgaactcctggcctcaagtgatccgcctgcctcgacctcccaaagtgctaggattacaggcgtgagccactgcgcccagctgcactgcattatttacccagaaatgtgaggtgagatctagatgcacttccaaaggggtgctgaccaccttgaactattttttcagctttgcttggcctttgaggcccatcctggaagaagagattaggaggaacagatttgatgaactgaaagaaggaaatggctgggcttccattttctgtctctgtagatttaaaaattaaaaaaattggagacccagggccgggactgtaagaacattataaaactgcatcttttgtcatccatgttacttatttttatcatcttcaactgtgtcctccaagttagcctttggtagctgagggattatgagcttatttgggagaaagcaaagagaggggatctggggaggatatatccatgtgccagccaaggactagaaagtgtcatgactccttacaaaggacaggagaggaagggtcttgaagctcaagtttctactgtaaaagagaagagttagccgggtgtggtggtgggcacctgtaatcccaactactcgggaggctgaggcaggggaatcgcttgaacccgggaggtggaggttgcagtgagccgagattgtgccactgcattccagcctgggtgacagagcaagactccatctcaaaaaaagaaaaaaagagaagaggacaccttgggtctgggccttttttgaggccgtttgagggttccctgagagccacaaaaataatgggattccaacgcctgttgcagaaatggtgggcaaccagcagagccacccgggtctctaggagctcctgcacaattataggactgggggctagaaggaacctccagtgtcatctggctcaaccctgtctggaattgagggccaaggctctctgtgatgaggatgaggacatattgggatgattaccaggcagtgctggggctggcagcagcagggagtgctgccaggcaaatagaagcagctggcatctgccagctcttgatgtccttgatatctctaggacactggatataattttctccttcttggccttccttccctttgaatctgttccccatcctccatctgcctctatatccctctatatcccaaacatgggtcttactccactacctctcctctcctctcctcttctcaaagagaaatccaagtgggaaggaaagcagaactccctagaatctgagctgatggaactacatgaaactatggcatccttacagagtcgcctgcggagagcagagctacagcgaatggaagcccaggtaaagtggtactggtttcagggaggggtttgcctcaggagtagtcccttgggcccaccttggcctgtggtcctgtgtcccacttccttcagcaagtctgtcagttcctctggctgtctccatgtccctgggggccattattcaggttccaatgaatcctccttcaattgctttttctgaattgaggttgatatttttgccccttgtcctgaaggaccagcgtctcccctgggcatagcagagtcctggaaggtggtagggatgcccttttacagtatcagcttaagtggaatataccaccactttttttttgcccaagtccttatcactgctagtgccacaaaataagaaagagaagggtcggtgttggggtgacagtagcagggaagtgtagtctaaagtggcttttcatcttgtcttctagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggtaagtcactccatggggagtaagggccaggggacacacccctgtctggctgagctcagggactgcccaccaccctgggccctgtggcacctcaggggtatgagaaagctgagatcatgagcacctcaacatcggtgggattcaggctactgtgctagtcgggagatacagagaggataagacccccacagtccctgccctcacagagttcacagtctagtgggtaaacaacgataatgcagtgtggttggtgcctaatgggggaagtttagtatgccccaggcatgctggagggatgcccaccctttcctgggagtgggtcctgaaaggctttctggtaaaagtggtgtttaagattagacctgggccaggcacggtggctcacgccggtaatcccagcactttgggaagccgaggcgggcagatcacttgaggtcaggagttcgagaccagtctggccaacatggtgaaaccccgtctctactaaaaatacaaaaattagccaggtatgctggcatgtgcctgtgatcccagctacttgggagtctgaggcaggagaattgcttgaactcaggaggcggaggttgcagtgagccgagatcgcaccattgcactcgagcctgggcaaagaaacgagactccatctcaaaaaaaaaaaaaaaaaaaatagacgtgaagggaccagtaaggaactagccaagcacaggttgaggaggagcattcacgggaagaggaaaagagggcgagaacaagtgtagtatctgtgtagatggttcaggttgcatgggacagagggaggatttgggaagagaccggaagacagcaggggccacacctgtcagggcttacaagtcatgctgaggacctgggtggtgggaagcagatgaagtttttgcagcaggggagtgatgtgatcagacatacagctcacaaagattgctcaggctgccgtgtggagcaacagcatgtctggagagacccactgggaggctgtactgggaagtccaggggagagcttgtgccctaagatggaaagtgtgaatggagacatgtgggtgggtctgagaggtaggacttgattggctaagaggtgggaggaataaagagagggcagaaagaagtcaaagatgacactcaggttcctgttcatgaagatgaagagaagcaggtgtgagaaagaggagtggaatgaatgatgaggtcagtttggaaatggagggaggagcctgttggcaggtcagtaaaatgatctgaagctgaaggatggagttgaagccagagacactttggagtcatcagcagttagaacaaatgggtttcttgtaggcagaatgttgagtgagagaggaagtgggcttaggagaggacttcagggtgtattatttaacctcaaggtcaagcaccgtgtcttagtcacctttgtacccccggtactgagcacaagacctgcagagagcaggcaaacaggaaagccaagttggctcaagagagagaggcatcatctctttttccaaaagacgcccagtccaattttccagggaaatagactctacatcctggtcccttgactgggccccagagaaccccagacacacagtcccccagagagttcattctgggaactcacaaagctctgctcttggtgaagggcaatatgaggagaaggaggtccatctgtgaactccaaagttcacagggtttgaaatacagtagtgcggcttatcagctgtgtaaccccgggtgaatgccttcactctgatcttcaatttctcatcagtaatataggcattggtggtatgacatggcatgatatgtatgaattgcttaggaagaaagcactaagtggacctcctttcctatgttcaggcccattcttacaggcacagcaaaagtaagttatgtaattgggcaggagggcacttcccacccatactcttgggttactgagcagtattcactcaataacataactctggtcagagtcacttcacccactgccacctccaaacacacagggtgagactcttgtctcaaaaaaacaaactcataaatggcaggactggaatgaggtctgagtcatctgcctctagagcgcaggctttctgtcaccaagctcttcctctctcccaggcaacccacatccacctgcgtacacttgttttctcttgttcatctcttcttgactgttatcatttatgaaccacagggcacctagaaagtatctagcatgaggcttccccatttatccaaagggacttaacctaaggacttgatccatgtttcatggtgcatgtagtcgttttataaatgaggaaattggggtttggggagagcttgtgctttgaccagagtcatatagccactgagtggctatatgggccactgggtacgccacagggcacccagccctgtgtgactcgagagtccatgctgttcccacagcacatcagtgctctgagtcattgctcagccttctaggagatgtgaagtgagctgggggctctgatcctagcttccttgctagctcaccgcatatccttgagaagagcccctctgctcctttgttttacctatctgtaaaatgaaggttctgtactagaatgactcagagcctctaggaaaaataagacaaaagcctgaggagaacattgaaccgctgtttgtgtggaggatgggttggtctggatatgaggttggcaaggtgtgattttgctccatacctccgtaccctaggatgaactggagctcaccagacgggctctggagaaggagcggctacacagcccaggtgcaaccagcacagcagaactggggtccagaggggagcagggtgtgcagctgggagaggtgagctgggggctctgggggaacaggtgacccagcagggagctcctgtccaggggtttgtccccttcccttgggaactgggttcctgaagcttaaacctgccagattggtctgtgtgtcctctgtctgttccctacctgtcttaggggctgcccaggtgagattcacaggtctttcccacaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtgacccctcttcttgtccagtgggcatgcatctccacttctcgtgtggtccctagagcataggctcagtaaattacagcctgtgggccaaatccagcctgctgcctgtttctgaaaattaagtttgtttttttttttcccgagacagagtcttgctctgtctcctagagctggagtggaatggtacgatctccgctcactgcaacctccacctcccgggttcaagcaatcctcctgccccagcctcctgaatagctgggattacaggcatgcaccaccatgcctggctaattgttgtatttttagtagagatggtgtttcactatgttggccaggctggtcttgaactcctgaccttgtgatccgcctgcctcagctttccaaagtgctgggattacaggtgtgagccaccacgcccagccctgaaaattaagttttattggaatacagccatgcattgtttatggctgcttccctgctatgccccacaaagcctacagtacttactgcaggagaactttgctggcctttgctccagaggtctgagaggctggccctgcctcttctgcttcaggagcacttctttgcactgaggcctgccctagctgtgccttcctcagccaggagttctcttcccatggttactgtcccctcatatacctgcacaggcactggccacctctggagaaaggcagctctgctccaaccacagagccaagccgagccctgatttcttatttgcaccttggcaggtggagcgagaacggaggaagctgaagagggaggccatgcgtgcggcccaggcagggtccctagagatcagcaaggccacggcttcttcacccacacagcaggtttactcattttcctcagctgcagccttagagagcccaaccccagccaccagaaactcagccctcctcattgcatatcccgggccaacagcacttcagctagtccagagagcccctcctgactgcattctgccctgctcggcacagctcagtctgtccctgccctgagaaggaggcccaacattggggtgggggttggggtggctagtggccctgccttctgagggacttagatctgtgtactcccagaccagtgccacagactggcccgggagtggggctcatggggctctgcttaggatccctggtgtatgggggttgtgtggtgcttgccagctcctgaggagcctaggagcttgatcacagcttgatctcttagacctttttacaatgttgagtttataggcttagggtccatggtctttcctggagccagtgtcccttttttgggtaagaggcttggggaagactccccaaactactcgtctaggtgaggtatccctgccaacagacacaggcttgcagcctgacagggaggcgctgtttatggtggctgagcactagatctccatcccttgtcctttattgaaagttctcaagggcaggcaccgtgtcttcctctctgcatccttagctcacagcccagggctagcacaaagcagatacatggtgtacttctgttaaattaaaacatgcctcagagaagcaaatgccatccaggccttttggatgttttgtgtcaggtctccatggcgttgcccattatgctggtgtggggcctctccttgctgcagggcctgctgccccatagacgtccagtctgagttcagatgcttctggcccatagcccttgcccaggcccctaagattgtgatgaggttctgcaaggaaacttgcagaaaccccagagtgggaaggcctatgccaacaagagtgctgtttgtcttccttaggatgggagaggacagaagaactcagatgccaagtgtgtggctgaactgcagaaagaggtatgttctggattttctaagcccatattccctcccttgcactcaggccctttgtgcacctccagcagggagaggggaagttcctcccttcagagaacttcagtctccatgggaggcaaaaatagtcccagtcccaaccccatctctcatatgcctagggtgggagtggggaagaaagcatgatcctggcccccgacttccaaatccatacttagaaagggaaaggagtaggaagagggctgaggagcaggcagaagattctaggaggacaggtgggagcaagggaagccatcctggcctccctgccctcagaggtgccctcgcagccaagactgttgccagtgccccagacagaggagccaggcaccagcacaagctccaggccacacagctcagcacaagctccaggccacacagctcagctcaagccgccactcgcagagaagtgacttgaagagccttcctgcctcttaggcctcaactaaaagtccactctccctttcaagttgcaggaatcataagtgttacctttttatttctgagcctatttcagaaatcagtagtcactactggcagggcctgactctgtagctagacctaagctattactttgaattctattaaactcagaatgtttttctattttattaaaaagtcaaagcaggtgcagtagctcacacctgaaatcccagcactttcggaggccaaggtgggcggatcgcttgaggtcaggagtttgaaaccagcctggccaacatgacgaaaccctgtctgtactaaaaatacaaaaattagctggacgtggtggtgcacacctgtaatcgtagctactcaggaggctgacacacaggaatcacttgaacccgatggggtggaggttgcagtaagccaaaattgcatcactgcactctagcctgggcaacagagcaagactctgtctcaaaaaaaaaagtcagatagtggttatacttgagtatatattgttatcagcctcatcaaaatgtacatttaaaactgggcatttttcacatgtaaattatctttcagtgaagttgatgaatagctttgtggttttcaagcgcgctatttgagtcacatgtgcagccaggattgagaatcactggattctagaattcctaagggcccttcctctaaactctctacagcctgtttctgagattcgtgtatgtggtagagttgattcagatgctcagccaacgagcttcagagaacacagagcaggaagagctgggacaacttcagggccctcagctgctctcccttttttttttttttcctgcccaccaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgagatctttgcattca

SEQ ID NO: 114 - DNA, 29851 bp, Homo sapiens
ctgcggcgggggcggccccagcggatgaatgaagcggcgcgtggctgccggggaggccagagcgtggagcgctgcgcggcgcggcggccgggccctcgagacggggacggtgagtgcgcggggagcggggagctggcgcgggtgcacagggcccgacctgctggcgtaggagcgcggcaggtgccgccatcgtgggcaggggctggagcgccggggggatgcgcgcgggggcgggaggcctgggcaccggccgagcgccccgagcctctccgcgggggagggcaggaccgagcggaatcggaggccaaattcgccgcttcccgccgccggctgcgcaggtaggagctcccgagtcgcccgcaggaggaccgaggcgaaggggccccacgctgcagcgggtgccggggggaagcgggtgagcaggggctgcggccctggcagggactgtcggagtggccggggcaggtgacctgggcaggtggcccggagcgcgcgcaggcgcaggccccacagatccagctggggacgaacgcgcctccgcggagctccagagttgcggagtcacccacctgcggcggccgctgctgccgagtcaaggaggaaaccttcatgcacggaagtttctcgggggcggccgggctttgttcgcgccagaggcgctcgagacatctccgggaggggagcgcgggcggagcgcacagggctagtttccagcagcggcggcgcccctttccctgccccaccacgcgacgtcctggccgtggcttggggggacccgggcgccctccaggtgcaggcagagggtcgggtgccctcgcgttgctgttgggctcccctgaccagggaggatggaaaggaaggagcaggcaggcttagctgccctagaccggccctagaccgggaacctggaagcagatctgacttccacttccaagggagaaaccgcctcccgcactggcgccccgaggggagagagaagcccagctaggtttccgcgtggtccgcgtggttggtgaaccctcaggctggggggtgccccgcttggcgtgcaaggccctctttggagctgccgtgggacctggctatgcgtcctgtttctgtctggaggcggctggaacgcggtagttttccacatccatgcaaccagcttgtcagctgctgctcctcagctgtggtttttggaacttgggttacctccatctaatcagaaactggctctgcagagcccggtgtcagcgacgttttcattcccagcagcgggagcaaatggatctcagaggacagctccttggccttagccggctccgcttgtgaatctggtaataatgacaaggacagtgacagcaggggttaggtgttgagtgctggaatgtgccgggcatggtacccctgctttgagcatcgtctcattcagtccctagcaaccccacgaggtggccattatcactcccactttatagatgagtaaactgaggcaccaagaggttaagtgattgactctaggccacacagcttgtaagtgctgaagaggtctgactccaggtttgtctgatccaggcttgggctcctgttttacgactctgttcttaaagaggcaaaaggcgactgcagggtcaggccggagacccagaacagcgtcccaagagctgggcctgcggttactgggccagagtgtctgttctgggttgtcagtgatcgcaggacaccagtaggatgttgctcgggccgagaccacacagcccgacttccctctgtgctgctggagggagccagggcagaggccggccactcggtgagacctggacgctgaccacagccaggctgccctgaccgccctcagcaggctgtgtcctgccttcctgctgggcaaggtcagcaggtggtgcctggaaaattcttcatgagggagcttccctcccgagtggccgtgacctaatctgtagctcactgggtgtggcccctaaagcaggtgctgggcaagtccctcccatggtggagagctggctgggcacgtggcaggcagggcaggctgggccaggtgaagggtggccaggtggatggacatgctctccttgctagactaagcccagagaggccggctctcctcggggctctgatgggccccttggcttgaccaagccccattgcagttttggctccaggtcggtctgacttccaaatggcaaaatttttctcagcccattgtagaatgaaaagttaactcatcgagcttagtattgtgcctacaaggtcttcgatccggatgtctccatgagtgttaatccatttctggggtgggtactgctgagccaatatacattcctggcttcctggactcgtccactggaacgtgttgggtcctggtgctctccccagcagatggttgtaggtggtcagagatgagccacagaaaagccaacgtgcagcctggtgctgggggcaggagggagcagggcccttggagctctgggagagagccacgccaggccagccctcctgcttcctcaagcgggctgtggacagaggccacaaaacgttccctcacgagccacatgactgcctcatttgcaagtggcaaggtgcacactgttggcttttggacaaggacatgggacagtcctcagaccttgctgttgccttcgttctgggacatggaccactgtctggccccccagtgagcttgctgagtgtcagctgacttcaggcaggatctgggtcttgcccacttgttggaatgggcacgtggggattgcaccccttgaacagggagggaggtgccagtaactcacatgctaggttaacaggttctgggtgactctgagccttggccctgccaggggtgtgaggaggaaactggccctgctgctgggacaacagactctgggcgtgtcctcctgtgggcctctgcagaggaagcagactgggactacaaagaacaacctggtcctggggaccctgctgccttctctggcccctgctggcccttcaggctacggtgagggtgagggtgcgggtgaggatgagggtgcgggtgaggacccacccacacccgcaccctcaccctcatcctcacccgcagcctcaccctcagtcctcagacactggggtctccggctgtctccaacccttcagttcttttcagtagcctccttcccaccagcatcacacagaattagaccctgggactacatttctggcggaaggtgactgctttttcaaaccacgtgccttctgcagaagccgctccccacgtagcccaagcgtagggtgagacttggcaccagtggctggggtcgcttttgggtgccagagagcccagattcctctccctcccacgcgcagccaggcccttcctgcccacggaccttgccttttcttggtggtttttctaatctggcaagccttggggggcacctgaggcattgcccctctggcccaagccgcagggagagcttgcgatgctttgggtggcgtgtgtcgtccagtctgccccaggctcacttggggcccttgcatttgccactggactctgcctttcgggaggcgctgtggacctgagatttggacccatgggcctaggaggccacctgggaggagagtggcccagctgtgccaggcaggttcctcatctggacagaacctgctccctgcagcctctcaagctccccgagggcccttctgggtcttgtctctcccacacattgggggtcaggtttgagcccctttgctggcggacctctgagctgcccgcccttccctcccaccacccgccctgcctcctgtggtgcacagggctctcctggaggagggaggtcctgggcatcccctgcctcctcaccttcaccctcaggagtcccagagccctggctgctctgcacagcaggctgggaagcaggccctgtgcccaaggactagcctgagaactggggaggtcctttcctcttccccagaggacaaagagagctgtgaacaccacgggtctgtaaaggggtccccccacatgcaggaaaacatgagttgtggcatcacttacgccttcactcaccagtagccgaggcacagcgggggtcctgagcatgggcagggcaagccacttccaccccagccatggaaggaggctgaggaggccagggcagcagtggggacctgcggcaggcagggcctgcagggctccggggccggacagggtggatttccattctgagtctgtttcccatgaactccagtgctgactgggcccactttgagtaggacgctcagtggctcattctcattctcatgatgtctctgttatgggtggaaactgaggcagagagaggcccgtgacctgcgtggcttggagccagcctccgtcttcttctcaaacatgcccttgaatggcaggagagttttcagttccatggatgggatgatgagtcggaaggaagagtaaacctgcacacacccgtggcttcacccgtcctccccacgctcccaggttcagtgggtggagactgggtgcaagcaggttgagggacaggtccttctgggctggccctgctgccgcaccctggctccctcttgctcagacaatccttcattgtcggccccatacaaagcaatggcttcctgcctgctcgcctgtgcgaggtcaccaggtatgcaaattggggtgtaccaggcacagctgaggcccccatatgctgatcccagagtctgtgcctcaagctaaagaagtgaaagctcctttcattcattcatccagcttgaggaagagaccctggagtgaatttggagatagaggagagagtcccaggtgtcttggggggctggtgtggcaggggaggcagctgaagatggtgtggggagcaggcaggtgctcagggcggggctgggtgcagggcaggcatgtggctgtggctggcagcctcagagccgtcaggtgccaggaggagggactcggctttgccaggcagtgcctgggctggaatctgaagagaaaggagaactgagaccctatggtcctgcctggcctccaaattctgagtggggcctggaagccgggactgggacatcccctaatgtggaggggtgctacccacccagcccagctccaggcctccctggggacatttgctgggccacagtaggtcagccaggccaggcccaggggctggcaagcttaaaatagttttctcagagatcctgcgtcctttccacgcactgcgctgagagcgctttgcagggagccaggctgggaagtaagtgcatggggcctagggaagtaggtgggcttctagaagtggcacaggccgggctgtgtcagctgcccacacacggggatacaggctggcaccccagttcccacagtctgggctgtgccagccacccgcacgtggccactagctcctcccaggtcactgtcctggcttgagaggagggggaggaagaggtcagccggattcgcctctaaaagaccctagcagaggagtcagggcctcctatcccggagatgcagctgactgaccaggccagcatgaggaaatcggaagagaactctggcccccatggcctcctcctaaaatagcgggcactgacccatacacaggcgcacacgcacgcatacaccctccccaggcctgcccccagccggaggctccagggacacattatcccccggctgatcgccttggcctaattcacaccctggctgccaaggcctctggcagcaacatccccccttcctcccctgcggggttgttgtgggttagagcagggacagggcctgagggggctaagctcccagggaaagggcagctggctctctagatgcaccggaggggcggggtggtttgcgtttctctcgggctgagagccacctaaggctccgcctcagatgttctcccatggacagaggcatcagggcagtggggaaaggatgggccgagaggtgagtgggtgccctggggcggggcagccacagggggcctgaagtggctcacgggcggggccaccagtcagggctccgggcctgggcacatgggcaggctctgcttccaggggctccttcccacctgccggctgcatgggagccgtgtggccggagccccaggggagaccttgtccctcattctggagcagccgtcaggagtacaaggccatgggagaggaccctactccatggaggtgatggaccctcctcccgtgatggggcagatttcagtaactgtgtgtgcacaggagagctcagctggttcaggcctccagaaggttcctgggcagcgatggtggtggtgtgctgtcagagcctcctccctaagcctggctcccagggccttggctgatgactggaattcactccaggctccgggcctcttgtccccaccggccaggcggttctgattcgcagccatgggcagcttttgcacccagctctcgagtgaccgcccctgggctcctcgtgggtgcgacagtgtcctgggagtccctgaagcccaggtttcccacatagcaggcgttaggaagtcggtaccaaagtatggaaggactggcttgtattagtctgagttatccagagaaacacaaccaacaggataggtggaaagagatttatcctgaagacctggctcaagcacttatggaaggggcaagtcccgagacctgtcgttggcaagctggaggcccaggagagctgatggtttcggtccagtctgagtctgaaggcccaagaaccagagaaatgctgctgcaggttccagcctgaaggctgaagacccaagaagagctggcatttcagtccaagcccaaaggcaggaaaagaccgaggtcccagctgcagctgtcacaggaggaggccctctcactcagcctttggatctatgtaggcccccaactgattggacgaggcccaccaccctggggagggccacccttcacatgctaatctcacctggaaacacccacagcacacccagaacgatgcttggctaaatgtctaggcacccaaggcccactcaggttgacacatgaaattcgctatcacagtgctcttggccctgaccctgagaccatcgcacatagcgtcagaggctgtagagtgggccctgcagaggccaggaagcagatgccctggtgttagatgcagtcagggtgttcagatgaggatgacagtggactcgacctgggatgctgacaggagccagggtggcctgggggctggccgctggcctgtccttcacagggggtgcagtctcctgcaccccatggctgtcccatccctgccccgggtctcccaccccctcctctgccacgtggctgccactgcccggccttccacaactgcctttcagcctcaccccatctgcagactcctcatttgcagcaccggggttcacctgcatctggcctcatcagcaggtgcagtcttatctgcgtataaaccagcccaccccatgcagccagcttgggatgagaggacggtcatggggtccccgtggcccttggagggaggcctttggaagaggcaggtcctttgaatttggtctggggtcaaggctgcctgcagctccctccccagctccgtagtgggggctgtatccatgcatcagaagaagctgctgccttttccgggggaagctgagggtgtggatcggaagaagccgctgccttttccaggggaagctgagggtgtggctctgggatgaggatgaggctccatccttcactgttacagggaccagcttgggaagctgacgcacctttttgtcaaaaccaattccaagtggaaagaaactataggcaggtgtgcatgtgtacacacacctacacagacgtgcacacacaggatgccagaaagaagaatcaaaaggacaggcctcccttcttccccaagcccagctgcaatgtcctgttccccttggtggggccagtccaggggctaggcagcctctacgtggggctgccatgaggcccttccagcccctgaaactcccctgccccaccccacaccagcttatccataatgggcctgagaccagaaaaccaaaggtgtgggctgccgagctgcccgccttaacgcggaccagacatcattactccagtctccattagcagtgaacgcagaggtgacgttcaccttctcactgagccatgagtgcatctgccttggccatctcggaagctagcagatcgcagaaggaaagcaacatgtgagtggcgcgggtggtcctcatgggccccagcagcatttgtcattgatggaactgatgaccgagaccaggatgggggcgctggctgcctccaccaagcatgcgtctggctgtccacattgctggactcggctgctgcggctaagatgctttcatgtcccacgttgggctggttttcgtggcaaacgttagccctgaaatgtaagtcctgcaccgcacgttcagcaaggactccctcaggtccgggccaagccttgacatacatgctgggcacccacttctccaggcagagttctcatccctctggctcaccagctcagaacggcacgctcagtaaatgccagtgcttaggacgtatccatgtgaggtcttggtacaatcctggaaacttcctttgggaaatgcatgaatgtgggaccctcctcatcgccctgagagtccagagtgttgcctgcccagcgtcactccacaacccatctgtcccctggatggcaggagccaggccagacgccccatcatagccagcttttatgtttgctcctgttgtcctttagccctgagtcatggaaggcccaccctcccctttccaatctagacaccgctgttttaatggggaaacggcctcccagagaagatttccagcttcagaagagaacccggagctgaaactcttgggcatgatgaagatggaatgggtactgtcacacacatgctgcttgcgtgagattcagataagggaggctggcccgaagccaggtcgctgctggatctcagaaagacgtcagaacgaggccccaacggaagcccctggaggtgcacagctggtgagctgagtggtgccatgtaattctcatcgtctgcggccgtctgatgggcatctgtcggaagccacatggctgatatttaaaagaggattttaaatttgctgatttaaatgtgcataataggtaactttcggctgagctttacatatttatgtcagagcttttaattcaggtaaaacagccttcagcttggagctgtttggacacctacaactacctgttctttctcagttgtggctttcattttcaagaaggaagtccttctgtttctctgtggccattgctggtcacgaaacttagcaatctggcttcctctcaaagctatgcagacgggatcctcccccttcccccttacctgctttggccccagcgtctggtcctgaggccagggctgaacaaactgcctgtatgaggcaagcccagtgcccgggcgttgagcgggtgtttcacggcagccagcgtcttggttcgcaatggtttacgtgggcttgcccaccattgagcatcccagggaccccatcagatcctttgcagaagtgctgccgaatccgacccactccccctgcccccgcctcccccaccctgccccgccccacaccccccacccccgctcggcccccctccccgtgccagcacgtgcagctaggcggaacctctgagcactctcccgcctgcgtcaggctgttccttggccctgttgaggctccttcccttcatgttctggcccagcccggaaatgaggtcaagtttctgctatttatgtgtgtgcgtgtgcacgtgtttgtgtgtgtgggtggaccttgacctccaggcagtcctcagggtagttcttggctctgtgttcctgcactaagaaaaacaatgcgagggaaacacacccacaggctgcctggggagtctgcgtggctctgagcctggcctgtcctcctccgggcctctgaggttgctttctgtttcggcggccggcggccggtggagcccttgcgcctcctcgtcagtcccgccccggggctcttgctcctccggcttttccgctgactcctggcattcgagttcttgtgttacacatgctcctgggacgtcatccttgtgacagctcgcttcagtagaaagcctgtggctcgtgggtggccgtgggtggctctctgccccttggggaggcgtggagcattgctcttacaatatgaatgtctctccttccacgcacactccctttctgacgcagcaggtcccaaaccagcctggcctgccagctcgtggataggtgttggcattgtaaataaacccccgggtgtggccgcgggcacccagggagcaggccccaggcatgaatgctgtggaatctctgctgtccgaggcctccaaatacggcctcaaacagcctcccggcagtgtccaaggtcaacagcggctgcacgtgagtgccacacgagcgtgcacggctctttcagtaggtgtcagaaggcagctgtgacgcagacgcttggctctggggccagactgcgggggctgcatcctcattgccaccggcgggctgtgtggcctcgagcaaatgactgacccccctgggccttcttcccctactgtgaggcctgggacggtgcctggtacacagctggtgctcagtgtgcacagcgggtgttagcaccctgccacccagcgggattcttcacagcagctgcccgccttcgtcccaaggagcctggggctgaggcatccattcgctgagagggcgagacctccgattccacagaggagccctgtggggaccgcgcctcggcagaggacgtggcgggaggacccagagcccagctttgggggctcaatcctgagatccctgtggccttggggaaggggtgctggtaccgccagatctctccagacgtaaaacaagccttgcctggacctgggggagatcccatggcctgctcccggcctgaccatgctgggcccggtttatctgccttcacagatgaagttgcccctttattaaaaaacaaaacaaaacaaaaaaagccagcaatttgtcatccccaaatgctgtagtgtctgtcagcataggcctgtcccggggctggttctcactgaggcccctgtgtcccctcgcagccccatggcggatcaccggctgcgcctccgctcccacccgccacgctgaccttagagttagtgtgtctgttaagctctaactctgcctcaaccccaaggtcatctctctgggccctcctcaggcctctgtcatctcccaaattcgggggcatatgtgacacctgtttgcctccgtgggggctgctgtaagaaatgaccacacaccaaagggcttaaaaaatagtttattcccagccaaacactgcatgttctcactcataggtggaaattgaacaatgagaacgcttggacacagggcagggaacatcacaccccggggcctgccatggggtggggggaggggggagggatagcattaggagataaacctaatgtaaatgatgagttaatgggtgcagcacaccaacatggcacatgtatacatatgtaacaaacctgcatgttgtgcacatgtaccctagaacttaaagtataataataaaaaaaaatagtttattcccaccagctccggaggccaggaacccaaagtccacacaggctgtgctccccctggggctctgaggagggtccttcctgcccccagtggctcccggggctccaggtggtcctgagagcgccacgcccgtctctgtctctgtctgcaggtggccttctctgtgtcatcttctcctctaaaaatgcacctgtcaccgggtttagggcccaccctaatccaggatgatctcttctcagatcacttgtcacatctgcaaagacgctttttccaaataaggtcatgcgctcaggtcccaggtgaacgtgactgcccggggaacacggggggcaccggtccgcccaccccagccccagcgcaggcccagtgagcagactctgtgaggagctgccaggaggatcctggggtatcacccagcccaggtccccacgggactgcctgctgtccctgcatctccgtgcatctctgcgcgtcgccggctgtggctggaaggagaccccaaggccggatacttagggcttcggactctgcagagccctgagcatggctgatgtggccccggcctcagcctgatgtcagtgggcagcatttctcacgctttgtgttttggagcctcccaggttgtgatgtttcgtgggctgaataagcttccagaagcgccggggtccctgttgaatgtgatacaatgtggcccaatatggacacgccaccgcccaccccaccttagctccacagtgaagacaaaagaccccagactgtggacttagacaacagaaacgggccctctcttactgctgaggaccagaaatcagggatcatggtgtctgcaaggccggcccccctcggaggctgtgagggaaggagctacttccggcctccctcccgggcaggggaatggtctgcacatccacattccctttttataatatggacaccggtcagattggatcagggcccacccaatgtccctgtttaaccttagtcacctctttaaaggcctgagtttcaaaaactgtcatattcggaggtattggggtcaaggctccaagacagcttcttttaggggtcacaattcagccataacaggaggtgccccagatggcaagcaccttgaggtctgcgagaaagaccctcccagggtgggggcggcacaggtgttctgtatcacagcagccccgggaaggaccctcccagggtgggggcggcacaggtgttctgtatcacagcagccccgggaaggaccctcccagggtgggggcggcacaggtgttctgtatcacagcagccccgggaaggaccctcccagggcgggggcggcacaggtgttccgcatcatagcagccctgtttattcgccggtttatttctgacggggaaagcccttaagatgcagagaggctacagccacctgggttccccagaaggccttgggcagtaggggggagctgttgctccaggaattggtgtggggagtgaggcggtgccctgtggagcctcgggatggtggggaacagggctggtgagggcagtggggcaggggcagcgcagggttcagaaggaaggtggcacgtgggcacgttctcctggtaactggtctacatggctgccgactgcaactcctgttagccacaggctgacccagcagcggccggagcttggcggccgggggtgtttccggtgctgggggctcacgtggcccaggaggctgcttccagctcattcctgcacctcccaaactctgcacggagaggagctccttcctcacgccaaagggtgcagagagctgccgggtgtgaacttaaggaagaacaaggtcaggctccaggaccaaggtggagtccatcagggccacttggctgcaaatggcaggggacgtggctgacacagcgagcggggccagggcggggtgacctgggaccccagtgtctgactcggcctctgcgtctcagctccactctccaccgcgtggccccatctcagtaggccttgcccccgtcacagccctgacgccacaccgctgaagcggcagcttctccttccaacagttctaaaaagggcaggaattgagtccctgtgagcaagctgggcacagccccccacctttccgcagcggagctgtggctgggagacacagtgcctgggtgtgggcctggccagacgccaccctggatttgggaggctcttgagacaaggcaggcagagctttgagccacccccgtgatgggtgtgctggaatgttccctcctggatgtgctgtacccgtggagagacgtgagcttgctaaccagacattcttctcacaggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattggtgagtggggctggcggggtaagtgctggcaggggtggctgagggcagtgttgcaggagtgagggtaactggccggagccagccccgccccctgccttcgtgtaccccttgtctgcatggccctggggctgctgcaagagttggcaggggaggagggtccgccctgaggcccaaagctgatgtaagggactccggctttctcatgtggaccctgctcagggctccaggccgctgtgcccgggagcctcagtgcaacccctgcgtggtgtccagcccaccttgccaggaccaaggggcacagtcactaggcgctgggtggcaccaggtccaatggcggcagacctcatgctccggctgggaacctggcacttgcctgggaaggagtttgatgtgggataagtgacgagggacagagccccaaggccacacccatgtttccctgaaagcaccatgttggctccatcagccacatagaggtggagggacagagccctgagaccacacccacgtctgcccgtaagcaccgtgtctgctccggcagccacataggggtgtggaaaagaccgagcaaatctggagagtcagaactttaaggggaaaaataacatgaagcagctcatggctgcttcacagctatctaagagtaaagatctatgttataactctatgctaggcagctgagctcactgccctggggcagccctgggcccctcactggcttcctgctcctgtttgttgagatgtagggaagccccatggcccgtccgacatggccgagttgacccagtgcacggcccgcctgaccccacttctcggcgtccccctgcctggcttggctctcccgggaagggcatcgtaggatggtcacggggagcagctggccccagccggactctgcagtgacctcagcctcctcatgtcctccttgagctctgctcatcccagtcacctggcagtgctcgtcccaagaacccaggcgggtgttgagatcacctcactccagcgaggggacgtcccaccacaccgagccttccaaatcccggcctgtgggagagtgagcgtggctgggcggaggggctcaggcctctctggtccctttccccaccctgggcccctaattcctgccagtgtccatctgtgcggctacttagacgccctgcaaacggggcttcgagggcctttgccctttcgtaagggaaagacagtgcacttggctttgagggggatttttaaagattgatgctgacccatatcaggcccagtggcaactgcacagactcatctaacttaaagaggcccatgaggggagtgggccggagatgcagaatggcgggtgcggggcttctcccaggcacggggccccacacggccctccgcagcccctgggtggtgcacagcggccctgacgcctctgcctctctcgcagccatcttctacacagcggccatcctgggcccagctgccggctacctgattggaggtgccctgctgaatatctacacggaaatgggccgacggtgagtggccgcgcacccagctgcctgcgctggagaggcccacgtgtctctggaagggggttcagagtcagcagggcccactctgagtcaggccgggcgcggcgcaggtgctgggcaccccccgggctggagggagtcaaggctggccttggctctggaggactcggaggatctgtaggggccttgggagtcggccccagggcaggaggcagggcaggcaggcagtgcccgaggcctaagcgcttgcaaagcccagcgagccctggccactagttccctaatgaaactgagatttttctgtttcttttcctttctttgtatcttgtgtgtgtgaccctagtttctgtaaatgtaagcaggagaaagcaaggaggggtggagggagaggcagagagagacagagggaaagacacgtagagacagaccaattcacagagacagatggagatagagatacagagggacagaaagaagacagcgacaggcagagagagacagagacagatggagatggggaggcagaggagacatgtccttgctgaccgccagtgctctgtgggtttgggccccccattcatcccttgcccatcctgcacttgtgaagtttccaaggtcctctgttactcggcctgggcaccgctgcaccttgggactctttctgcagatggcgcctctcctggaggtctctagcactctgacctcttacaaaagcccctctggcctcggattgataatgtggggtcaagtgtgtgcgttctgggcagagcctggaggtaggctggagctcgtgtcccgggtctggatgcttctctcagtctctgtgccccttctggctccgggatctgggcccactttgcacaaagtggggaggcagagcggggtctggcccccggaggcggccgcagcatttctgcgctggagcaagcaggtgccgcctggctgcagccttgcagggtgttggcgctccctgtgtcctctgtctgtctctgcggctctgctcccggcctttgctggccttttgccctcccgccgctgcctcactgtgaagacacatccccgaaagcccagagcttgtcctcactgtgaagacgcgtccctggatgcccagagcttggatgggcttctaccactccacggccgcctcagcccatggttattttccactcgccttttcgtttgaaagcacttatgtgcaaattgccacgtgcacaacagtcccttcgtggggagctctcagtgagctccagctgagccctctggcgtccctgggaaccccatctgtcatcctctgcactgtggggagggatgcctcctcccgctgttgcctggagaggctgctcctcttagtgcccaaccccaccgtggtctcaggaccaggccacaggtggcatctccagccctggagcgtgggccaaggcatggagccatctgtcttgggggacagctaagccaaggtggtgtttgctttagtctgcaaggaagggacaggacctgtggccagcagcaccaggggcctgtgttgaccagcgtgcagacagaccctggaggtctgcccggaggaggggccagcagcccccagtgtgtgtgccatggagggcacaggtgggctgcacgctgacccaggtgccactgcctcttccacaggacggagctgaccaccgagagcccactgtgggtcggcgcctggtgggtcggcttcctgggctctggggccgctgctttcttcaccgccgttcccatccttggttaccctcggcagctgccaggtgggtttcccttccccagcccagccttcacattgggagactgtcccttagtcttcgcgaagggggcaccccgtttcctctgctgtctttttccccgccatgatcaagtctgcggcacaccctcattctcagtgttcttcccatctgggtggagagacgcctcctggctgtggcacaaggcaggttgtgtgtccatcctgtcctgtggcctcccctctgccccagcggcttctccccctcaggccacggaacaggcttgtcccaatcagggcagggcctccatcccctccttcccccagccccactttgggccccagctctcccacacctccaaacccggcttgtgctgcattctcacgtggtttctgttccagtgccgcctccccggggctgcgagggctgcagggatgtcagacagtgacgttcccagaccggggaggggcagaggagtgggggcagagcctctctcggagaagtccacctccgggagcccccagcccccagccccagctcactctgtgcccttccaggctcccagcgctacgcggtcatgagagcggcggaaatgcaccagttgaaggacagcagccgtggggaggcgagcaacccggactttgggaaaaccatcagagacctgcctctgtaaggaccggagtcgggagggttcctagtgtcctcagaccctttaatggtccccatcttgggggagtcgttgagacccctccgggatcatgatggggacgcagcccctaacctctgtcgtgaccctgggccaagagattaaggagcaacagatagagcctctgggccaggggccgcagaccccgcctcagggctgcagagccgtgggagagtcccagagtggggccggggcctcggcccgcacccagggagccatcacttcactcatacagtgtggagactcctgtgggctgcgcctggctcccagtggccacggagcaaatcccttccacaccagcaagtctccccgtggcctgtgtgtcccggggtccccagggaagctgcatttgacttgagacccttccctcaccatgaccccccacactctaattccctttcatcaggtgtcacctgtgccgtaccccccgggccctgggatgctgcccccccatctccctccctccctcagagtctctgaggacctcccccctctacccggcgtgtcccgctcaccctctggggaggttgcttgctttgccgtctgccttggctgccttccctttctgctgagtgtggtccggccttgctttgctgtcttgctgcactgctagggtgaacccggggccctgagccggtggggtcctagagggacaacagaggggcccgggccctcccggcctctcctggggatcatgccttccctggggggctctccccagggctgggcacaggtggccctcagggtggccaccacccaagtcctcagcgtctgaggccccagcacggggagactcttgtgcccttgtagcagcaggtccctgagctcacaaatggctgtgtctcactggccatagtgggtggagggtgtgggcaatgggtgagtccctgctgcctgccctcaaccaggataggagggaaggcatcagggccaaaggtggcccctcagaaagccccaagctgtccacggcagagaggagcagggctggatgaagatgggaaagagaggcctcattaggaccctgatagaccccccaaaggagctgggagctgcctgctaaggagggtgaccccatgggccaagctgacccggggccacgttcccaggacttgggaacatcgtgtaggcactggctcaccctctctcctccacccagcagcagagcggcttagagctgagggtcaggcgccctgttcccagcgtggctgtgagcccccagtgtggacctaggaaccctggggctctttcagttcatcaggtgataaggaggtttatgtccagggttagttccctaaaccagttgctgggaagaaataaatcatgggacatgttccctttattaaagtcatgactaattctctgggcaaattcaacacgagaatttcagccgagcaatcagtgattaagaaatgaagtttgcatagcatttcagagagtcagggcctcctaacgcagccacacaccccggagcctgggcaggtctgggaaaagccccagggagggactcccccagggtgcccaccccagccccatccccccatatgccaggacccccccagggtgcccactccagccccgtcacaccacacgccagaacccccccagggtgcccaccccagccccatccccccacacgccgggaccccccccagggtgcccaccccaggtctgtcaccccacatgccagaactggctggggaagggagggcatgggctggggtctcctttgtcctccatcgtcttgcctttttcaagacgtgggacccaagtagttaaccagaaagaagaggcttttcaatcctcaagtcaggaaataaattttgaaagaactgggctctcccattttaatcagggaaggggacagaaagaacccatgttcatggctgctgaggtcagtctgagcgagccagcgaacacctccaagcaggcagagtgcctgtgaggctggagcggagtttctgacgccaacatcagctctgcaaggcacctgtgggcctgttggggctcagaggctaactagggctgcaccgtctgttcctgattcttcagaatccatttacatttggccacctcctcaaacaagagcatttgaatgttccaggcattcagagttgcgttcatcggaaccaggctctaggtgtggccgagaggaaagagccgccctcctgcaggtgggggtgatgtgaggccgacagtctgctctggtgagaggctggaaagtgtaggtttacaggatgtcactaagctgcagacgcaggggttcaagtcagcgacactgcggtgtgagcagaggcgacatggacatgtcatttattgtgaaaatttgcattactgtgggctgatgtgagaggctattgtgccatgacctggggcttcaggaacagtctctgcccctggtctatgttatgagttccagggacaggacaatagctgtgtctgcaaacacccccacctgaggccgagagccccccactcagtgggggagaagggtcacgcacaggagcgtgctgtgaacaggatgcaggcagctgtgagctgggatgaatgtgagctttgcccagtctgggtgatctgtgtaccccagagagagccgagcctctctttgcagaggcggtttcccttctgtctgcctcgatcactgcactggctgggagggctttgcgtggtttacaccatgcaacacgttttccatctcagcatcttatgcgcttaagcagcggttgggcgttagccctgctcaggcctccaatgctaacaaaaacagggagagcctccattcaccccccagggcctcgtgtgcagggacaggcagccccgacgcactgctgtcggccacctcctgggttagaaactgcaaggcctgatgtggggccttcccagcttccagggggctatgtccttatcctgagaccccacagccaggaccgcaacaggcagatgtggaggctgaggctgagccctcagggccagacggctcagagttcccacagttccccccagggctccaggcccatgcaccaaggactcgccccagttgaggcctcaccacccccagggccactggcccccaagtgcaaaccaagctagccaggtccgtctacccaggggcttcttgcatggagggttcgaatcccagtggcttcctgccccacttctcccaggggctggcggttggggactggccacagtccccattcccgtgattccattcccctatcccagggcctgtccggtcctggacttggtggcctctgcctgccccagccagttccctttttcaggccctgctgctggccagtgacggaacagggtcctgggtcacttggggtctctccccacctgagctgaagctctggccaaggcactgataaggtttttccctaatcagggactgcagctttcaggacaagtgggccacaggcataggctcagcctggcgccccctgggtttctctggaataagtgtgggtgtcccccacctgcctgcaccccactctactccctgtcggaacaggggccctttgtaatcagaccggggagctgacagcctcaggaacagcaggttcctcccaccctgggtctggcccactctgaccctcagtctcttctccacaccccgacctctgcccaccactctgaccctcagtctcttctccacaccccgacctctgcccaccactctgaccctcagtctcttctccacacccccacctctgcccagctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttggtgagaaaactgaatcttgggggtcctctgcttttatgtcagttctcagaaacagagtcttcaagggcatcttctagaaagacccagacagggcacatggcagtgagtgccctcccacccccgctgccagagcaggtgtggagagcgccacgggggctgagcgactctgtccacaggccgggagagtggtggtcctgccctctttgtgggacatgctccgtaggtggaagggtccacggtgggctccaccccctagccacctagtcttggcttctgtgacttggtgcaggaagggtttggacctggctgttccatgagccaggcactggtgcctcaggacctcctggaacagtgcagctgggggtttctcggtgccagaggcaggctggccttcccaggctgggcaggtctgcagaaagtggggacccctcctcagagctgctcctcctgccagcgttcacagagtaccctgggccatggcagaggtgccaggcatgtgggccaccaccgccaatctaccgcgctctacccttccagggtccactatctggacaggaagagggcatcagatgagggctcccctccctcccccacaggcccatcctggcctggcccctctgggctgacctcacaagcccacattcccacactcaacagccccccagaggtcagctctactgccccttggagagcctccccacctgtccccccaaatctgtcccctccccacctgtccccccaaacctgtcccctctccacctgtcccctcacctgtgccctcctcacttgtcagcccagaagctagatgccagctaatcgcaattttttactgttggtggccactcaggcttcgacaaatgtccttgtcacagcctgcagggactcggcagaggcccctgggggaggagggggtgtggctgccctggaggggggtcagtggaggagtcattggcttcccactggggcaggggccgctgaccttggagcactctgggctctcctcctccccccgccccgccccgcccccccgctcccccttccccttccccttccccttccccttcccctctgaggcatccccgctgtgggctctggacagaggtccctcctagggctctatcagcgcaacagctaagcactcaggtgtggtgttgagtgctgccatgcaggcaggaattgatccctctatgcctcagtttccccacctgtaaagtggacccggctgatccaccaccctctcccaccacggccccctgcctgagtccctggctgaatccctccctctccccagggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggaggtgagggccagatggcacctgggtacgcgtcggggccccaagcacccgcggtccctgggcatggaggaggagtggtgcagcacttgggagaggtggttttgaaaagggctacgtcacaggacagcggcaagggcaacacccgctcagcagggcacccggcagcatccacgtgaaaaggcaccatgccagcccccagcagtgcctgcgcttgggtcccggctgtgcccccgggcagtcatatgcctctctgggcctcagcactctgctctgtagctgtgtcaaatggaacaacagccctagtgttcggggtccttgaggctggtctctcggtgacataaaaagtgtcccaggatgtgctcctggagttgccatgtgctgggagtgggagggacacctgctggtcaggtggcaattagggaatatccaaaatacacgtaggtagcctgcacctcggccctgccctgcgggccccgggagtgcacctgcaggtgccgtgcaaggccgagaagcacaaagcagccgttgtggcattatcggaacctaagagtcatcagggtggacggggtcactacgctgtcctcacaacagaggccctgcccacaaaggagtggaggaagctcatcctgggccactgccaagacatactgtgaagtgggaaaaaggaaggagttggacaatgggcgcagtgtgctctgattcaagtgagaagtgcagatgtttgtgactgccgaggggcgtgtacgtgcagacgacccctgcaaatgcacagccggcctgtggctggagaaccgaggactggggtggggctggggccacgaggctgcctttgtgtacttggcgctttttctttcctaatgtttgtatttgatccatatgaatgtgttgcctgtccaaaaacaaatgaactagggaaaggggctgtgcatcaggcggacggtgctggggggcatgggtgtgccttccttgcgtgaggaggaaaaaccattctatcaccagaaggcagtgcccagtgtgagtgcccagcgtgctgggggcggtgcaagcttggcaagtttgtagacccgaaatgcaggctgcatggggacgagccccatggctgaccctgtgcctgctgggcgccagcatggctctggcctggaccctaccactcgcttgtcccccctctgcagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgagtggagccgctgcctaccgcccctgtcctcccctggaccctgggaaggggcccccgtgccttccccttgtaatcggagctattgttgggcttcccaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacggtaagctggggtcgggtgtgcgcttgtccagagctttccttgcagcaccctgaggcggagctctgcagatcctgagacaggagcactccaggaaacacccaggtctaagcgggcctgtctgtcactggtggcaggagagacctcactgtctctgatctctgacgaggggcttcccacttgggggggggtgatgatgtggctggggactggtccaggaggccactggcctagggggtgacttggcatgcaaccccacttctgtgggtgctgacgctgtggttttctattgcagatgtgtccgtgaccctcagagatcctttgccctgggaatccagtggattgtagttagaatactaggtactgtgcagtgtgaggaagccatggtcagttgcacagtgtgctcactgcacaagggcatgggcaagtgtctaaccaccaaggggatgtgcttcccagcaggaggctgttcccgcctgggaaggggtccattccctaactgtccactagaggggcccatcgtcatttatttgcccaaaggctttccctgggagatcatgggaaactcgcagccccaatgccgaatgcccaaagaaaggaacgtttaagccctctttgcaccccctgagaactccaacggccagtatcaccttcccagagcccatcattccaggcctcttggctgcctgccccctgcctagcccctacccaccaggagtgtgggtgctgagtgggcttctctccgcagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtaagcaggcccagggaggggacagagggtctgctctgagggtggctgggggctccgaacatgccgcgatcttccagcagcttggaccacagcctagtacatcacagatgttcctgcagccagtttgtagaaggcccttcccacattcctcatgagttggttgtggggagaggcaggtgggctgcagggcctcctcctggggttcactgtccaggcccccagcagctccagcaaagcccaggcccaggccctgctccctctcccacctcctgggactgcccctccacagtgtggtcttgcacgtacccgggatgcccgttaactaaaagctttgcagaaataagaagtggctgctcctgttagagcggcttgactagctggtccactccgggcctcagtctggggggctggcgggcaggttgcagcctctccgtgatcagtgcgccttggattccattggatctcttagtctggccctcatttttcaagctaacagaaactttctgttgtgacttttggcgtatgctacctgggaggaaacgcagtatttgtgtttggaatttgcccccattagacgataaagcacaaagccttctaaataaaatgcggtcccacggccagctgttcagaggatcttgacgctcttccttgggtgacggacccaggagagttcatcctgcaggaacccgtggcctcaggctttccaggagggaggttagagaaagggaaggagcccagctggttcacctcccctcggattagcagaaaagaggcgagtctgagcagggccttgtgtggctctggagagaagcagtgggttaaggagacatacacctcggtttccccctcatctgaggtttcactttccacagtttcagttaccagaggtccaccacagtctgaatgtattaaataggaaattccagaagcaaacagttcataacctttaaagcacgcgccgttctgcacagtctggtgagatcttgatctgtcctgcccaggactcggattctccctttgtccaactttggaagaaggcaaggtcagaacttattctgcagggagctttggggatattggatactaaggcccaagccctctgtgatacgcctttcgctttggcataaaataacggttgactctctgttaggcgcgtctctgctcagggagtggtggtgtttggggaagcccaaaggcacatgagcatcaggaaattgaccatttgacttcataagacataacctttgtccagcgtgtccaggctattcatgccaccacctgttgatcacttagcagccggtgtggttcccacatcccccatcaccatatcacagtgccatgttcaagccactcttatttacctaatcatggccccaaagcaccggagcactcacgccgccgttcagctctgccaatgggaagccggaggcgcctccttcagcgagaaggtgtagttccttggctgggcttagtactacccttagactcacgcgtccacaggggtctcagtgtctgcggatgagggggctgctgtactttcccagggagccgtccccagactctctctttgctgtgttggatgcatcccttagctgggagcagcaggctgagagccctccacacgcagccatcccctgggctcagcacagccagcgggagccgtatccagagggtcagagttggcctcagcagcgcatgcgtccatgttaattgtagcgggggagcacacggtgtctccttataaacaccctcgcattccactttgtcctgcaccgagtcaaaacagcctcactccctgaatgcaggctcagggccatcagccaggctgacactccaggaggcacagtgggtgtttctggtccacgcccagcgtggaaatcatagtggtgcacatgtactctgcgtgggcattgcggcagcatccgtgcttggacctcaccgcctttggggcccacgtgggattcctgccacatcgtcctcttgccctgcaaagtcggtgcagcccctcattgttgacaaagaaaccaagaccctgaaggttcagaactgcccatgatggtggcaccggggcttgaaccccggctgtggtggtgaccggcgactggctctgtgtgaggttcctgtggccgccacgacaaaggaccgcaagcggggtggcctgatgtagcagaaccagattcgcttgcaggtgggggcagggcgggctccttccgccgctctggctctctgcagctgcatgtggcctttccctctgtccctgcctcaagtcttcctctcctttctctcatgaggacaccagtcattggatttggggcccaccttagatccaggatggtctcatctcaaatccttaattacatctgcaaagaccctatttccaaaaaaggtcccattcactggtgtctggcactgttcaacccatgacaagcccctcagtcctgtgcctctgtttttagtcaaagggtgtgtttcattccctctttaacaatattggcgtctgctctacaaaccggttatatgggaaagataccctctcagagcaggatgggtttccgtggacctggtgagggtgctgcaggctggggcagggacaggactgggacaggcccaccagtatccaaaggctctggccgagctccccacgaggtccagcgggctcctctctccccaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctgcg

SEQ ID NO: 115 - DNA, 5973 bp, Homo sapiens
agctttggggttgtccctggacttgtcttggttccagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggtaaggaaatgttcgagggcccaggtggggcaagggggggctctggagtcctcgaagttggggatgagaaagacagcgggaccacaatcagggcgtgagacactgggtgcctgcatccccgaaaaacgtgccaggcgtccgggtcccggggctctgggcacgacgcctaaatcccgctttctcctgcgggggcccaccggtgccaacactgcggtgactcacggcctgtgaatcacgtagaaaccagaagcgcgaggttggcctctgggggaaggggaggctggcctcagcggccggactcggcgggccgaggcacctggctctctgcagttcagaagctgcgggctggtggagccacgaaccctgcatccagactgggagcccggttccctaccctgcccagccgctcggagacattccaatctccttcccggtgcccccctcggtaacccaatccccagggcaggctcattacccctcggcgcccagctctgcctgcgaggtgatctgctgccccagcgccccctgagccccactttcctccccctctgcactttccactctgctctccccaccccccatctgtgagacaagtattttcatacagcgagcagctccagagttctaaaatcgctagggataattatcactttcttggatttcaacaaatggtttcgtgtgaaaccccaatcccacatttccaaaaatctaggttcccacctacctcccccgaccatagatcggctgcagcccaattgggtgtgttggtcaaaggtggggaaaactaagtcaatccagactgcctttcccacttttccagcccaccttctgtgtgccctctgggccaactgggctagacatctggggcaggggagagtgccaggacctggtgactgggagaggactctgggggagagatggacgttagttaaggaccccagccactgggagcgtaagggcaggcctgctgccttcaattcctgcactcaacagagagacggtagttcggctgggttgggcgagaggggagggagggaaggcacccctctccctggactataggagtgagtctggatctaagacaggtctggaatgctgcagagagagcagggatctccatcagtccttgccgttagttcttcctgcgatctaaccacaatacttcttggagtcatatcagtctttcttgctctgtccttgctaaacttaaagacaaaaagaaattttctctttggaaagcctagatgccactccctcctcatcttctctggattctggcccctgtcctcagtggatgaggtggtggtctggtacacccccaggccccagctgaagagtaagattcaaggccccaatcctgctgtctgtcttcagtctgtttgtcctccctgcagggtctctctgagccacgtgccctcctcaggccctgcagggggcagattaaaaacagatccattagacaaacacagtcctgagccagctaaggccggctaagctgggccctcagctccacaggcaccaggggctcgctgaaaggatgtctcctctgaacccagccttgcctctgcaggaacttcggtcctggcacacccctcttagctctagtcaagggtccatctcaataagacttggggacctgtcatttcttcctagacacaagagttcagcagccaacaatgggggtcctgggctccccaggggcaaggcttcctctctccctctctcttctgtttgcagtagggtaggtatgctttggcactgaggggaaagaggatttgtttctctaggaacccaggtctggaggaggtccagggagttggccagatcaggggcagggaaatcctgctacctggcagagggccctttcacccccgcctagtgcatccctggctctactccaggacagggcggcagatcaggccaggtgaggtgggtgtgtggagcttagacctggagcccatccagagaggccccctgctctgcacgtcttcctttcagaggggtgctgtctcctatctcccccacttcggttaataactggggagcagagagaaggggtccaatctgggctgggatatggaggtgcacagagagtctgaatccacgaggctgaatgagatagccggaccctgtgaggggagtggggggtcctgaagaaggggatacatcacacagagcggggagggcagtctccttttctattccttcttctcacagcagagggggttcccttgaggggacaggggtatgggagtcttccagaagggcagatgagtacggtgcctaatgcagagagctttgagccccagctttttgctttcctttttttttttttttttttttttagtggtagggtctcactgtgttgcccaatctagtctcaaacttctgggcttaagcagtcctgctgcctcggcctcccaaagtgctgggattacaggcatgagccatggcacctgaccctttgccttccttttatcagtaaaaataataccaacaatcatagctattgtttcctgaaaacttaagcatatgcctggcactgtgtgtgctaagtcctaaacacataccatcccaattggctttttttttttttttttttttgagacagagttttgctcttgttgcccaggctggagtgcaatggcacaatcttggctcaccacaacctccgtctcctggattcaagtgattctcccgcctcagcctcccgagcagctgggagtagaggcatgtgccaccatgcctggctaattttttattttaagtggagatgaggtttctccacgttggtcaggctggtctcaaactcccaacctcagatgatccacccacctcggcctcctaaagtgctgggattacaggcatgggccactgcgccaggtcgtttttgtttgtttgtttgttttttgttttttttgagatggagtctcgccttgtcgcccaggctggaatgcagtggtgtgatcttggctcactgcaacctccgcctcccggattcaagtgattctcctaccccagcctcagcgtcccaagtagctgggattacaggtgcgcgccactatgcccagctaatttttgtatttttagtagagatggggtttcactatgctggtcaggctggtcttgaactcttgacctcgtgatccgcccgcctcggcctcccaaagtgctgggattacaggcgtgagccactgcgcccagacttttgttttgttttgtttttgagacagggtctctctctgtcacccaggctggagtgcagtggtatgatctcggttcattacaacctccgcctcccgggttcaagcaattcagcaattctcctgcctcagcctcctgagtagctgggattacaggtgtgagcaactgcgtccagccctggcttttttttttttttggtagagtcggggtttcagcatgttgcccaggctggtatcgaactcctgagctcaaacaatccacctgccttggccttgtaaagtgctgggattataggtgtgagccactatacccaaccttgattggcttttgaagaagctgttatttccattttacaattgaggaatctaaggctcagggtggttaagccatttgctcagggtcacccagcctgtaagggggctgagccaggaggaaatcacagcctcctggaccttactccagagcctctgtcttcccaggctgctgaccattctgtagagggaagcagctgcccctgctctctttcattgctgtggggcagaaattgggcaaatgaagacctatctagcactagatacggtgggtagatagggcaaaaagggaaatggctcctacttcccaggacatgagtgatggggtctggcctgtgcttggccaggggtacagtcccagtgactctgatgagctgtcaacagggtagacaaaaggccaaaagtgaagtaaacagagacaaccggagccagtagcaggatgtttgttgggtagggggctggggagaagctgcccctgggcattctgggactgaagagctgagacgtggggagcctgatccagacctgctgactcaacaaggtggggccacagctaggaacaggactcccaggggcaggccactgcctctctccctctcctccctaaaccccctcatctttcagggctgcaccgcctaccgtctccttcaaggcactttcttagacacccaggcaccaggcagatgcaccccccaacacacccaccccaagcaagtcacaaatcagcctgctccaactgtcttatggggagggtgtgagagaggtgcccaaaggcccctaaaaggtgagcctctcctctctccccacaggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaaggtgagtgccagaaggggctccagggtcatggcgtcattgccctgcctctcaacctgccattttccaggctagcagttaactcctagcttctctctgtcccagtagggaaaatccctaggtggtggtgggggctagaaaggggctctctcccttatccctctcactgcattgcccctgctatgggcccagctcacttggccacctgtctcttgcagagcctggtgaaatgggagagtgagaataaaatggtctgtgagcagaagctcctgaagggagagggccccaagacctcgtggaccagagaactgaccaacgatggggaactgatcctggtaagtcctgcctcctccccactaatagcaaacccagtgctaccttccaagattctctgggagaccccagggtgcaggagactcaagaacaaccatggctggactccgcaccctgctgatgggactgcttgaacagaactaaggtgtccctatcccatacagtgccctgtgtgaattagaaatggtgttccttttatgcaagcaaagggcatgtactgagggatcccagcagttcttcagggagatcttcctggcttgaggaggaggacgggccccaggggctctattgctatcctccctccattgatgcctgggcattctgggaccagctcctgcctgttggtcttgagccaagaagcaggtttggacctggaggccaagcagagtacctccattcaaccctcctctccaaagccacaggaccccaggggcctctcaggctaacaactacttctgtccttccagaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgctttaaaaaaa

SEQ ID NO: 116 - DNA, 71470 bp, Homo sapiens
ataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcaggtaggttttttttcctccccttttctctctttttatccctttttggtgtgctcgtcctccatcctccttttctaattttctcattttgagtggggatgtgagtctgaagtgagaaggggtgtccgtgggtaggaatttcaggtgggtttagctcctttatggcaagcttttctcaagagtggcttcttcgctttctcttacactcacactctctctccttgcttttctctcctttttccctcccccaaataatttcccctgtacctgttcattcaggtaaccaaaggtgtcctttgctatccagcccaggaaaagttttattgagaattatatggctggaataaaaactcatcaaggggagaggtcctgctctattttcgcatctagttccaattcattatattcagcaattaggacttggcaaatacctgttaataattacaaaacttggtcagttacagacctacaaattcgggggcaagtctttctcttagacatggcagttcatcctctcccaccgagaaggctgttttctaagcagaaagttgtctgtttttgtctgcttagcgagtttcatttctttatttcattctttgtgtgtgtatgtgtgtgaagtaacacctcacttctgtgattataaataaagaagtgaaagtcctcatggaacttgagtcgtttaccaaagtggaggggggggcactacagctgggaagaaaactgctgtcaggatatcagggttttaaattaggataacttttaaaattgtatttttagtggcaaagtaatatagacatggatttaatagaagacacatacacacatatatcccattccatactttggcactgaaaagtcgagagagagatagcaggagttcccaggaacagtgatgagcccggctaacatgaatgtgtttatctcccacctactgatatattttacatgctccccctgtaatgatgaaggcaagattactaactccagacttaggagtaacaggcaaagataaagtttacagcacaaatgccctgtctctctctctcacacacacacatgcccataaaactagcaacttactttattaaacatgtatttatatgcagtcgtgtgtctcaggatgaatatagacaggccagctgtttcatcccagacacttgtgtgaccatttctttatttcaggatttcccctaacaatttcaaatcaataggacaaggaaagaaatgataaaatatgtcaaacttaaaagtctcctactatgtatgcctaggtaaatttaaggtgctttctaaaatatccacttccccttctctctgcccccctcccttcacccctctcagcaaatgtgtggaaactgatactcactttccaggttttctgcaaagcttctagcacaggagacaataggtgtggggcgtggggactgagtgtgcccggcagagaaagggttaatggcccttgtgttacagtttgcatctgttacatcttttatagccccctgtttaaactaatcctcgaggcacagcatcttcccaacctccaccgagttttcaggattctcctcctctcctgcctgcctccgaggtcccccttctccaagttttgacagtttcaactgaaaaaatgcagcgcctctctcgatttttaggtacaaaagtttcgaagccagaaaggatacgatcatttagtagagcttaaaagtattgccgtagtggttggactttctctttcctttcttaagggaaaaaaaaaattctactggaactatttaagggaaccagtgtgggggagcatgtgtgtgagtgaggtggggggaaatacttaagtaaatattgtcaaagtggcgagggggggtggggtaaaggacagtgtccaaagaggcttataattatatttatcattgcggcgtaaaacgggaaatcttaatttgggggcgagggtggggggaggaagagacagtgcctcgataaactccaaaaggggaggggagggggcgctgggcgagtgggcttcctataattactattatcaatttgcccgagtgtgcttcatccaggggctgtttcgcgttgtttgtttgtttgtttcctctgggaattggggggtggggggatgagaaaagatgagaacgaaaagaaaacctcgcctcaccccaagttcccgagccgggggctgaggacttttcgaaggaaagggtccgcctagccctgagtcaagcggtcttactgtaccgccgtgtgcattccctcatacggtcaggagttatgactcattttgaagatgtaattcttgtctctctgatcccctcgcgggtgcaacacaccaaacagtaacaaacacaaagcgcctcggggccaaggctgggggtggggggcggggagggggccgccgaagtttcgctttggcgttggggggcgcggatgggtgctcgccggggccctggcccggctcccctgggcggcccgcgcgcgtttcaatgggcgcgggcgatgcccacattgtcgctgtgtttggttgctagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacggtaagaagcagcccgaaccaaacttttccgggccactacgcggctcgagacccagggagaaggagggggaaagggaaaaggaaccgaggcggcggcggcggcggcgcccagggctctagggcgagcctccctccgcggccggcgccggagcccggcgcgcgcggcggctggaccggggggtgttggggaagtgccgggcaaagtgagcgtcaggcacccgggggtccgagcgcgggggtccggccggggccccgcgcccccagccccgctgcccccctcgagcccctgcctccgccctccctccgcctccgcctcccgctccgctcgcgcccggcccgccgggtctccggccgggcttcgggagcgtccgcctggggcagggcgggggcccaggcgctggatcgcgcaggatcccggggcgggggcgggggtggcagagagactgcgaaggcaggagaggggaaccgggtctgcgcctcagcgaggcttaaagtttcttgccggagtcgcccggccgcttctcggtgcgccaagtaacggtccgcgggcagcggggcccggcccatcgcgcccagaccccggggtgggagggagtcggccggccccgcgcggggtccggtggggtcgatgatggctcggggacggatgactcctctccagcaggctctgcccccaggccggggactgaaggagtcgcagggcgcagcgagacttttcccggcagtttctacatggtctggaggagcccgttatccaggctgagtcaggaaggaggaaggagaaaggagatgggggttcgaggggcacacgcagatcagaggtgggatattaaaggggggggtgagagtttggtaggtccgttttggagacagccagagaagggacgcggggggacagagagaaacagagagagaggaagagagtgagagagagaccccctaggtattaccccaaacaaaatcgtgggaataaaagagaaaagtgattggcaagagcgcggaaggcgcctgggggaggggagagggctggggactagcgagggtgccgggggggggtgggggagctgacggaggataactgagtttaaaaagaaagaaaccaacccccgaaaacaaacaagcgaacgagcgccagcccagactcggaaaggaaacttctcgctcccctcgctctcagcccgatcacccggcgcggggccgcgtagacgctcccgaggcaggcgctgggacgcagcgcccacccggcctcccggcctccgcagccccagcccgcgcctcgcggggaccgcccgggcccacttggagcaactttcctctagagaagacaattgtgcgcgcccccggcctgccccagagctgcgcggcgcggggagggggcggctgggggcgcagtgtgaggtgctggaaggagcaaaacacaaagacgagagaattttgattagagacaaatgatgcttttctctctctctctctctctctctaggttttgtgtgtgtgtacgcgtgtgtgtgcgtgtgtgtgtcttttgcttgttgtggtggaggtgtcgagccatatgggggagtgatagaggaattttagtcagaaactgttcgttacgttatcctgcctttcccctttgtgctgtctttgatctatttgcttggcttagtattacagaaaaacaagtacaataatatattccgagctgcttccccaagattcagttcaggctgcttctttttaagtctctccctctctctttctccctctctctctctcttaatttaatttttttttcactctggtgtctggcattatttaaggtggtccttacacaggagacctccccttccccatctctgagtaatttagtagacactaaaattacacctaatgtccccctctcctctcttgtgtttcctctgttccttttattaaatgttggttattgattttctaaaatcaatgtctgttgtggggcttttttccccctcttacaagtatctaaagcacgttgctgatcaactggataacaaaagctttgtgtcaaggaggcttttttccctcttctgttaaacagtcattttttttttttgagagaaaaagagaatgagatttaaaacaaggctcccagaagtgttcttttgcagggaagactatttaaagtgtgcatttcttcttgccttcctccttccacctccttcgggattttgccaccgttgaccagcctggccctagcagtgaggtcaggccagagcccaggtctaaggaaatagagggatcctggcttcctgggaacccctaggagacctggcagagagggaggcccgttgggcgcttcgcaggtggaatggagtgccagagatgtccgcagtcatggacactgcaagtatttcccctccacccagccactaacttgggagaagcctccacattcagaagtggaaagttgaattgcacattttaaggcatttagcccagatcctgcacacttaatatcaagcctgtccattgcttacagcttctctaactttgactgttacctgtctttttttccaaataagctgtgggaaaacatgctgtatactggttattgtaagtgtttttcactgggtttaatctgaccgagcaatgttctggttttgagaagcaggtagaagagtactaccaccccacccctttttcattttctttctcatcaaacacatatccaatgcctttccctttgggaattgctaggatttatctgaactgagtggatttttcttctttcctggattcatggaaaagatgtcacttttgagcttgtgtctttgctgataacactaaatatgatgatgcttatcaaaatcatatagaaattcctggaaagaaataatggcaataataatcgtataagtagaagctggaagggaaaaaaagatggtcatccaggaacctagaatggcactttatataattttaatgaagtcaacagtgtatatatagactaaggcgacaaggagataaaacgtgtaaagcagtgtgtgtgttttaaaggctggtcaagaacgtgagttagaagacaatgctatgtacatttaataaaaagcaaaggagaaggaggcagttgaagaaaaataaatgtacaaagagagaaacaagtatctgaaatacaaccttccagattctcaggctagcaagatgcctggcagaggcagtgccagggccaagttaacccatagcgggcagtcagtctcctttcccccacatggaaaggatgaaatctcttcccagaaaataagatgtgcaggaggaaagagggagtggggtgagggggaaggaggcaaaaagcgagttgcccgcagacaagaatgtgtgtcggtttcaagaaagttcagtcagatgatcctcagtcgcctgactcactttgtaacactttcactgacgctggagaggagggggaaaacccagcccccctttttctttcccctgattataccccactatctccacacagccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccgtttcagagatgcttaaatgaaaaggaaagaaaatgcagtcaaccccttctccaggaggtgcctcctagctctcctccctgagaggtgaagttgggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagagccagtaggctgctggtgtccatagagtgacagtccaccaggactaagggtgggctgaggattttaaactttacattgtttctctgttaccagatacaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgtctaccctgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcattttaaggtgttctgtagtgtttttatgctgtgtatgtgcatgtgtgtgttttgtcttgtgtttcctctgaggaggtaagaagaaaagccatccatgcgtgtatcttttggcttttctcttctttccgttctctcctacatattatgcatatatgtagcccacatgaatacacctgtttaaaagaaaatcacagttcagatggtgccttgctggttcatttaggaaacaacagttattagaagttggtctgatttcgcgtgtggtccatgaagacagaaaataccaactcttgtgtcatctggtgggaggcaaatgggggaaaaacttttataattttgtagtaaattagagaggggaaaaaaactgccagtctgtgaaaagatttttgcctctccgggaagacacacacacacccagtagctgcaccgttagctgaacccctgacacggcggtcttttgaatgccttaggtatgatttcactttcgctcacatcaatgctgacctgaatgcctttcatatctgatccgctgtgtctctcccagtaaacatcccctgaggggagaacaaagaaaggagctcttcttcttcttaatcacaattcagccctttcaccgccggcaggctccatttgcattctgccacagaaagccaagatgaaaagaaagagagagagaaagagagagagagagagagagagagagagaggcacagggtagtagctgagtaaaataacttaggtgtttgtggctgtttgttgggcttcccctagttaccagccttatatagctgatgctccaccaggccctgtccctcctgacaggcatatagtgttacaagatggcatgtctgtactattcatggccacccgctcaacacttgaggtaaaaagtgtcaggaggggatcgaattctcccccagaagcctgttagatttggggtcaggtgtgtggacttcccgcccttaagtgctgcctacgatttggctttaataagtctgattgtttaccagcggaccagagaggtgagggccctgggggtgggagggacgggcgagctggagactgggcccctggtctggtttcagtgacgggtcctcacacccagcctgaacacactgataaatcctcaggaaaactggaaaagactttcccatttttccccctgactttttatgataattcatattttcaaatgaaaggggaaaaaagccaagaagaaactctcaaatgagccaaaaaggaaaaaaaaaattctctgaaaagaattttagggggaaaagttgtgctattttaaaaagctttgagggctgtaaagtgccacgtttttcacaccttctccatacttttttttcagatttttttagtatgtttaacatttgtgagatgacagcctttttgtatctcaaactggatgcttcaggatttgtaggggaggggttggtggtattcacgttctcttgtgagagaaagtttgtgcctaaaggcctccttcctgggaactgtttaaaccctcgcaggcagacctgtcaggttttactgtgttatttgccaccattttcaacatgcaaaagtaacatgcagttaatggtattggaatgagaccacagcaagagcagaaacctctcgtgacaacttttcagcgacattatcttgctcctagactgtcttgtctttttcttcccctttctgaaaccacttttgagataccaataattttctcccaacaattagattaaggatacaatgcgctcacacacatgcaccacacacacacacattcacacacacaaacacacacacaaactttggaagtgcaatctcttccaacagcagagtgaatgatttgaaacgggggcttttccaataacccttgtggaagatttcacttataagagcaaaactaacggatatattagaagttgtgcgaacatgtgacacagattcctgatttttttttctttttcccagaagatttacagaatttacaaaaagagattatccctacaccttccacccctcctatccacccccatgacccaagcaatgaaggatttaggcagatttacttcagtaaacacctttggacacttgcggggaaagtgggagtctgtttgcaaaaggaggcttttgttaagtgaggtacggggataatgctttaccaggcagctgtgatattaacctacccagcaatgcgggaacactctttaactctttgagtgcctggccccttgcgctcagcagataaaatcctggctctccaaagacactcagaattctggctctagcagtttattattcagacaagtcttataggcatgaaaactgttcaagcttttaaaacaatgtggtttaattagatgaggtggacttacattgctcataagccctccaaatggtggtttataattggcaagggaaaaaaaaaagatagaaaaaaggaatcaaggcagcacattaaaaattccaggaaatatctttagaaaagctattttcatttctagcttttaaaatattagactacggtagctagagggaatgaagcagctggggcctctctccttcctataaaagacaccagaagtttgtgatgaagaaaggggcttcaacttgaaaagctatgagaggccagttcggacagtgatatgatctcagccttcgcatcttttcaagggggaagtactgcctatctgtccaaacctgggaggtcatgtgaacctcagagtcagggcctcaggctggccgttaccaacttgagactttccaaagcaagcagagaggcatttatgaggaaggagttaatggttattttttgctgggcacaagaataactttacaggtgttgcatttgggcttaaataagattgccttatttagtttcgaaaaagagtgtaggtgtcaacattcgagcagccacaaatgtgtgagaaagtaaagggtatgagacatgacggaattaaaggtgtttgctatgttgttacaccgtgtgtcaggctgcaagctccctttgtcacagcctcctggtgatttgacagcgcagatctacttcccttctaggtgagacagcatttttaaacttgagttataaatatggtacacccttcgagttgcaccctgcctcccagatccgtgaatcctatttgaaagcatcttgccctgagacacaatgaacaaacgcccgtatacaaggaggctgtgggctcgggggcccgggcagcgccagcatcacagtagctggcattgactgttgtttggcaagaaggtcctctgccaaatcatccaataattaagttttatgttatttgtatgaacgaccaagcatgcagtattccttttcaaatcaaagggaggcttaaaattactttttgaacactttcagaccatggtcaggtcacagtttgggggctgaattaaaatgatctcattcatgatctaattgaggttggcaaaaccttagcagtagcaggagtacataaatataaatcaaagaccaaaatttagcaaatcatatcatttgctagaaatctgctcatgaattattctccgattgccaacccagaagttaaactttgtctcccctcagcaacagtaactgcgcatattttttcaggcttctgacaggaaagttagaggatctgaaaagagaaaggagaaggaagatgatcactgtgtcatcagatatggtacatttgtgacccaagaaactatgagagctgataaagccatgtacgtttacagtggctgctgcagccttggttagaaattaatatgggtttctaaaaaccagactttggaagagcaggcagcacagacacattaagagtgtaaggggagcaaacgtttcaagaagggtctgattgtactttgctttcattttttcaattgaggaatgtaatcatcataatgattcatgattatttacaaatttagttctatcactgagctgggtccagggattgagatttgaagtagtggttagaactagaagacgatacggagctgttagtgtgcatattcaggttacctttcattctttctttctttttaacgctgctataaaattaagactccaaataacttttcctataatctgtgggattaaatgtcatactctattgtatctaatccatttttaagttgtaaatttttcttgtttgctgtgtatgatttcatcttaaacccacacaacactttactataaactagaagaggtctaattctacagttgaatcttttgaagttaaaattttaaatcctgtgtaaaagaagatgttcttttaatcaaacagtaaacacagaactggtcagttggccacctttatatatcacaaatatatgaaggtatacttttaaatcttcaggataaactaaggtgggaacatttaaaaataatctcaggtgagagaggtagatgaccacattcctgggaataggtaactgtcattaatgatttcctaaaatgtattctacattaaaaaaactgtaatggatttctctttaatagttacgttgcccatagacaacatagtgatttttgttctttatatactgtttcttatttttttataataactcaaggaaaggtactcctgacaagatgatagccaccccctcctcccaaatatgaaataatcagtaatagatgaacagattaaaatattgtgctatataaaatctgaggtttttttctttctctcaaatggatgagtaaatttcaaggaattcagtgcccaagtgatctataaatgtaatatattgctttcaatgtttcttagtttaagaaagtatttattgtcttgtatatccaagtaactgtaatcaaggaaattgcaattgcctattcttggaagtacctaagtttctattttagacaccatgcacatcaatggaagtgtttcacatcatgagaattctcagttttaagaggtgaggtttatatataaggaactcagtaagctgtgttttcataataaatagacccattaagagggaaatatctctgagcaaaatggttgtcctctaaagatttcccatcacctttgctctgctgatgggaatttgaaaactaaatacagcccatgtgcacacattcccacatgcacacaaacacaaatgcaccctaggatccaaactctgagaattttcctctttaactttcactacagtcatctagcttgtgaatgaaatacacttaaacaaaaatagtagaggcgaagaattaatgtagattcttgtttagtaggatttattgtaggggggaaatgtgttccctatgccacatgattcttacgaaacttacacctattaatctaagctttaagtgtattatttaggataaattactagctttctgcttttgtactgttttctcccattttccttcagtattaccaatcttaacacagattatcctaaactgattgcaaattattatggtttttaaaacagcattctggagtcctgaataaagatggtattttaaactagtgtttacaatatacagaataaaaaagggtgggggagatttaaaaccataccgaacacttagaaatgtgtggagttttatacttgtgcagataagtgtgaggtagccttgccctgtgaaaccaagaccacaaatgatacgtgtcagtaggttctttgatagggcttctggccacagtgtttttgtgctgtcaaactgctatgttgaacaaacacctcctctgggacagagtgataaatgcagagacaggctggcttcaaccagtctcagcaacctcctcaaccacaccccccactcccagcccacctcctacctcctacaatccagccacctcccactccactttgcccctttacctgaaattgacatttatatagaggtgcccaggattttttaaggtgtcagtggtgagtaattgttgatactccccaaatcttatgaatcagtactctgaaactgcaggcaaagtcctttttctggcaggctttatctagtctttttaaatggaactggactgagcttctaaacttttgccaacttgaactttttccacctttgcttaatcacttgaaaaccacttgctttccttgtctttcccccagtcgctttttattttctaatgttcaagctattacattgtgcaacacagacaaaattttgccttaaaaaatccaaacactattacctcttacttttcactttctagcattcttttagggctaacatttcaaatgtatagtcaactggtctttttttttttttcttctctctcttggagccattattctctgactaaaacctgtttactggtgcctttgtgtgtgcgttttttccccctgacattaaatgaatttccatcttctacttctgcaatctctaagaaatagataaaccattatattttttccctgctcgtattttaaagtggtgatcctgacagcaggacgattattgcactttatgttttagtggatgtttgctgttgctagttacagcaacacttatcataagacagcaagaaaagagtagtccctggtaattaaagtaatgaaatattcatttactctaccttttctgtagtctcacaaattaggctgctacatttaatgcctgcactgcctctgtttttattataatggcagctttcgcatctgcaattaggactaattctgacagttacaatttctgagggatggtaaacagtgaacgagatgtgcagcagaggtattacacgtgaaaagcccttgtctctttaaccttgttgttttttttctcgcagaggttaccttttcccgatggtgcaaaatcgacttgacataactgttcatcagtttcagggttttccctggaggtatttgcatcaaatcagcccagtcaagcttcaagttgaaattggcaggccagaaactcacagggtagagactggaaaagagacagccaaagtacaggcagcaaactgacagcagcagagtgaaagacagaggggtggggggaggttgagagcgagagcttttcaactttagtgtgcgggaaatctcagctcctcctgtactgatctcagcagcaccatatcctgaaggagcttgaaaggttgagattcagaacaccttcagctaattcttaccactagggctcaccagccttgctccgggggtttgctctcacttaatctgattggatgcctaaagaggagtgggcacacttaattaaacggaaggaaagttctgaggcacctccccagcacttattaaagcttgaaagccaaatctcatgatcagtgttataggaggaaattaaggtggtttgttttttttgttgtttttttttttttttctaattgttaacttgtaggaaagtgaacaatccctctctttaccaggtttgttttcttgggggttctcttctgagtagattaaatgttcacagagactagagctcaggggactgtccattcaaaagctaatgcattttggctaacaaaaagccagtacaagtagcaaaaattatatttgaagagatactcctttgaatgacatgggtttgcaagttctctgtcaaataatgccctactatcctggtaatatgagaacacgtattaagttgtttaaaaggtcaaaaaacatggcaaaaccttaagatgtctaagatactcaacttttactctcaacaaggtcactttaagaaaaattctatgattgcaaaacttgtataattgcttttacaaagaaaacaaatatgaaaagtgtttcctttgcctgagaacattttttctccttgatgtcttaaaaaaaaaaattgtcatccttccccgtctcttctaactttggagtgggagggggctggtgtttttactagatgatttaaaatcctccttactttccaactagacttgggggtcgaataagcccttgctttcaaaccgttttctagctctgtgtatgacaggcattggctgatctgctgatgcccattcgacaggcactgttgaactaaagtggtgtgacggcacagttttgttaagctgtgaacaaagggctgaagatgccttgctggcatcatccatgtgcatattggccttgtcacagttttgcttgatttaatgctctgtttattcctagatattaaaacttaaattctgaacaatatgttttcaaatactacataccaactttattttaaaagctttaactttgaggaccctagggtccatttgctcatccagtttctgtgtagccaacattaaaacacagctttggaaataaatagattgccagtagcctcttagctgttatccatttaaaaatgggattccagtctttaaaagtcttattaggataaaagatttatttttctttgatcattggttgaaagtcattatttatttccaacactggattgtcacataaattcctaaggaagagttaccttgtgtgtactcagtgcagtcagagtagactttttaaaatgacaaattattaaagagatattcagtaataaaagaaagcctataagaatacctataagggtaggcacatcaccactgagagaaaaaaaaaaatcaagggagtttatgttaaagtgagccctatttaagagatagcagaagaattaagattgagacttaaaaacaaaataattgttatgaaaatccctgttccagaggcaacagctcgcctatctaaagaaatcttaagtttggtactaaatttagattccagcgtcccgttgaatgtgtcttgagctttatctacgctgggtttttgttccccctctgcctctctttccactcttcaggttttcttcaagtgtttgctaagagattagttagcaagtttatattgaggaggtagccatgggaggcagctctctgcttgaaggaacgcgcagtgggtcagagtgagaagatacagggagctaagactgactaaggcctgggatcaggtactttattttctctcaaagacaaaccgcccatagaaaggttggtgggatggcatctgccagcaggagcacagatgttaccacttttagaaacttccaaacaagcattattgctggaataactttatgaaaaaaaaaatctgctgccagaatactcctttttcattatgtaaagaggctataatttgagatattcaaggttatttttacctccattcataaaacagcatctttcttgagagctgttacgagttaggtgaggaaggtggcaaaggagagaaaaatactcagcagcctaaaagtattgctgctgctaataaccggtgagactgcactaagaatctgaaatggaatctccggggtaaaacacatccacatttctacctgccctaagcgtgctttcttagcagtgactgagatgaattgtccatttcttttcagtggtagtttttctccatgttcacttatgccaaataattcccacagccagaaagagtgatacaggtcggggtggctaggaaagaataagcctttattgctagtttttgtataacatcaggcatgagaaagacacttgctaacagcatagattgcaagacactctgtggcctgttctcttagtttcatgagaaaattttgtccaatcccataggtgtgaacaagatttagacatgtaatctccaacctggaaaagaagagagcttttaatatattaatagggcagattcttacttaatatataaagtgaattttggcatcagtttggggtttcctattaatactttgttagcaactgtttatggaagagacaaacagcagttcatccaaatagtcctccttccccaacccccaacccctatcttggtattaactgctttgtcctgtcagcttataacattctatctttaaattactctaaatgaagtcataattctagttatgttttgtaacaagtccatggctaggaccaacatgacttctcaccttttaatgaactgttctactttaggatcttctaaggaatagagtgtaaaaagaagcaaagcaggagatgaagaggtctcgtaaatagtttcctttgaacatccacaattgcttacatggccttttccccttttttccaggctggcagaaatggcctagcccaggactcattcaagtgagcacatttcagaatgactcattggatgattggagggagacacaagccctacgataccaatgcagtgtattaatggagaaagttcctgagattgggagtgggtgtgacattaggctagggtattcctgaagggctctaattcatgtgagaatattaagtgtagatcttctagctatcagttagcgtaaggtttcataaacaggtaatgatggctctttccccccgctacccccccatccaatttctagctgagtgaggaacaggctctgcttcatataaatacgatctttgaatttatctgcaatgaggtacagctttaatgatctgtatctgcaagccaggagcatgaatgtgatcttattgtatcatagtgtagagatgagataggctagcgctacagcacaccagtgcattgtgcctgggtgtcgggagcaatccttccatttccaaagcagcaactctttatttttcatcattgtttctttacctcacttgtatgctccttgtgatacagatctgagtgagttgtgcaagcttcagacttgccagcccccagctcccaggcctagtacagagtaattcataaacttaccatattagactatcagattgaaaccaagggtttctactgtggtggaattggaaagcccattgttttgattatcatttcatcagccccaactgatactagtatgctcaaggaaaacatacttcagttacagttgattttcagattccaaaatggtgctgcaaagcctgtgcatctctaattatattttatgctaggctgtgcaataccaaaatatacgccgcagcaatcagtgagtgaacagtatcaatcaatttgtaaacagatgaagtcactcattcccaaactggttttccaaaaacaattactaaattacaatagaaaaaaattgtacagttactgtatttgtgtgctgtgttacaatcaacataccagggaaacaaaacaatttaatgcagaaaaatcatcattcatctacattataattgcttctttttcacatctacagggcggttaattaaaattgtgattaaatgcggtcgcgctgcctaagatgtcttgcccaaaacaggtggtacagaatttaaaagtaaaaaaaatgtaattagcattggaaattgagaaattgcctgtaagaatcagtgttaatttcagtcagtgatgaggtaatttataaatgaatgcagtggaggctgtgcaaatgcacaattgccttccttgccattcttagcattctcagcatgcaggtgaaaatgttttcaaaatattgaggtaatttgaaaatcaatccatgcattctgtatcttttttctcccatttgtaccaaatgctgaacaaatgctgccatagatggcacaatccatcagttttttactttctaaaagtaatgctgcacatattttagacctagattaagaaatataacaacacaaattgcaagcctaaaattgttacacgggtcaaaattgtacacctgaacttctgactaatggagatttggttggctgtgaaatgctcccatcaataaaatagagacatggggggaaatctgtccatggtgtaggtggtacaaacagaatgactattaaccaatccaataaatacttgagattaaatttttaaagtttaagaaagaaacagaaaatttataataaggctgatatttttcttagaatcttgaaccgtaactttgttattccatctagaaacatctaaaaccagttaataaagttatcactagaaaaagcgtttacagaaattaactgtttttcaatgtcatctttcctttcaacaaagatgcaactttctacaaaacattatgctatcaacttactatatttcaagcgttctattggcaaatgagtggattctatagattagatactggttaaaaattatttctatttacgctgtatttttactattaaaccgctagacttttaaaatcttttaatggaagaaatttaactttcatgtgcttattctgaccctctgaacaatatgaatttaaaatattttaataatgaattgagaatatggggtttgagtatctggcttgataccactggagttaagagactttgtggggctttttaagcatcctcttctgtgtttggcattctgcaaaatgatctctccatataaagctcatcctaagaatatgcttatttaattgtggcagatcaatctgatgatcaaattctctcatgtaaaatattctacgtgttttttgctgtttcaggcagaaatcaataatttcacttcactctgaagttatgttttgtggtaatacggacattttcgggagaaaggtgaaaaataagaaatactgtatctctgggagtgtcatctttattcattcattcattcatttttagagacagggtctcactctgtggttcagactagagtgcagtggcaccatcctagctcacagcagctgagattcctgggctcaagggatctctgggagtatctttctatcctctgatttcaggcctagtttcgggccttccctcatgacccttcctgatcatttttaggacacaaatgaaaagtgcaatttagaggtgacagctcagctggttgttccaagtggcatgccatcgtttctctcatatttaaatctgtttcccatttaatattacaagtagaaataaaatgagacctctaaatggaggaaactgaaaggtcaccagttaactccatgatccctctcctttcaccagctcttgcctcccactaactgtgatgatgacgatttcatattccagcagtcagttcactttcagcgagggtgggtgcagacttcatcaaagaatggcttcctggatttccttcaggacctgtgaacataagatccgcaaccacatggggcttggctcaaatttcagcagagtggtgggatggaggaggtattatgacgtgctccaggctgcactggttctgagtttacaaggggtcacaagggttagagaatcacagatgtcaatagagcgcgaggaccttcctaccccttgaaatatttgcagtagaaatcttacctctttacgtttggttcgtagtgccctatgagcttagcagggcaatgtggagttacttgtgagatgccaccaatgtttcatatatatatatagtatattatataatatataatattaatatatattatataatatataatattaatatatattatataatatataatattaatatatattatataatatataatattaatatatattatataatatataatattaatatattatataatatataatattaatatattatataatatataatattaatatatattatataatatataatattaatatatattatataatatataatatatatgttgagaatgacatatatatatatgttgagaatgacatatatatatatatgttgagaatgacatatatatatatatgttgagaatgacagtgtctttttatacaagctccctccaccaagtatcatctctgtactcttacagggtcatcaagattgtcagaaaaggcctggactacatgcctgtcccagcactagattggtattttttaagtccttttttgtttcaaagtttgccatgtgagcttaactcagttcattctgctattattacaagcatcacctctttgaagctgttatcagattcatgaaagaaaaatgcgcattttctttttctactgagggcttctttcacctttattcctgagagtgatcagagctttgaattgtaaaaaaagaaaaattttctcattgtacaataattgaaaagtatgtcatcaggtcctttctaggtcttcctgtggtatgtcagcagaaaactacagtgtttgttcattttgcattaattacacacctactatgtgcaggctctggctgaggtctgtggatcaaaaaatggatgctagagcctgggcccctgaggagcttgctgtctagtgggaaatgggggtgcatttaagatatgatgaaaatgtggcaagtgccacaaagaactttctacccaatacagagagagtacagaggatggcacaactagatctgggagaaggtggtgaggggtcacttcatggcagaggtgacttttgaggagactgttgtcatataacatggatttcaccagcaagtgagggcacagcacgctgggctgagaggatggcatgtacaagccaggagaaagggtgaacagcgcaggcattgtcagccaactgagatgtctgaaacacagggcatgagcaaagaggatgggcttgatttgagtctgcaaaggtggtcagggagcagaagaatgtcctatcccatatttttggcttgtatccagtaaataggtgatggtgagcttgcgaaccatgttttatagaagagtgacataattatatttgcgtttcagtgacacgtctctggcaactgtacgaaagatattatcatctaacatttgttgagtacttaacaatgtgctgggacccgtgctaagaattttgcctatgtcatctgatctcgccccaacaataatgctgtgaaatgggtactattattttcatactatttttactgatgaggaaattaaggtttagaaagggcatgagcctggagtcaggaagaaagtctacggttacatgttactgtaatcatggaatttctagaattacaagcaacacaggcaataatgatcattgactagaaggacatttggaaaagaaaacccagcgtttgaaaaagagtgaggcagtttgattctgtttctctgagtgaatagtgagactaagtggggtgtaaggatgtttcatcctcaaaatttattttttctttcattactatgtcagtttgaaaaagaaaataaaaaatggttgttgatcctgaagaaactaatcctagaatgtgctacatctttgagagtttggaaagagacagttaacatacaacccttcaaaacagtggaatttggtaaaccctggaacactgttcttgctgatctaattcatgacattaaggccttcctcggccttatgaggaagcagatgaaaataatccttttgcgatgactattttcccccttttctgatttaactcttccattgcctaagactcaccaattctcaaacttctaaattctccacactgccttatctctgccatcccatggcaagtcctaaagctgctaacattttgtaacaactatgtgacaaattgttgtgcttttattcaggtcggacatctttgccaggcttgcttgttgtgttttctgtttggctgtgtcatgggaccaaaggtgcctgcctttgtacagcatgtcaaatctggttaacatgcagccatttatctttaaaaccactcctgcacaatggcagaggtgggccaagccacagggctctaagcacaacccaatttttcagaccatcttttctgcatatagggagcacgttggacagcagacaagacattttgtgatttggggaatctcttagagacaaattgtagagtgcaagtgcagtgtaactggactgctgggtgcccagtgaagtgaggaaaatcagatacagcacaggctgaaagaatgaagcaagaattcatatctctgtgcagaacatgcacagtactttgctcacacagagagttcacacatagacaaaagcatgtttgcttgtgggttattttcaggggattctatagccacagtctaggcgtatatatttgcacgtaagctttctttctgcattttgtactggtaggtgtgtctacatgtgaacatgtaaacatgcttatatgagaagacaatttgctgttgctgatttaagacacgggaaaggcctcctagttcactgaggcgtttccctcctaatgtagtagaagcagaatctttttgttttctacaattgttttaataaaggactctgtgtgtgtttaaggaagactcagagccagagtgtcaagtgctgcagtgaaaaatactgaagatttttctttccataagacagctgcaaactttataacccagttcactctgggttttcatttctcaattgtttcaaggtgtcttgggaatgatttgcccttaaataactagttatcaacaaaggagaaaaaatagcaataaaaaatgtgataaacctgcatagactagtttaactaaaatgaagaatttccttgcttggagcagttcaaggaccgaacatagcaaaactgtgtgatttaaatgaaatattcagagtggtcaacataaatacacatgtagacaagagatagtatatgtgtgtgtgtatacactgaggttacttcttgaagaaataggcattttttcctttctttttgctttttctttcttttctttttctgagtaaaggaccccagagattgtctttcactttgaaaacaatctctaatatcaggaaaatgcgctgtttgtttatgcgtacataatgcaagtttgtccgcctgggaactgcagcaaatgggagaagtatgcatggatttcacaggtaacaggattacgtgggcacataattgatccatttggagaaaaaaaatgacagtgctctaaagatgcctaggctttggagatggagtttatgaaacaggcatttgtaaattcaaaggaatcaatatgtcaattttattacatctcagaaccagctgggcattaaaggaacagtagccttaaaaaaaattacagctgcatattcctacgttgtctacctttcttaaaggccctagaatttaaggaaatgaacttagagatgtgtaccttttcagaaatgaatttacattgtccaaagagaacaacaatttaacattatgtcagttatcaacctaaaaatttgattgaaatgtctgccttatcattacaattgaagtctattaatagatacagataataagcagaatagtgattttcacataggttgcactgtcaaggattcattggaattcatatttgcattgtgcttttcaacagtctagattttacctcttcactgatgataggacatagtttaagagctagcctttgggtgtcccacagaattgggtctgtgcatgtgtgaaatattcctgttttattagagtttttgacaatctatttttttttttttttttttttttttgagacggagtctcgctctgtcgcccaggctggagtggagtggcgcgatctcggctcactgcaagctccgcctcccgggttcaggccattctcctgcctcagcctcccgagtagctgggactacaggtgcctgcaaccacgcccggctaattttttgtatttttagtagagacagggtttcactgtgttagccaggacggtctcgatctcctgacctcgtgatccgcccgcctcggcctcccaaagtgctgggattacaggcgtgagccactgcgcctggccgtttttgacaatctaaaaagaccaagctattttaaattattaagttcctaaataataggatttggacagcagccataagagaggtgaatgggatgggaatttaagatactattttaatatcacaaagaggttacacaactaaggatgaaagttagaagctatgaattggtccacatactctgcatgtgctgtctgctagaggctgcaaggcgagctgcttcactgtttcatgttccaatctccaccacccagactcctgctccaataacatctctagatctattcacttgtaacaaatggagcccagttctcctccctccccaaggaggccagacactcgatataatgaaaagaacacaggattcagacccaaacaaatttgtgtccacattctgattctgccatttactctccatgccatgtgcccctgggtgcgtttcttaaccactctgaacttcggttcttaatgcttaaaaatggggagcagtatttgttttatagaatctttgggagtattacacaaaattctaaagacagtgtctggagcctagaaaacgctcactaaattctgattatgactgtttcaaggtgtgactaatcaggatgccaggaaccctacgatggaggcacttcagtttctgggccttgctgaaacattcttgaaaagaggaaacaataaccgtagcctgagatattcgttccttttttttttactctttggagagtacttaaaaaaagaagaaaaaagaaatagtcatagtgattggcatgctattctacctctacatttccaggaaatatacatggtactttttcttatagaaacagcatctcctccaaaaagaatacattctgagatgacttttgtcacagcacttaaaatatctgattcctatttgtctccccacaaatgtgtaaatggcttgagggcagtcttgcccatctcagctcaggccatgacatacaaaaattgtttcgttaaagcaaaggtataatgaatacagcgggtatattaaagattcagtatacattatcatatgtagaaaaaagctttgggtaactttatgtcagattccctaccaccatattaataactttttgaaattcactttgtgacagctatgttattttgaatacttgagtgggtttgctttttgtttttgtttttgtttttagtttgtatttaaatcaactggctctctgcctttctcaatgacacctttgagacttgggagtcagggaggcagagaggcagtgtgggtgctcggaagagtgtaggctttggacatctgggctcaaatttggtttctactttcatacaagccataagacctgtagcaagttgttcagtctaactgcatctctgcttctcataataatactcatgttatagggcagttgggaagaaatactggtaacaggtaaagtgccaagcacatagtaggtgattaatgttctgtccccttcctccactcttctttgtcacttgagcattcactttgggttggcatttagtgagctccttctgcccgtcaacaagtcaatcaacatttaatacataccatgggtagatatcttacccctgttccaaatttcattatgaaaattgggctattttctactcaaggaaatgagcatgcagaagtaccttctgtacttagaatcacaatcattttagctattttccgcttaatctgacggtttctttgttcccatcatcttttttagtgaagcactttggtgtttctgcaatcctttgctatcattctgtgcttgggtatctcagatctctcttctcccccgatcctttgaagacatcagaaaagaagaagcacaaggtctcttgactatacgtttgccacacaactgtgtggattggttagttaatagagttgattaaaacactttgtttgattctgcttaagcataccagaaatacattcaaaatctacagctacaaaatgtaaagaaggtagtccaaatatagtactacataatgaggctccctgttggtagtatataaagcagtttagagtatagcttcaaattctaatgaagatcattttaaatcttgcactgaattgtgaatttaaaattcccatgttctccataagtatctgaagaggggcatgtaaataccataagtgaattaattactgccttaagttggtaaagcatgtgtgaatccaaactttattcttgaacttgcacttctcttcccaaggttttttgaaccatttcctatatgctgagttctgagtacctatttaactactgaggacatatgaagaaggtagttttctttgcatggattaaatgtttcaatctctgaaaatcaccaccaccacaacaaaaagtctgcccggcaccatctacatgtacatgatgaaattcctaaagcagaaaagatatatttataatctgaaacttataaaaacatgacaaactgttaccttcacttttgtgcccccttttttcattaacagtattaggtcgtttttttttttttttttctcttgagaagaaacgaaagacgaagtggcaagaatatctttcacttttgctcacgttttggtggtgtaatattgggaccactgaagtaattggacaacttttccgagctgactcttctgaagtaaacccaaggcaaagggaaaatggagctgctgctaggctcaactgatggcgcccacatggcgcccaccccagctccttcagagactccatcatttccacagaagggccagaggccctgccaatatccgcacatcactggcatgatagaccataacagcttcttctgagctgttccggtctatcgtgtcaatgcgtactcggggagtcctcaacgcacggatcactgacacggcactacataacggctccttagcagccattattgggtatcaagtcaatgcctactcagggaggctttatcgcagaggcctgcacgagcagacacattccgaatactaaaattccttaggaaaattagtcattgcccatgtgtgatagctgttttccattttgaattttaaccattttgggaaaaggaagagaatgggaaataccagtatagtccgaaaagcccttaaaaaatgagtgcgaaaagtggaagggtggagtggacataggaagatgatgaacttgtcattttttcctttccatagcttcattttattgtgtcaaagttgcagaaagcacttcactttcatcgaggctctttttaggcagggtacagccaagaaaacttttttatggctcagatgtaaatcctagaaaacgtagtagaaatgatggcaggatctctaactgtaaaataacagtagtgttagtagtaagtgtcattataataacgttatagaactctgcacatcaaaaataccacattttatcatgatctctgcaagagatttctgttggtagtcattctagacttctaataaataatacgttgagtaggaaaggttctgtgaggatccaaataataatgaaaatgacagtggtgatattaataataatagtacagctcccatttattgtatcattattatgtggcaggcatttgtatacattatctcatttaattttctcagcagatgtgacaaatcaggaaactgtggcttagcaaagttaaataacttgactgatgtcatgcaaccactaagtgacagtggtgggatttgaactatatctggggagagtcatgctcttaccattgcattgcctctaatgatcatcactttcagggaactaggtgtttaattagaatatcccaacccattgtctgcttactgatcaggaaactgaggcagggtaattttagtaattcccccaaataataaagagagtcagaatgaataccagaaagcaacaagaggcaaaaacagcctttctctctgacaacatgttaaccacaaacaagacatgggaatttcagagcctccgtttgtgtttcagaaggaatgtccactgttgccatcagtcctgaaaagatttccttgcaccaaatcaaaatggttcgagtttgctgttgttgatattttttttccttttgtgttctgcttactgactgacatctgctatcatgctaagcaggtgttcctatgtaaacgaacgtgccctgtttgtgtttcgccatcctcgctgctgcgcacccaaatgagcagcgtgattaagaatcctgtaaatttttgaaaggaaacggatggctaccctactagaacataattacaccgttccaacatccgcagctcactgctgcagcagagttggagaacagcagaaattaataatatataatagcatcattctagtaatttataaatgaaataaagtagagaggagattctgctgatatgcattttctccttaattctaaaagacaaagtatagattagaattttagtggggtgaaacctggccagcagtctcccactagttgcctgattcatgataggagtgtttttgcttagggaaaagagctaatatgttttattaggccagaggaaaaaaagaaaaagaaacatgaataaacaaggccctctaaaggcaacactaaataaagggggtctgaaaaaatctctgtggattgtgtgcccactgtatttaaaaagatattattactttaagacttcaacatgtgctgcattttttctttcattgtaataacataccaccataggtcaccccttctgagaaaagagggactgatcagttaaagatgtggcccaacataaactttatgttaaatagcactcgtgtaaattctagagatctgctgaacaacaatacacccatagttagcaataatagagtagatttcatcttgtatgttttatcacaataaaaaagaacattcatgcctttttaaaaacattattttgagtacccagtatgtgcaaaggagcctcttattacaaatcatcgttagattaagggagttgatgcttttagtcaaccatgctggagaaagaacaacactttctaaagaggcaaataaactatatgttaaaagtaaccagtccatttctctgtctcatagggttgtggcaggcactttagaaactttaatgtttttctaacttcatttaccgtaggtaagatgcctaacaaatggatgagctcagttgtttcaagagtttgtctcccatgagccaatgcccatcacacacacacacacacacacacacacacacactcacacacgagcaattatccttaagaaaaataatatttatagcacttaaagtgttatttaagcaacttttcctgcttaattccaaagaatgacaatacatccaaaaaaaaaagtcatggattttcttcctttaattaaacttagagaacatgaaaatactgtttgcctttcaagagaagcatgtccatttaagatgcttattcatttaagcagtattcatttaaaggtccccttgagtattactctatgtgttttgatttggttcagagaaaataaattcatttaatagatttatttcattaacaggtatttatttaagtgggttccactgtatttaaatctccaaacagtttccattacttccttagctcacttgctccatgttgactaattttaataagcctaaggtgcctagggtcttattgagtgttcagtttgatcaatatggttaaattaaaattgtgcaaaatataagcaaatgtactctaacaacacagtgaaaaatgtgctgtgcactaagcattgattggtatgctgtggacacagatatatgaagctgggtgggcctctgaactacctggaaactgccactctcctccaaagctcccctggctttagatacatccatgtgatctcccacccgttcatggagacagcagctcagatacccccattgaattagaaggggaaggagattcatgtcaggtgttttgctttttgatttaatggaaaacagcatgtaaggctcacagtgaaatcctatataaagaaaaaaagctaagattttataaaagttcaactttgagtattgctgaaatgctttaggtaataaagaatgcaggccctagttctttttcacagaataactttttaccgtaattatccttaaattttaatcatttggtagcttgaattctttttcagagatcttacttgtcaagtttgttttagcaaattacaaaaaaacaaaaacaaaagccaacctgatttttaaagtataccaaaatcagctttgccattggtactgcatttgaaaacctagtaagctttctaacaaattcattgctttctatataattgtaaagttaaatagataactgaatatttttagtggattccttttagtatgaataagtttgtatcttctattcctaaatcaatttctttacctttccctttttctcttctttttttctccttttttgcctgttttatggcaagcatacttaatattcagtgtcaatctttttaagcttttcaaaaatctaccacaatcacttaccaatcataagtatatatcattcaaaattgttcctgatatgtgctggctgttggggcagtttctttttcctacctgttgtgtgcctttgtacctatctttaatctcttcttgctaagtgatagctaccatcacaacactggctttccttgatagcatatcttcctgcatgtccaaaacttaagttcacatgagcagaagttgttcttatcaaaggtaaatcagaagttaaaaaaaaaagcagagagataaaaacatcaaaaatgtacatcttgcaagcaatgatgttgaatttgggagaagtgtgttctattgaaatgaaaatcattttctagtttaaactgatcacggaagtttatatgcataataaggatttgaagtttcctatcaaattaagtacagtgtttgagcttcctaacatttaataataccatcaccaatacacctgcaaaataaaataatgtttgagccccaaaatcatcagaaatatgtagaccaataccagttcagaagaattgactttatttttgtaatggggccaagaaaaattcttaggtttttgtttagttttgtgcttgttaatcttgatttttcccagtgttttgcatgttttgagtttttaatatcaaaggtactgctctttgtaaacaagtgtaagtttacccaggcagcttcacttacacccttcccttgtaatcagatgtgaaaattacaccctcccttttggatacatgataattacacatttcaacatgcaaagaattgtctctgtttcagttgttggaatgaaaaagctgagacatttcagtaaaatatattattatattaaagatcatttccataattgttttcgggatttgtaatcaaaaccatgatcaaggtagtcttagttttaaaaagaatacacatggaaataaggagaggataaaattaattgccgagttccacttgaatgaccattcttttattttatgaaaatacagttaagtacattatattctttctttaaaaaaaaaaaaaaccttctagtaccttatttgacattttctttctccatgttcgttgaattacctattttttcaggtcgaccaaaaaaatgtagaaatacacatttttgtgatcaaggtgaaaaatttagtcagaagagagatataaatacaatgaaggaatcttttcaagaaaagatgtgtttgtttttgtttgcaagagtgcttttcagccaaatataaaattttgtaaactcaggtaaggcacctcacacttcacaatcagacttctggattcatctagagtatcactcatatcataggtaaaaatatatgtcactattggtataaaatacactgaagccttaaaaatgcagaggttttggcaaataacactaactcaaaaatatcttgtatatccaaggagagggtttaaaatcaccgattcctttttactttcttaagctaagaagaaaaggaagagagaggccaggcgcagtggctcacacctgtaatcccagcactttgggaggccgagacaggtggattgcctgaggtcaggagttggagactagtctggccaacatggtgaaaccccgtatctactaaaaatacaaaaattagccgggcgtggtggcgagtgcctgtaatcctagctacttgggaggctgaggcaggagaacagcttgaacccagaggcgaaggttgcagtgagccgagatcatgccgttgcaccccagctcaggtgacagcgtgagactctgatgcaaaaataaataaagaaataaaagaaaaggaagagagaaggcagcattagatggctgatgttatggcttcgtgaaacagtttatggcataaagaaataactccccaactccttagttttccaagtatgtaaatgtttctgctcatccaaacactagcataggtaagtgaggacacatatttcatctagcccaaatatattttttaaaagaatccctgcagattttttgcttctataaaaaatatcccaacccaaatttctaaaaattttgatttttggaattaaatgataatactaattagcatttacctatacatccttttctattttaaaatcattgcataatctggcatttatatttaattttctaaatcattttccctagagagcattcatgtaattttagaacttggaaggaaccaggatttcaactatactcatccacagacttttcccattgggtagaaattgaaacagaactgacagaaccaggatttgaataccagccttttgactccaaatcagggacaagatgcagttttgtatgttaattatttttattggttttgatattgtggccccaagatccatagtcttattttcatgctaagtgactctttactctgaagggccaggttataattgccatgtatgccaagagtgaagggacccaggaccagaaaattcagtatgcccgggtggtgagtttttagacttatggagctgcatgttctgaactccacgttctttggttttactgctcctgtgttttttgacagttgcttttttttttcttcataatttctgtacaggctgggcagagagttcaggaaatgttccaccgtgtactgacattcccctggcaataagtgggttcccacttcagtcgcattccactaagcctattttggcaccatagagagggtgatgagagggaagagtcagtggaggagaagacaggaaggttgccaggaaggaattgaaaggcatatgctcctggccccattgcctgtgtctgccttcaccacctttagcttcacaagcagtggccatggcaaataggaaaaggtttgggtgggagaaatacagaagaagccattcctgattaggccatgtgtcttccactagtttccatcagagtgggctgaccgatctgtgaagatctgggatcatgactcagtataacaagaagagtcctacacatttgattcaggaaatttgggctcctggcccacccagccctgccttccaatctcagcatggccttggacacatccttaacctctctgggcctcacattcctaatgataaaatgcagggactggacagagattgcaaactggtggctgacagatgtttgatttgtcccacacagtattttaaacacatttgaattggttgccaatatttaaaaattgggctatttcacacacacacacacacacacacacacaaatccagatttccagctcccctggagaactcagatgatctggtgtttcgggcccacatagctgcatggaaagaccatgtgggaacaactttgagttccgtaagaaaaatcaatcaacttccctcacctgcttggcctgtgtagacatttgagtgtgggaccccaattctctccaagactcctttgaagctctagttttagaattccaaatatgatttgcttgaccataagaaatatacttaatccatagtggtttctatattcacggcagaatgctaaggtatttgtttatacaatcagcatcaggtaaaagttggaactatcttaggccaaataaatcagccccatttagaacaaatgctgactttgaaatttgataatgggaggcaggaatagttcagcaaagatagcctttgaggtagttacaagaaagatggtttggctcctgactcactattacctacacagcgaactgtgtattttgcaaattatccaaaagtagattctttaaaacccaaatcaaataatacaaggcccttcagttaacattttttcacatctcccactctaaactaacatcttcataaatattgagatcatgaactttttctgttcatgtaattgcaaacaaattatattggcctgggaactgtttgatcttcttcaaaagtaaaggaactacattgattttaaaagttatatttttgtaaatcatgtttccaaatgtatccactttaaacacaaaaggtaacatttgcgactcatggttatagagtgtttaatattgtacaaggtgcattgacaaaaatatctcatttgatctttacaacaattgtaggagctagacagagaagacatttaatacaaatgaggagtctgagacccagaaaagttggatgactattggaaaattgacctattacttgcttaatgtgaaaaagagccgggattcaaatctacagcttttggctccatatttaatgttttccatgccatcagtatgcttccagtgtcttagggtatgtgtgtgtgtgtgtgtgtgtgtgtgtgtgtgtgtgtgtgtgtgtgtcttacctaaacactgactttttctctctctctgtcatgaacaagaattgagaggttaaatgggaattgtctcatgaattgtctcaatgttttctaagttgaatgaagaatcttttttggtagctattcttaagtgaatgctggatttttattaagggaagctaacagatatttaaaagcaccctccatatataaaagcacaatccatggaagcatagtgcaaggaataatgatatagacaaatggaggaggggcaataaaaagtcataaaacaggcaggtagaggtttctggaaaaataaggtggtgagggaagagtctaactgtaaaagtaaaaaggtagaagatagaaccgttgaaaaaaaaaagaaatatcagaaatataaagagaaataaacagcaagaagactccgtagtaatttaagaagtgaaaacttttaggacagaggtaggagagaaatgggaaacactggagaggaagtaacaactaggaagtgtggaagaaaaacctgcaggccagaaatctgagcaaagacttgagagaggatgatggtaaatgtgaaacattgaaagggatgttttaagggattcagacattgagaggaaagtaaattttcatcacaacaccccatgacgacaggctcaacacatttggattatgagaaaggaaattaacatggttagaacgaaagaataaaaattagtaagagaaatctttggatgtcaatggagaggaggagaaatgatattaaaaggaaagaaggcatgggtggaaagtagaatgagatgagaacctatggtaggtggaggtgaaaaatgaaatgcgtcagggaagatcatgactgggaccgccgcacactgcagtgatgaagacggagaagctattcttcagggaacctgcaaataaaaagaaaccttaagatgtatttggagggaacccaccccagcaaggtgagaaagcaagaggttacattctgcaaaaagagaaaatgaacggggagaagggggaaaactaggggaaagagaaaacagcaaatcaaagttatggagcgtacagcattgaaaggaatgaggcattctgttggaattattcatttaagcatatgggtattggcgtcccttttctaaaaccggatcctctcccttatttctcatttttctataacactattataataaattcacatggaaaagtacaaggatgagcaattttttactttagaaatgtttcaaaaggggaggtaaacttgatggttatctgtctgaagggtgacgcactatagtggcatgtgagaatgaggccagaggtaatcatcagttttgaaattgttctttcaacaaattcataatgcatataaagtaactcgtgcacacatttatggcaaaacatactctagatattaatttatattgcttatactgaagatctcttgagttttcaaaaagtttgatttacagatttttcacatcaaaaattttttgtagattctattttgtaattaagatgtgtagactcctcaataattctttaccttgatgctgtgtatactcatttatctagattaaaatacttccttgccctgaatgttctaaaagtgtaccccttggggctctagaatttagaagtctcccttccccaactatttctagtctaccttttcaattgagttaatataatggctttagaaatacaatttccatgttgctataaaaatggggttaaaagtcataacaggcacaagaaacaggaggaaatgagaattgtgtactttcagtcacacccgggccatgtgctcgggccacatacagcatgcagccctccggagtgggctgtgtaacccggggcacacttgaggtcagggcacatagaggattaatttactgaaggtggtagacaatccctctgccacaaatgcaaacattttttcataagcgcctgaagcaattagttctcttcaataataaatttaatcttttcctccttcctttctttcctcttcgtttctcctctttcttctcttttcctctataaatgctggcctttgtctaagatcttcaactcaaaggtgtagatgccaggaaagaaaaacaaaatcaatgtattgtggtactaacaaataatgctataattattagaaaaaaacagattgaagcaagatacaaaaattctcaaaagcagctatctgtatgaaaatcttttctacttctagagagtatgtgaatgactgtatctttcatatcgtgaaagcagatgcttacatgcaatcacctttaaaaaaagaaacaaactatcacagtagtgacattgcctattttatatgagtagggaaactagccaaatagctttgggaacatttattagccttgtccttttttttcttttttttttttttaacttttagtatagagagaaaatagagatgacaggtaggtggctaagtaaggtgacaggatggcagacagcattcctatcagggcagaaagaatttataagggagctgccacttatagcgtaatagagctaagttaagaattgcaaacagagtagggccaagcaacattttaagaacaattgtccttaaacattcttgtaatgctaagtcactcatctttgtttcccacttgcttcctagagttaagaaaagttctttcctaacttgggttgctatgcagagatgtgaaatttcattggctccaaatgcttttctgtctagtagggactactgggaaccctgctaatgtgcatattgatgtaccctgtagcttcacagatgatgaaagagcatattacttatttccacaacaacaaagctaagagaaatttgaaaggagccagttattttacctggggaatttctcccaggtgatggggctatggaaccatggaatttaaatatgggggccgtcctattttctaaaaagtttttatggggagccataatatcactcccaagcagaaatcaaatcaaataaaagactattgctttcatttgcatttatttagtcaactatgcctaaaatacggaaaagatattatcatgctcattcagagtgtattttattcgttgtttactagactggactgacatgatatgatttgtgctttgcggggtcacaacaagctactagcaggacaatttgctgaatcaagaggatgattgtgtctggtgccagtcagtcgcaattaggaccaggatcagggaggcccggggcttgtgcatcgtcttgggcaagctgcatagaaatcagctcacctgaaactaattgtcacaacagagaccttatgcaaatgagccctggggttagcgtgggaaaagaaaaactgtcgcaaagataggtgacctgctgagcagggggtctgttgctggggaaatctttgttcaatgagtttaaaaatgttttcattgttcaaagtccaccccccgcccccccccccaaaaaaaagtagcatacacactcactaagagtatggcaaacacactcatctaaaattccaataaagcagaagcctgctttggagcatgccataaattgggagtctttataagggctacagcaggagaataatttccctttgcaagggcctttaaagtttaggtgctgcggattgcagtgtggcctaccttgaaaattcacttgcaaggtcaagcctattgctagcctggcaggacccgcacagccttttctccctgcattccagcaggccacctccacacagccgtgaggggtgcctgtgaactagacaagaaaggcctagtttctaattgagctttactggtatctcaggtagaagagaagggccaggagcactctcttaacacatggcaaaagaatccggggaaacaatggcagtttcttgaattgtggtttctcaaatactcacaagttcaaatgaaatgcaagcattgtgaaattccaggaatggtaatgcagcccaagtggtaatagatcataaaaatttagcaaaagaaaagtaaaaattatttttaaactatgatttactttgtttttcaatccctgacaaaaacacgtataagttggaaatgacgtttgattttattgtagcactcatttggaataatctttaatatgttttactttagaaaaccagatgaagaaaagttattcaaaggtaatgataaacatttttatacgttactgtagcaaagttgcctttgggttcttcaattgatttttagcttttcaatcttgttttcataaaaacatgggctaacatattgatacttcttagctttacactaaagatttcccagtgacatagtagataatgtatattcacacaggagtataaatataatatcaaggaaatgaaatagagtgttctaagctttagcagtaacagagagcatagatattttgcatctaatgatttcaaagaaagaataatttgaatttaaaaatgtaggtgagagaaaaagaaagtttcattgcattggcgttgaatacaaatgctattttgtttggcaaattactggacctaagaaagtgttttcattgtgtttcctaaagggctggattgaaatttggacttgtacctgataagcaagctcaggaattaacttggtagccaccacaaaacctaaagaaagttaggcttagaagtgcaacttaatcacaatttagattttaacacacacgcatacacacacatatacaactcttttgtcccttcaccactgtctgaaataatttccacataagagacatttcacagtgggtacgaagtgctcagctttcactcatcaaactttaatcggaactgcattttagtttttgaataaagaacacttaaaaaatttagatgcaaattattttgcattattcatgctctaagtgtccttgtagatttaaacacttctgaggccaccttgattcaagtaattacctaggccctcactgctccgtcatgaataaggtattttgtacaagtaaagtatgcacccgatgagcttttaaagtggctttacactgaacttgtgtattgcttcttgtgcatgagtgagccgaacatgtgtcgcaatctgtctcaggtgggaaaccctggctgggcatccatgggtgacgggatgaaacccgagcgtctccttcacacacatgctcttcctttgtctctacctaagaatgttcctgcctgattctagtagttgttttaagcattaaaaaaaagcaatagattctaggaaaagagacagggaaagtgacagtgattccgcttaaccccttcatcaccagagattattggaaatgcccacttttcaggcctcctcatctccatcagcaaaggcttccttgtaaggtaataagtctctctcattttacatggttctgtacatctgtctccccatctgtcagcccagcatcctgagctattagagctaggtgctacctccaccacggtattcacacgaaatggagcaggcttcaaactcaaaagtagctgaagaatacttacaatggaaatgaaagtgaccatagagcatcaatctgtaagtttatccacacacacaaaaagagggtttgtaagagttaaatgtaactggctgaagcttatagctggtgtttgttacaaagtacccaagcttttcctttccaacttcgtggctttgaagaattataggaattttatgatgtgctgttggagttatactggcagagattacagtaaaggggttaaagttggtttatggtagaaaaaaaattatgcagaaaccaataaaaataaacacactcaagtagactaaacttgctgggcttttagttttacttttaacaaaggaagtttagatgaaagtaaatgttgcagcttttagaaaattagttgacactcatacttgatcatctttactatacagtggtataattaatatttaaacattctaataatgcagcttgctttgcatgcacttttcagcctcacaacattatattttatctggaattgtgctagcattttcttgggtagtgcccattttcatagagttaaatttaaaatagggtagggcctcagctcttattgccagtaaaacatcaataggagagtgaacaggtttcatacatctaccagacagtttattattaagaacaatatttatttgagataatagataatatataaattttgtttcattgccccatgaatgtttttaaatgatcagaatagattaagtttgaaagttgcatttggctgttgtccactcactgttcaaaacaggaggattttgatgatgtcaaggcagtgcgaaatcagcaagtgatacatgaaacatggaacccccatgcctgcccattcattagggcatctgattaacatagtaaggaatgtttattttcagtacataaaattgtagaactttgggagcatcttctgaattgcaaaagctgaacacccaggaacttagtgaaacaataaaaatatagagaagtaagctaatttgtgagaagcctgagctagtttattttcctatgagaagtttcttcctgttccaatctcatggctgtaggtggtagggaaaagttgtttcaggtgctgccctcagctagtccctttgaagagtgcaaggtgcccagtgttcctgatcttctagtttgaatgatgagaaagagcattctacctttccaccatcacttaagtgtcctttgaaattgaatttgcatgcacatatttactgctcattctttttaagtgagtaggtgtgctgagcttcaagtctattttgagactcagcccatgttaaccccttgaggcccacttcatgataggtactgccctgtgggaatcctgtcatttagtgaagcatgaagccataatagatccacagccataccaccattggggcatctcatttcgattaattccctgaagcctttggtgctgtggtttgcagaaatcaaatggcgcaaatgagaactacaaaattaggcaggttaaatttcgcaagaaaaaaaaaagataagtagtagaaaaaatagccagtgtaaaatattagtacacaggagcagtaagtaaactaagttccacactgaaagaaccaccagatctcgagaagtagatatcaagaaacagtttgcactggctgttttatttccttatgtcagaaggaagtaggtttttacagatccttggacatgatcatctttgtttctgatattcagaaacggaaccaacagtttggtgtctatttattttatttggtttgtttttgagaaagcgagttaaataaactcagcttacaaataattaacagcccctggactatttaaaacctgctactgaggtggtagagataagttgaatccaacagctgtcacatgtatgggtttgacagataggtaagtccaagagtggacaaattaaaagcatttttcatatgctaatctccacctgcacaggaataattttttttaaggaggcagtctactggcagagcaaattcaagagctatcagtagtacattacttctaggaattatgacatgcaataatgaataaatacttctatgagaaaagtctgctgtggaatcttaattccagatgggtgtcctgacagcaatgtgccagcaatattgtggaaagaaaaatgacatatatacatacatatatatatacacgcacatatgtatatgtatatatatggcttttaaacttgaataataatttcttccatgtgtaataggttcacaattatatctaaggaattacttttttagttgcgaatagagatcaaagtgaaaacaatagtcaaccttgcccttcaggtggcagttacatgtgagctgcatagtgagtgtgagagacagtcaaggatgtcaatcagaacctacagattaacccacagcagtgaaatctgagatggtttataacaagtagataacagtttcaggcctatgtgagaacgcataaactaaaacttcatgctgggacaaaacagggcaggacatttgaggtagagagtgagaaaaccatacttttattatgacaaagcctctcccatacttgttgaaatgtcactgggttgttattaaatgctcaccatttctctaggttttatattatcttacaaaaagcttttggagtttcctttaattttgataaacattcaaatttgtgcataatttctgcacttcagctttgaatgacagaaaatttcccatgcttgttgagtttcctttcaagtaagaaagtaattcttgtaataaataaaaatgttatatttctttcttccaatgttatcaagttaataaacccttaccttagtttataaagtcaaaatttactaatgtattgaaatgagaaccgaaatactcaaaaagaaatcttaaacatcaaataataacgagggtaatgaatgaatggtcatggttatggatggtgatgatctaatgtaaggtcctatctctttttaatagagagtcctcaggctcagacaatttagggttaaagtgcctataaccagatcagaatcctcagttattacgtagtactcttttaagacccgtgaattaagttataatcaatgattacaacactggtatcatttattaatgtacccttctcttctagggtagcagagatcagtttctgacaccttagaactcttcatgtgcaagaggaaattgaaacaataacaacatatttaggcagtaggcaaaatgatttgctttggctttacctacagggaaacttgggcaatggtcattagacttttttaatggaacttcaagtctgatgccttgtgaccaggtgctaacatggaaaagagttagcatcattgacattctttgattcggaagcacataagaggtagataaggagacaacacaggcgacccacctccaggccaggagaagaggacagttcctggaatgtctgcaatgtgttactatttttgtcacacctatgtgaggccatccatctggtctgaatcaatcagtctcatcccagggctctgctcctctcccagctgaaataatacccttctttcctcagtgctgtcttcaggaggggcgctgctcaggactgcccggacaaggccaattaatgagcctgtgtatttgcaaacgatgacccaggattagacactggagaaaactttctttaaattctctataaactctgctctcctagaaacagtacttgagaaaaccggatgaatcattagacaaataattgaccccagaaagcgaaagactgatgctacattactttgcatacgtacatcttattttttaaagaaaatgtccttgccttgaatttaaaccatgaattggtctgctgttatacccaaagtagataaagcctgggtgtgaggcattcaccatgacttagcctgaagtattttcttcggccacttcactctcctccacgctacatgttcaatttccctgcacctctgtaacaaccctacacctctgcttctagatcatcttcttggcattcctcatgtgcacatcctgttctctagcagtcccttatccatgccgcctcatcagattcctgcacacctgacagcctcttgcttgctatttcagctactagactactgacctctattgtacatgcctgcaatcccagcactttgggaggccagggtggtaggatggcttgagcccaagaatttaagaccagcctgagcaacatagtgggaccctgtctctaccaaaaaaagaatcaaggtatgcaccagttaagccagccacgttttaggaccacatagcactcttcccacaagagacctcaaaacttaatgacactggctttggcaaattcaataccatgacataaaactactcattttccctatctgcctagttttccattgcagtgggaaataccaccctatcgtggacctcccaaccaggaaccccatggttatttttgtctcactgctgtctttctcactccccacaaccagtctgttaccaaccgttgctactttttctttgccaatgtttcctgaatccacccctttcctttccattctcatagttgtggtcttagtctaggctttggccttggcccatggggactttgcagccttctttcccctctcccaccacattcacatatcaaattccagcttactttatttaataacactgacaaatttttttttctcttgtctatgtttttggtccattcattctctctgagctccattgagactgccagctgctctctggactggcttctaatgttcacttcatacatgtcacctcttcatccagctacctcctaattgttccaatctttttttctttctttttggaggtaagctcttctggtacttctttttttatcgttctcacacttcttcagaaactcttctcatggtatacatgttcctggtacacaccactcaagggcagattctgacactttctttcggtagtccatccgtgcttcctttctgatgtagcaaagtgtcctctttgtgagcacgcccaggttcaaaacttccatttccaccacttgctacctatgacattgggcagttacctgacagcacttcacctcagcttcctcatctgtaaaatggattgttgtgatgagtaataagatcatttatttagagcactgctggcacacagtaagcactgttaacatgtttgctattagtattattatcatatctcataggactccccaatcacaccccgcttcaatcaccatcatgctgtatgccatattatccttgcatgtaaattttgaggaccacataactgggttttaaaaatctggttctaacagtagtttatgtcttagaaatcagggcaaagttaatcgaagatacctaatatcaaaccaggtaaagatgaagactttaaatgctttttgaggatgattataaagaacattatgataagaatgatgatgatatgatgatgatgatgatgatgatgatgatgaagaaaacatgaccaaatgcttctttgggttaatactctgcttataaaacgaagtgtccaggaaacatacagtattcctcctgaaattagtttttttttcccattaaatggaaacatgttatgcataagaacatatattgtgcagtatgcatgagatttatttttcagaaagcagagaaatggcaagaattttaagtgttctacatacttatttagatctcacatcaggagataaaacaaatgaaaactctgacttgttaataatttacgttttggtggaaaattcatacaagctgttaagatacctctaagacccaacacagaaaatgcaaataacatatatccactgtgcactgaagaaaatttgtctgaaaagaaaataacatcaattaaaaaaaaaaaacacaagtgatttcaagggaatgttgaccacatttacagggctgtaattgtgcttattaattttagatgtctcttttgaaatattcgtgtaaatgatctctccacttaccaggtgtttcttacagaaagtccactgggctacctcactacctaggaggtggcttacaaataggggatttctttttagaaagccacaccattacttttctctaacagcttatgcaaaagttttgtgggggagggaaaaacccaagccaaaaaaaaaaaagaaagagagagagagagaagagtgtgcatgacaataactacctctgtcccttaggtttttgttcttttcatgtcatggaactttttagctgtgctgcctgggtaactgctctggaaggttggaatatctgttgttgaaggaggtttgtgattgagggccctctgacacaaccttttgttgcattgaggtgtttgatcctctttccctttcttctaaaaccaatcccatccctttaaaaaatggataaccagcacttcttttacttattgtcagcttttggaaagttactctgggggtttgtagaagtttaactagttaactctttgcatgctgatgtcctgtcgctaaatattcttcttctttctaaacaggaaggattttaatcacttatatcaggtaactaccgctgttatgcaggcatagcaagtgaaacatattaaggtccagaaataaagcatttgtgttcaaggtcttcaaatgtgagagtgattcaggctttgcaatgagacacatccttattttctttttgtcctagaaccgaaacatgtgagagttatgactctgccacttgaaaaaacatgatgatatactaatttttcattgaagaacaacaggctttggtaataagtaaatgcaaagggttacttcagaactggggtacataactgaatggcaacaaagaaagagagccttagaatgaaaagtgtaggggtcttgttccagtctgctgactagatgctggaatatttttttcccaaaagaagggacacaacccaggctctaggaaagaaaagaagcttaagtggattatttaacaaaaaagcaacttatggcttctagatagtgacctacattctgcacacaataatgatgttttacggtggtgatagggttaataacctaacatcattcatgtagtgttttttgaaaattgaattttactgctacaaagtaaatgtaacagccctctggagacaatattacaggcactttattgtttgctaagctgatgtcatctttctacagactgactttaaaacaaaggcagaacatttattacaaatatcactgtgtgaaaggaaatctactgaaatattgtttagaaggtgagctgataaaaaagtattaatacttggctttgatcatcttgtactataaagttatgacttcaaattttttctcatgtgatctctattcaaggcaaacttcatcctggcaattcctacctgtgtctctaacattatttgccctcaagttgaaacatttgtttaagattcatgcgtgttttaaatacatttttactctctaaggcaatttcttaacagagttgatgagtttttgagagagagagattaaatagcatctttcagagataatatatgtatgattttaaaaacaaagtatggagattaagctgtttagtttatataatgaactttcaaaatcacctgtaagtggtgactgcaaagtttgcaatttaaataagctgtttcaggcactgccaagcaagcattctgcatcacaggttgcttgcaactcagagggtttggtctctgtatctgatgcacgtgtaatacagcgtgaagttgtttgtggatcacacaggagcttcttagagcttcatttccacactgtaacccttgaaaatgtatcaaatgagcagatgcacttggctcttccttaaaaggcacaagtaatttgtttgtaaatcagttacctttcaagaaaagttaaattagggggaactcttgtttctttgatgttttccctcttagaaagccaaagagcaaattaatgatcattttgaagtaataatgataatgaggaaaatataatttagtgagctacactatcccaaaataactttttcaggtacagcatataaataacagcccaaaggactaaagcagcctgatggtgtttttctaagaaaatgatttactgctctgcctttgtctctgaactctggttagaaggaaaacacaggtcaaggaaattgggttaagggaaaaaaagcctgttatgggctaggtgtagaattgtatgaatagtgactaattgggagtctgtagcactcagatcagtgtgtgcaatgctcagtactggctgatggtatttatatcagtcaaaaatgaagctggatacatctttgcgtgctctacgaaggcagtgtgttagttggtgaattggccgtgaccaggagaaagctaccagtagtactatgattgtgactaaaccaagaactgaactgcaatgttttaaaaatttattttactaataagtgtacttctgtatagaaaaatcatttttaaaaaaccttacaactattttgaaacattttactataagcctgcctttgatttgtttgggaagctattttatagtcactcaattcatttattgtatttgacaaatattagctacttaccatgtgccagcaccaaaggttcaaaagtgagtcctcacagagccttacagattagtgtcagaaagaactgcttggcaagggtaagagtgtgacacattgtgagtattcaagaaatgtttgttgagtgactgatagaatgaattgagggatgatcaaggtaagtcctcgatttgatatatgtacaaggaggaactaagagtttccctccctgaacaggtcagaaaggacatgcttgagctggccttaaaaaaacacctgagtggcatgtagcatgtgaataatgaacaggaatgagccactggtggtagaaacagcatcccagaatatgctctgagttttagcagcacagcccatttctgacccctgcatgcctcaaagccactttaagaatttggtctttgcccttctgtcctcaccccctgttgtactgtaatacacgcaaacatgtgtgtgcatgtacacacacatgcacacacacatgtgctaactccatcgttggaattcgactgtccaccccttcaagaatcaaagcatctcctaaaaaaaggaaatggcatgcctgttccttacttgtatccataaaactcacatttgagttgtctatcatgagacctcagttttttgaccaaacattgtccttaagcatcagacacataagaaaaactggaaagaggaacaggtaatatttaaatcacccactattcttgtaatgaaaggatttttcaaacatcaagatgaaatggttttatcaaattattaaagtttgctttttgtgtccaacttagcaacaagtcatggatgggacactcaaaacaggccaatttgggacagttccaactgtaggaggccttgtgtcattacctctataaatggaatcgagcttcccttcttctgcagctatacattttcttgcctttgatttcccactctgctttctctcccggcaggctcttcctgtctcctctatcagttactctataggcagatgtgcctctttttccatttgccagatccccccaacccagatcttccaaactactcccctttgaagtctctattaccgatacaatcacttttgtttcccttccatcccctctctcactgctccagtttcttctctccctaaccccattagttacatctgctgcccctaccattcagcctgtgttaaatcgtaatgcgcttgacataacttcagtttgtctgctaagtactcaatcagcacgcattgctatcttctgatttgtaggaaagggggcaagactgagtaagctggctcagaattctctgagtgattcagctctgcccaattagcacaaccaaagtgggaaattgacaactaataataatgaaagaaatgggttttagttgtgaatataaatcccacaaacttggttcctgatgcctgtggtagatactgtatgcttcatatggtggtcagatggctcagagaatgcagaagtggatgaatgaaggagagtgtgtcaataattgcaatatttattagttgactgggattctttccctggaattcattaatggattttttaaagactctgcaaaccaccagaaattgtatgtaacatttagtatattgatgcatttttttcctgggcagtgggtccatacgtttaagcagattcttaaaaggctctatgtctccccactatccgcctccaaaaaggtgaagaatcattgctataagtgaagacacctatttggtctatgttttcatgtggtctgctttttttcccagcccattttaacattccacatgatttgagcagttcagagagtagaaacgtagggttttaaaggcaaaatttaccttctttaagaggaaaaatgtttaaaccacctaccaggttatacaattcacattttaaaaattattttagttttaccacaattcaaagacaggcctttttttttttatttaacaatgggtataatcacacatctgaacataagaattagttttatgcagttccatagaaaaccaaaatcttgaggaacactttcaaaacaaccagagaaaaataaaccattccttatgtcagtcttgttagggagggattaagaaactggcaattattttggcgaccttaattgttgcgcggcaggaaaatatgtaattagagcacgttcccaggcctgcacacctgcagcacatcctacagcataatgtcagctttcagtgcctgtcggtgccaggttctagcacaaccagtcacagtgacgctctgagaacatttcggactcatgtaatgtggcttctgtgtatgaaagaagcaggcatttacactaccacacaatggagtgcattgctgcaacactggtttcattattttctgacgcctaccttcagcactgccctggtttactccgtttgaggttttattgttacggtataatagtcctgtacatttttgaaattcccttattattcagcttattaatacagtactgacttgattatcaggctgcagttgcacagcggaagattcagtgcattagctaagtcagaagctgagtaaattcttggtataatgagaacaattgtttgacatttttttatgtagaaagatgggccatggtagttctctatatagttgcattttggaattcactctatattccctatatgttgttgagtattcgtttttcatataaagaaagcttaaaatgtgttctcactaatttgaaaagtgtttcagggtatgggaggactccatcatgattctcattagcttttttcttctttttcttttattggcttttctcaacaaaaagaaactctgacgttagaaaaagtagtgaaaatgaagaaacagtatgcacgatgcctatttttcagataattccataatctggcatagtgatagttaacagacttttcccccctaagggagatacactgtattttgctatctgacatgttgtcatatataaagaaatcaattggtaattaaatgatgcaccttgtgaagatgacaaaaggcatttggttgcgaaaagagaactgggttttgaggggtttgtagtgaaggcctaatgactattcataagagattttcagtccgttgatccacttgactggaaagttctgccctggagagttagtgctgtcagtttctctcacctcagaaagccgccgcaatcgacggtgtagaggatgagcgagaaattatctagtagttgctctaggcctgtcttaggtcacgtgcagaaggcacatctggcttcctgtaggtacaacctcaggacataaactttgactaatttttaaactataaatatgtacgagtgacactgaataagttaccttttattcatatttcctttattttagaatgcatgcaagttgtgtagtaagctgccattttggccttatttttcttccaattttaactgttacacacttgcttgttaagctaagagtgactgtttatgaaagttgtcaaggaccaaatgataacagtctccttatgtgaaatccaacaactctgtgtttgctgagaatatgccaaagttgccctgcaggaagctcacctgaaacaaatacagagtatatgattggatagcgctcttggggggtgtttattgccctatttggcaaaaggcagtaagatatcaaaatgtacatacataggactggatacaaggctgccaccacatcaagatctctagaattgcagaacattgttgctccagtgtcttcataaacacaatcacaaaaactacgatgaaaattcatgcattcaaaacagaccagttactgtccaccatggaccaggcaccatcctagctttggaggagacaaacatgagggaagtaaaatctcagtgctcatagtttactgaggaacagacaaataagaaaacagttacactacaacatataaagagttatgattgagttgtataatagcacagagtttagaatccaggaaagggttttctgagaactgttggggtctacaaacggggtaaagatttcttatacgagctactctttccattgccaaagccaaattagctggcggaaaggtgagttggacaagtgaggtgtttctgttgcatgtggaatctcaacagaacagtagtggccagcaatttctgtacatatttactcttggaaagtgcttctccatgttatcttatcaagaagctcacctaatcaaaggtaaacacatttatcgcctcattaaggcttgttttatggccacttcgatgtcatgtttgaggtagaagtacctgtcacagtctttgtctggaatgtatgtaaaagggatttcatggacactgcagaggttttaatctttcaatatcaaaataatttaatgcataatatgtatttgagaagatgtcactggtgattcctacttgtgtactgtgtgtactgagttttgctgacacatttgctagagctgtcaaggtggaccaaatgaatggacagatgccaaaaaaacaattatgcttattaatgtacattgattgcttgtttaggttataaaacaaattaaaaaaaaccattagtatttaaacccttttatagctgagctaatgattgcttgtaatatagtgtctggtaaagaatattctataatacctgtaaagcccagctatgttatctaattagtagactttgatttaagtggctgtaattatggaattgaatagttgcctttctaaataaccaaatggtagatttaaatatataaagatgttgacttgattatttaatatttgtagcaaagacaaaccacctaaatagagagattaattccacatcagtgcaacattaaaagggagagaggatgccaagaatcccattaatttgggatataagtgtctgaaatttcctcaaaacatttacgccaaggaataccaacaagacaatatcaagcagctctccctaaggatagagaggtaaggcaaacatgattttaaactgcacaatatcacacagtaaaattaaggacaatgtgttccaccagatgctaaacacagccatttatcgagctacaaggttctagactaagtaagtgttttgtatacatattagctccatattacctccatgacctctttccccatgaagccttccctgagcctcagtatccactctttcctgtaccatgaatccatttttcttttactttttcttttctttctttcttttctctctctctcgcttgctctttctttctttctctctctgtctttctttttttgttttttgttttttgttttttgttttttgagacagggtctcactctggcacccaggctggagtgcagtggcacaatcatggttcactgcagccttgacctcacaggctcaaaccatcctcctgcattagcctcccaagtagcttggaccacaggcatgcaccaccatgcccagataatttttttttttattttttgtagagacggggtctcactatgtcacccaaactggtcttgaattcctgggctcaagtgattctcccacctcagcctcccaaagtgctgggattacaagtgtgagccactgcacccagcccatgttttcaataaagatggtgctatttgaaactatggcatgtcacgtgtatattattttatttcaccatgtgtttaaatgagataaccaggtgccaagaaagcttcaatatttgcttaaatagccaatgtgacggagaataggtaacctcttttctttttttttcttatgatttgctttggctattagttttgaaacatacatgttatattcccaattagatctcgttacatccttcacaggctgtccaaaaatttccatacttctaacaagaacttcggttgactgagtttatattatatagtttttctgtcctttgccctatttctttcaaggcctttgagtcagaagcattcagcaccacggcgtacgatagccaccatttgctttgcccttttaactttgggggttacttctgaccatagtccaactgctcagaagggctttttcacaaattgtttaccgtggcagttgctaccctattggggtttgcattcagaacccataagcagagagcaatggtgtcagtataacaaataatgtgtacaattttttaaaatgctgaatttaccaaatccccatattatgttttcacactgctctttcagaaactgtgctaatacaatactcctataaactgatcttggtcctggcaggccctgttggaactaatggggcctgacagttcttcagttaaaaattatacatgagggccactttcccttaaattatctattgtatgccagctgttcacaactgcactgcttcactttctttgcagtgctagaaatgtctaattttctcataatatccatagcaactattctcatggagggcattgaagttagtaagacttcaaacacaccttcacagaaatcatgctagagttgcagtttccattttctttaattttttggttctgaaaaatgtttagatggctcattttgccggtttcatgccatagcacttgagttatatcataatttctcatttgctgcacaactttattctatttttatgctcctaaatgacgcagctctaagtacccgtgagtggcacttccgtgctgtgagtgctatcaaaggcaacctcagatggataaaactcctggttttttgttttcttttgttttttgttttgtttttgttttgtttttgctggggaggggagaagcggagtcatcaccaagggccttcttttgtttttcaggcatgttaaaactgtataaccaacagaaccatttaaaaggaagaaaaacatcacccaagttccgtgtctgaatgaaggctgtcttctcaaatgctcctcattactccagagcagttatatttggattataattaaaacgaggcttcttttttttcttttattcttcttttttcccagaatgcctcaagtgaagtattcctcccaaagttattgcacctctttactaacaagtgctgggattttaataagcctgtcccccctccttaccctgtacagaggaaaggatggcaaagagtggctgtggtacaaaggttacatattcagtgatattttctgcttttattggtaaaaatggggaggtgggtggaggatttcctttaattatgaaataagtgtgatgttagtagttatttctgtaacctggtgaaaatgctgcatatttcaggcctaatttttagcatatgttaccacgtgtgtaataaaacggtgatctgcgctctccgaatcttttggctgttaaggagcactctgattataactagttgctgtagaaacctggtcatccagatgcttatcaagaatgcattattattttttaaaccttggtggagaagccacagactgcagcagttggacaaggtcacatatcgatggaagtgacatgtctttcctctttccattgtgtgatcgtccagggcctgggggcattaatatgcaacggttctgtttttctttcagaaggacttgtaaactctttaaacagaggcacacagttgcaattgttgcggtactgagtgggtgtatagaagctagggctgcagccttgtccagttgcagatagaataaaactgacaatgatgcaatgggcctggcatgtagacaactctgtgggatggatgaatggtgcggctctcgctgtccctccggtggtggtaggccctgtaatagctagcgtaggaagggtggtgaaaattgatatgcactattactacacgtataaaacttaacactggggccattgcacaggtggggggttcctgtttattgatttttatgagtttgttagaacatgcgcttaatgcttttatactccgggagctctgggagggctcaccttaggtaataaacctttccgtactttgcaatcgctcacaatttacatggggactcacattatccagtacaaagcccagcattccccttctacttggttttaggagtgtgataaaaaaaaaaaagaaaaagaaaagaaaataactatagcacttactttgaattttttgaaaacctgtccactcccgctatgaaaatggcccctaattctaattactcatatttccaagaaaaattagtcacacaaacttatgttatgtgttgtctcagaggttgaaagcaaatcaggtttccaataagacagtacatcaaacaaagtagcatgttcttgatgccgatgacttttttttagaattatggttggacatttttggcagacagattgtcttttgctctatcaaaatgacagtttcttttgtaactgcaacattcataattagaaggagagaagcaatctgcccaatttaatatactaaaagaagtttagagtctctgctagtaatttcattatttttaaatttgaattaattgacttaaaataatacagttaagaagtataaccagcaggattatggagaaaggtttctttttccttaaaaaaaaacagtgctctcagtgttacacttaagatgagattgaaattttcttttttacgccaggtgccccgttctaagattcagagcagcaatgtgaatattcatccttgcagtggagctgagagaagttgtagggcaaatcctgggaacaaggtcactttaaacaaaaaagttctccaagtttcccatgcttataaggctggctgggcttaattaaagtcaatggatgaccaaaaaataaataaataaatagagagagagagaaagaaaagaaaatgaaagaacaaccacccaccccatatcagtctctttctaggcctcacttcacattgtataccttagccgttgatgttcaagctctttacatagatcaagaataatatttcttaaatcccttaacaacactgacgtgtccatggtttaatcactcttccccagtccacatctctaacctacgtcacttgggtggccctcacccacagcaccacaacaaaaacaaagccagaattgcattcagaatgaaatcatcataacatagcaaccttgttcaggatgtgacctttgggtttcagcaaccctgtcttatgcagccctggccaaccttaacctttcctgttggctcggagggtaacctttcttcatattttcttcaggatctctccttacgggacccagtatgttgcatgcctatgatgcacagggccaaaagtttcggagtgttaaaatctacgagcctgttttcctctatgagagaatgaagcctgcactcattttaaagaatacatacgtagcaagatctctttttacccttcctgtataattttggttatgcttaactctaaaggaaaccaattctctttagctctgttaccttatttcgtaccttagctgattgtcatctttacatgagcatcagatatggatgtgacaaagattttttagaaataataacgaccagtgctttatgagttgtgaagtgtttttctctcccacaagaaattacaacacaaagtgccctatgcatttttttagtatgttgataagacagcaggaaattttttaaccctcaaaactttctgattataagctgtgctctaaatttacacgggcagtgttccaagtcccacactcctttacaagtatatcattacagacctgcaagtgagaaggtaaatttccccatggcagttctgaaatctgacttcaggctaagaggccatggactgagagggctgattgtgctgggtacctacatatcaaaatctcctctagtattttagtagttccttctgtcctttttgcagccccgtgtcctacagaagtgacattttgttccattttcatttatcttactctccttagttgtatatcaaaagatatacacatttatataacccaagaagccagggattaaagcacaatatttcttaacacagcttcctctaagatctccagtagctacctaatgcttaaagcttgggctgacgtgggttatggggttatagtagctttatagatatttctatttgtgtatgctatgtttatatatgtaatacatatatgtgtggcttagggctatactgacatgttattttctatgtgttcatttattataaacagcaggcaagcagacgtttcacctcacacctcactctggtctctatcattcaaaaaatattgcaagattcccattctaaattaaatacatccgagcttacgtcttttatcaattctttattcttggtatctcaaaattctggtcttcgtcctttgtctcaaaaagggaaactgctgaaagcatttccacctggatgtttaaattatttaagttgcaggaaccagaccttttccctcctgagtagttgtgggttttaaaggctaaaattgcttcatcatgccaaagtgaaagtatgcataaattatttagttaaacctgagaaaatacagacttttcccagtgatctttcaagggctgcctacttaaatttcagaagaatgggcaagatttttttttcattctcttagaaaattgaagtatctcttgtgtcttctgtcagttggaatgtgaacaaaattacaaaatggtaatttttttaaaattccaagcttcataatatccagtatatctatatcattccaaggtgaatactgtgataatcaatcaataccaggaagactcctccagctggcgagaactgcaaaccctctctcaatgtattcttaggaaaatcaggcaacttgttataggtctttccctagtgccaacctaaagactggggggcatttccgattcaatttctagtcatccagagttggtatttcagttttaaaagtagaaagttaggtaattttaagatgttatgaaaactttgttgacatttttaatttgctttttaaatttacctttacttcagcaaataaaaataccagaaaagtgtgaagttgtgtggtggtggtggtggttggggtgtgtgtgtgtttgtgtgtgtatgtgtgtgtataagatagataatattaaagtagcaatgaaaacagcccagaaatataggcaattgaggcccaatttcaagtttctgtagcataaggcatgtatattacagaatgtaccacattatgtatctgatctctaaattcgccttagtataaatgctccaagtacattcttatgaccaagaaaagaatggtatttttaattgaatacctaacctcaaatcctgaaagaaacattaattgggacaggacaaaatgtcaacaaaaaagtacttatgtgagttatttagtatacagctgtctgttcatttgtagaatccatttgaattttatgttcagagaaattgggagatgagagtaaatatggggggagattggcatgtaaatttgttgagttttcatgaaaaaataaaaatttaaaaaaccttccaagcaaaataaaacctgttccattcacaaatgatggatgtcactgatcccattaatacctgttacataccaggtcctcttccttatatctaacttgctttttctcccaatttcagtgtagttgctcttgaccttgcctttgttcttctctcctccttctctcttctgcccaggcacagttatgtccactaaaccagatgaacaagatttcatactgacaccaccatactctgttaaatagttaaaaatcctattttggcttttgtttgctcacttagatttgtacacccaaggtgatgaagagagcacagatagaatctagagacaaatagtttctggagtcaggaatcagatccagattctaacacgaggtgatgtgggaaaaagtcagttaaaatttctgagattcaatttactcatctataaaatcatcctcataataattgctccccccttcaaaggtttgttatgaggagcaagtggaaaaatgtctattaacgggctctgctgtcagtggattaatgcataaatccaggtattattatataatcaaactgtccttttaaatgtagaagaaaagggtttttaaggcacacatgagattctggaaacgtagacgttatagaaagtctatagggactaaaaatgcattgtcttctatatgcatttatcttgccagaggtacatgcagacctttggggggtgctgctctggccaggacagtggtggagagctctgactcttgagtgtgagagctggaacgattgagaaaagacaggagggaaacttcgaggtcaggtgacttctttctaactacagcaggttctcagatccctaggctggcccaagatgagagaacagtcaccaaagagagtctggcacagtaagcctaagtctcagtgtcatctgattgtgaaatctgcttgtttgcatactcatacagtaccagagcttaagccctggccactgtacggatgactgtacaagagcagaatctaagaccaaggggttgtttttactaaggaagaaaaatttattagagttacttcaaggaaatctattagattatctcaccaaatacattaatagcatcaattattgtattttacataattttttttacaccagatacacagtatattaaagaatttgtggaagtcccccatgtgaaccagtattaaccatgataagagtaatcaggactggcccaagaaaggtagaaatgagaatttataaacttgtctaattctcattgcttgaagaaaattgaaatgaaagaatccaaaaagggatttatgaatattttttaaagcttaaaaagcccacatacttatcatcgaattgtctgcttacgataggagctggaagagtcccttatatccactcaactgtacttacattttaaatggttgttttcctttctcttacactactacaagagaaaggaaatgcctaggcaaataaactcagttaaaataactttatggttgtgacacagtttgacaaaagcaaaggaaattcagagtcactgctcacactgtatcctcagctgattccaactgtggaaaataaaatgctttaaaaaaaaaaaacaatggaacaaacttgggatggatttagtcttagtcttagaggcagccttcttaaatgctgaatctctgagttcgccatctttaagttcttataagagttgcaatatctgtattcatcataaatctagtcagagttaaagaagagtatttggttaagtactgcttggaaaatatgttgtccttttttaagattatgtgattctaactcaaagctgtaacttcttgggggttaataacctaccttgagatatactttaagtaataataatggcttcttgggattaggaaagatattaaacttacccatttccaacgatcctgtactattgcaggagagatgtggggagggagagaaagagaaagagagagagacgagagaaacattttgaccaaaattccatattcactattgctatgcaaattataaacctaacagagaggtgatgtatcatttttattaaacttatgctgcacaaatagtgtttacatagaagagtataaagttaattccctcccgggaagcatttctaaaaaatataaattgtattttgagagttaatcaatttgttttttctcttttggcattttaattgaagcttccaaaccgtatgcttcctcaaagtatcagaaggcaaatatcagtcgtgtggttataaaatcaactcttaattttctttcaatgaagtagcagatagtcagcttgtaaattttacctacattactatggagctgcagtgctataaattcaaaacagtgtgcaggttggtggaaattgaggtccaggcagcaaggcatgtccataaacttttctcaggttattggaacagaacgaatcaaaagcggttcctggttgtatgatattctcttttgatagagcaggctgcttgttgttagcaatccaagtgcagaggttagtcagagcagaatgtaatttctagcaatctgacagacctgcggattgaagcggcaggttttcccttccgatttcagggaattgcttcttactgtgacaaatgattagctgttatctctgactgaatttgatttctacaagcagctgagtcaggtaactttgcagcgtttgagggggttttttacaggaaatgaaatcggctccctagtcatatgtggaccaaatgaaatcttctctgtcagggcaaaattgtgcttttggttaattgaaggcagatttagcatagagggtgtgtgtggtgatgtgtgtgcagggtgtgtgtgtgtgatgctctgatggtgtaggcaggcacacccatgtgtgtacatttacaggaacgagggatcatttcatggattctctcccaactttgaaaatcctgggttcaaacaaaatccctacattctgagcagggttgaagcttttagaataaactataagtggagacagtcatgtgggtgtcagaataatgagccttcatataaggacatcctgtttcaaaagagtttgaactgcaatattaatcaaaacacaatagatactcactgagcatggttttcacaaaagtattcatcaaagggcagctgcattcaaagcaagagatttaggtaaaataagttaatccttgatctcatccaggtttgtgtgtaaattttgaatagggaggggttctagtgatagcaagcgtcctctggatgataaaacaaaaaacgtggcatgggaaattccaggtttatcttgtgcttcttgttcgcttttgatggaatcttaatagtgactacacaattaggatcaggtttatccttctgtttatagtttgtaattgctctggaaatcctgagtttcagtagttcaacttttagtttttaagcagtcggtgagttttttaaaaagttactatcggataatgtttcatagtttctaatcctattacagcaatgtaaaataaactgtatttcccaaatacgaagcaacatcttttattcccagacctcttactttgcaaagaggaaacaccatctttaaggtcatactagtaatactccttattttgtgatgaacataatatactttgtttataaatcctagtttaaaacaacagagatttgtggtaattgacgaagagtaaaaaagtcacaaatactgaatcttcatttttcagatgtgagcacaacattcctaggtatgtactaatatattctaacacggcattgcgctgtcatcaagacttttgtctaaatgtcaccactattatgagcaatacttttgctaaattctttagttgtattccctaaatggcagatacctttggacctctctctcattagctattaaaaagaatagttctttgaaaataacagttctgtgctccctaaacttcttttgttttttgttgagtgatgtcaacttagagttccacactgattgcccttcctccttgctttgtcgccacaaaaggggtgagggggtgccggagtttgacccacacctctggttagtattaatcacacagacatcaggtaatcacctaagtgcactcagacatactaatagaatgatttacagaccaggccctttgtgtttttctaaatctcattttaatttatttaaagtgacagtgaagctagactccaagctaatgagtctgcataaaaatgatttctttttccacctttgtgtttgctaaaactttctgactctgaaatcctgtcagtgaaaaattatttgagatgaaacactgcaaaagaaggtaaggggaaaggagacaaagaatatgatttgatcatcagagacctgccctgggtccaagtgggcctcatggtagccacaagtgtccagatcagacaaatggggacttttgcatatatgttttagtgcttcatccagacttgagtgcttcacagagtctgtgaggcaactcacatcctttggtagctaacaaattggtcctttctgaccagcaagcagtttaagaaagctaagctgtgttgtatgcgtattaaatatagcacgaactgcttggctttgcttaaccttagttgtattaacagattgtttgttttgatgactgcgccgttagcatgccagatgataaggaaatggttttggattagttaggacctataatatagaaactaaataagatgatagacttacaaggatatacatttcctgtaaaaaaaaatgaattcccttatcaggatttacttgaaaggaatatgtcttattacagaaggagaatgccttgaggaatgtgggaaagattaaaggcttttgtcagtagtttaggttgggaccaggtttcctgtgtagccagcccccctgtccccacgtaaatgttttgcttttcctcctctctctctttctctttaaggggaagagtaagcccttctcgctgcctggcggtgtcagattaaataccgagatggcgacaggaaaaaggctggaaggaaaaacaaaagacaggggggtgagagttatcaggttggcgacggaactgcaggcttgtcggactccaatttacagaaatccaaacagattttagttgacacgatctgcaatcattaccgccggagcagagctaattaagaaattagctttcctgattgcctgttctcacagtgatgagtagttgaataatgttgtatggctgaaatgttctaaaaccagacagtttaacaagtgtttagccttttgtggtgatgctgtatttactttatctataatatctgtgctgcatcactatttgtttcctctccttagaagcaccccttgactttttttttccttttccttggttcaccctcttcttcttggcattaagtcagagcttccccccttacttcagccgcgtataggagagaattatcatacagatttgtggcatgtggtacagaaaagttatcggaaacttgtggcacattcaaaagcatatttcctacccgtctaggcatttttcacaagaaaatatcaggtccaaagtggcatttgaagtttctgaatctgactaaatgcagaggtgattgtgaataaataacattaaaaggctttagtcagcaaagatacagtacgagtgagtggagctcattagaaactagccgtggaccccagatatgtcaaaggggggtttgctgagaggtgaccacgcagtcttcataacttcctcatctctcccacaactatcaaacacataggaagatgttatttggagaaaaaaaatagttatgtttaaaaagcttgacaaagaaattaatcaaaatgagcttcatggaccttgtaaaatatggtccaggcacatgtaatgcatatgtaataggcatgcgtaccgatgtgtccatatggacaaatagaaaacccaagagttaaaagtttctgcaaaaagacaacaacttctttccaaattaaatagaaggcttatttgaatataaactttctcgcaatacagcaaaataacaaagattggacaaaggtttccaggtgtcactgttgaaactgcaatgggaggtaagagtattgctagcttcccaaatgaaccacagaaggggaagttgcatcattcaagatgcttatcctttaggatttccaagttttaaaatgtaaatattcatctatggaaaaaccaaaatttccaagttttcctagtacaccttcaaatcatttctacacctaagaaaaataaatactaatttttcttaatgaggcctaataacacctttaacttaccaatttaagagacgctaagtcaatacaatgtgcaggtcccttctggatatttattttcctaagcacaaattcatttataccgaaaaaacagtggatgaaatactagaaaaatcttttctgcactggacctctcttttccagatttacctaagagaatcttaccaggaatggagatagacttttacttcctaagtagatttaaatttaacaccaatttattcactctagtatttctatatgggaactaacagcttctataggacctctacaaagtgccagaaatatgatctcatgtgtagtaataaatttaaatgtgttttcttttacatattctatccctccgtattttcccaatctcttccttttttatgactcccccactctcagtttctaaaatcacttgtccactccggagacccaggggcactgcctagagaaggagctaactttaaaaaaaataaaccaggctggtcacagtggctcatgcctgtaatcccagcgctttgggaggccaaggcaggcggatcacctgaggtcaggagtttgagaccagcctggccaacacatggtgaaaccccatctctactaagaatacaaaaattaaccaggcgtggtggtgggcgcctgtaatcccagctactcgggaagctgaggcaggagaattgcttgaacccgggaggcggaggttgcagtgaaccaaggtcatgccactgcactccagcctgggtgactgagtgagactccagctcaaaaacaaaacaaaacaaaaaaagcaccatactcagagctgctataagtaacatgcagttgtaagccacacacttctttgcatgattcttattttaaagattggaaagtagaattcgtatttgtttgttgtactaattccagtggtatacctggaattaataaatggtactaagacactaaggcgttactttcttgcattattctaaatcagagtgttgattagagagaataatccaaaggtaaaatagtcagataatttatttttatgtaagtttaaaaagagaaagagattgatttttttgaagagttataattacattcagtatgtaccttttgtgcattgaaataattttagattttctgaaaaggaaatattgatgtaattcagctctcaaaacacttgatgccatgcctttcttcctagtgtttatgtaaaagcaagtggtcaattgtcgctgcatcagagctatgacaagttcttctatattaggtgggcatcactcaaacacttttccatagtagatccagtggtatacctggaattaatacaatttattaagtactaagctatgttgtatttattgtattaattccagtggtaatacaattccagtggtaatacaatgtattaattccaggtatacctaccactggaattaatacaataaatacaacatagcttactactcaagtctattacacgccatctaaaatagctaatcagaaaggctgtatgtctgaaacacccaaaagtcactcatcctctttcttaaagcattaaaagttttggcaacttttctgaatccgagttgtgtgagtcctatactgtactaagctggacatcttaagggctgcaggttttaatatttacactgccccgactcagttggtaaccgctagcaaatcatctcaccccagtttttgtccttttcctgaagaaagctgaatttggtttcatgatcactgtttgctgaagaagacagtcccaacaatggtccaaagcaaggccagcttttaaaacagccaccaattctgagtcaaggcatctaccttcattctaatcaagaagggaagatacaaagtttcaagaccagtcttcaccttgcactgaatctgacggggtcttactcagccactttccactacctttcaacctaaaagccaagaaaagcaaggatttggattttaaagctgtacttgttataggtgttcatgggttttgttagcattgttgttttttagggatgaggggtgttactggagtggaagggggagctgtgttgcttttagtttgtcatttaggatgttaaagttagtatgggtttcagtttgcattttaaaaattagaatggtaatgagcaaggtgccagaaggaaataacaaagcacattttcctgaatagctccccctgtcttctgtgttcagattctactctgacttcccaacccggcttcctctcccgcctgctcccttctgaggtgcagtgtagaagttcattctcaggtttctctcagtttgcaggacgagatgctgccggccaggccaagggcagttatgccagctcagtgtagtgcagcttccttgccccagcgtgcgcaggctgaaagctcagccagtttctctttctgaggctgcttcacgtcttctcagggatttccaaggcacggacgttcatttgcctaaaactctcttaaactgcctgacaaaaaaaataagtacctaagtacgacataagtggtacacccacgcaggataattaggattgatgtgctcttttagaggcaccagatcctcaacctccccttactagtgg
